United States Patent 8,344,211 (PLANT NUCLEOTIDE SEQUENCES AND CORRESPONDING POLYPEPTIDES) - sequence listing, part 22

SEQ ID NO: 83037 - DNA, 933 bp, Zea mays
  misc_feature: Ceres CLONE 1568902
  misc_feature: Encodes the peptide sequence at SEQ ID NO. 83038
  misc_feature (823)..(823): n is a, c, t, g, unknown, or other
  misc_feature (826)..(826): n is a, c, t, g, unknown, or other
ctccccgcggtggcggccgctctagaactagtggatcccccgggctgcaggaattcgtctcacccctagaaaaagacgcgtctcttccacagccgcaacctctatccctcgtctggtatcgtctctcccacacccctctgccccaacccagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcataagctgcaccgccagtggaccttctggtacgacatccagtccaagcccaagcccggcgctgcgtggggcacctccctcaaaaaggcgtacaccttcgacaccgtcgaggagttttggggcttgtatgatcatgttttccgtccaagcaagttgcctggaactgctgattttcacctattcaaggctggagtagagccaaaatgggaagacccagagtgtgcaaatggtggtaaatggactgtcccatgcaacagaaagccaacctttgagaccatgtggcttgaaacgttgatggctcttgttggggagcagtttgatgaaacagatgacatttgtggaattgttgctagtgtccgtccaagaggagataagcttgcattgtggactaggactgccagcaatgaagctgtccaggtaaacattggcaagaaatggaaggatgtcatcgactacaatgacaagatcatctacacttttcatgacgactcgagaaggggatagccagcagaagtggacgggtacacgtgtaatcgcacacnaangatgtcgttgtttcgactggaagaggctgaaattggagttttgtgctgaaacggcacagctttcattaatacagcctcgcttactgaggcaatttccgaccctgttt

SEQ ID NO: 83038 - protein, 200 aa, Zea mays
  misc_feature: Ceres CLONE 1568902
  misc_feature (6)..(201): Pfam Name: IF4E Pfam Description: Eukaryotic initiation factor 4E
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYNDKIIYTFHDDSRRG

SEQ ID NO: 83039 - DNA, 915 bp, Zea mays
  misc_feature: Ceres CLONE 1568904
  misc_feature: Translation starting site: 454
  misc_feature: SWISSPROT Homolog: EC 2.7.11.24 Mitogen-activated protein kinase
ctccccgcggtggcggccgctctagaactagtggatcccccgggctgcaggaattcgtctcacccctagaaaaaatgccatttgctttgctgactaatagctttcgatgatacactactgttcaattaaccgtacgttgtttcgccacaagactcagtggaaatgggagttcttcaccgagtactgagaggcaatccagtaccagatccacacaaatcattggtaaaggcatctacggggtagttgctgcagctgtagataccctcaccggtgagcgggttgctatcaagaagatcatcgatgtgtttgagcatgtctcggacgccactctcatactgcgggagatcaagctccttcagttgcttcgtctcccagacatagttgagattaagcacatcatgctccctccatctcggagggagttccatagatatttatgttgtttttgagctcatggagtctgatctccatcgagtgatcaaggccactgatgacctctcccctgaacatcaccagtttttcctgtaccaacttctgcgtgctctcaagtacatccatgctgctaacgtatctcatcgtgacctacagcccaagaattactgactaactcggactgcatactgaacatacgtgactttggtcttgcccatgcatcattgtatgatgcaccttcagctatattttggacagatgatgtggcaacgagatgataacggacactcgaactatgtcgttcttctttctgccatacactccggcatttgatattaggaagcattgggggcattttgctgaacttctcgctgcagggcacctattcctggggaagatagtgtacaccattacatatcataacagatctgctcgaaactcatcatctgaacacctttctcgatggaaaatgttaaggcaggg

SEQ ID NO: 83040 - DNA, 887 bp, Zea mays
  misc_feature: Ceres CLONE 1568905
  misc_feature: Encodes the peptide sequence at SEQ ID NO. 83041
  misc_feature (658)..(658): n is a, c, t, g, unknown, or other
  misc_feature (687)..(687): n is a, c, t, g, unknown, or other
  misc_feature (758)..(758): n is a, c, t, g, unknown, or other
  misc_feature (831)..(831): n is a, c, t, g, unknown, or other
ctcaccgcggtggcggccgctctagaactagtggatcccccgggctgcaggaattcgtctcacccctagaaaaacacttggtggaagcatatgctcaatttgtgaaagattattacattaaaaaaatggagacaccaccatcctcgtatgatcgagaatatctgaaggaaacaactccacatgattctagttctaggctctggtggttccaagtttgcagtgaggttgcctactttcaagtggcacccaaaaatgacagcgttcgttctgcaaggatcaatacgaggtaccatttggacctatgcagacatgtctttggggaaggcgtttatcccgatgtgttcatgacgaacttgtattatggaggcacaagaatcgctgcttctaaaatcgtgtttacaaatggctcccaagacccatggcgccatgcctccaagcagaaatcatcgaaagacatgccgtcgtacataatgaaatgcagaaactgcggacatgggactgatctgaggggctgtccgcagtggcctttcaggatcgaaggggacgcttcgaactgctcgtctctcgctgtagtcaataccgcaaggggagaggatcgccaagcacatcgacctgtggctgtcgcaatgcagcaaaccatcagtaggagcctggtaanccgcggactagtggttcatccactcgggnctcgggaagagtggaaagaggttttggattggatgtcctggagcaaacttgtgtcgggactttggattacngtgttgtgcactttgaaaagcagataaagctgatggtggtaagcagcagtgcccggtacccccacagggtacntgatgcaaggcagggggtggtgctgtctgtggtcgatgccgtcgttccttttctgg

SEQ ID NO: 83041 - protein, 260 aa, Zea mays
  misc_feature: Ceres CLONE 1568905
  misc_feature: SWISSPROT Homolog: EC 3.4.14.2 Dipeptidyl-peptidase II
  misc_feature (219)..(219): Xaa is any aa, unknown, or other
  misc_feature (229)..(229): Xaa is any aa, unknown, or other
HRGGGRSRTSGSPGLQEFVSPLEKHLVEAYAQFVKDYYIKKMETPPSSYDREYLKETTPHDSSSRLWWFQVCSEVAYFQVAPKNDSVRSARINTRYHLDLCRHVFGEGVYPDVFMTNLYYGGTRIAASKIVFTNGSQDPWRHASKQKSSKDMPSYIMKCRNCGHGTDLRGCPQWPFRIEGDASNCSSLAVVNTARGEDRQAHRPVAVAMQQTISRSLVXRGLVVHPLGXREEWKEVLDWMSWSKLVSGLWITVLCTLKSR

SEQ ID NO: 83042 - DNA, 937 bp, Zea mays
  misc_feature: Ceres CLONE 1568907
  misc_feature: Translation starting site: 278
  misc_feature: SWISSPROT Homolog: EC 3.6.3.14 H(+)-transporting two-sector ATPase
  misc_feature (453)..(453): n is a, c, t, g, unknown, or other
  misc_feature (462)..(462): n is a, c, t, g, unknown, or other
ctccccgcggtggcggccgctctagaactagtggatcccccgggctgcaggaattcgtctcacccctagaaaaaacccagcggcttcccccaaacaaaacctcttctccgccagagtccgcgtcggccagatcaaacgaatcggcacgacgcatcggcatcgcctccgacgatcttgagacaaacaaaacccaccgctgcggcaactccgcctcccgctgacacggggatcgcctgacaacaggcagagaaaagaggcgcagggtttgcccgcgaagatggaggacgtggacgtctcgcggcagctgaagcagatgacgaacttcatccgccaggaggccgtcgagaaggccgccgagatcgaggccgccgccgccgaggaagtcaaatagaaaagttgcagctggtggaagctgaaaagaagaagatcaggcaggtatatgaccgggaagangtagcagtnggcatcaagaagaaaatttgatactcgatgcagctcaatggctccagaaataaagtccctcaagctcaggatgatttggtaacagatatggtgggagtcagcagggaaagagctactgggcataaagtagagatcaccccactaacaggagctccccaagacactatttggtcaaaatttgctgcccctgaaaaaacagctggggcttcccgcggaggaaaggagaactccacccggggaaattagtgggaatccgcagggaatggttgccaaaaagcaaagtttccccccggaaaagggggaatggaaaatttttggccattgggcccagatataggggccgggccccctggcccgggggggtgggcacccccaaaggagaaatgggtggaaaacccggggcgtattggggggtttcaaaagaccgcaaaattcgaacccttgggggggcgcggccatttttgaaaagagggcc

SEQ ID NO: 83043 - DNA, 958 bp, Zea mays
  misc_feature: Ceres CLONE 1568908
  misc_feature: Translation starting site: 420
  misc_feature: SWISSPROT Homolog: EC 3.1.3.16 Phosphoprotein phosphatase
  misc_feature (793)..(793): n is a, c, t, g, unknown, or other
  misc_feature (862)..(862): n is a, c, t, g, unknown, or other
ctccccgcggtggcggccgctctagaactagtggatcccccgggctgcaggaattcgtctcacccctagaaaaacaatccgaatcccctccaaaaacccaccataccgtctcccccatctgcaagaacaagatcaggagagcatcctagggggaagaaacaggagggggaaaaagaagcccagaaagaccaactgaccaaacaaaaaggtggcatctttgtgtcaccgaggcaccgccgatcacagaccaaagcccgctcctctggtccatcccaagcgtacagcagccgagatttcttcgatctgcgcttgcgtttttttttcttgtaaagattttagttttccccccttcaactgttgctagccttgagtcgctgagaagtttcgagaagggtggtgtgagtgtcggatagctcaagatggatccggcgttgctggacgacgtcatacgccggcttctggaggtgaagaatctcaagcctgggaagaacgcgcagctgtcagagtcggagattaagcagctctgcgctgccgccaaggagatcttcctgcagcagcccaacctgctggagctcgaggcccccatcaaaaatctgcggtgatgtccatggccagtactctgatctcctgaggctatttgattatggtggcttatcgcctcaggccaactacctttttcttgggtggatttatgtggatcctggaaagcaaagcctagaaacaatatgtcttccttttggcttacaagggcaaagtaccccgaagaacttctttccttcttaaggggcaaccnatgaaatgcggcatcagtaaaatccgcatccaatggttttttttgaacgaggggcaaacgccagattcnagtggataagacctgtggaaaaaccatttcaccaaacggtgttttaacggcctttgccagaggttcacgcatttgataaaatgaaaaaagattccc

SEQ ID NO: 83044 - DNA, 977 bp, Zea mays
  misc_feature: Ceres CLONE 1568909
  misc_feature: Encodes the peptide sequence at SEQ ID NO. 83045
  misc_feature (786)..(786): n is a, c, t, g, unknown, or other
  misc_feature (889)..(889): n is a, c, t, g, unknown, or other
  misc_feature (909)..(909): n is a, c, t, g, unknown, or other
tggagctccccgcggtggcggccgctctagaactagtggatcccccgggctgcaggaattcgtctcacccctagaaaaaacagaccctaaccctagcgctcccgacgcgccgcggagcgatggcgatggacgcggagcggcggcaggcggagctgatcgcgcagttctccgctcaggcggcggcgctttcgtccgcgccccagctcgccgcgctggtgcttgaggccacctcccacccggccctcttcgccttctccgagctcctcaccctcccggccctctccaagctcactggcacgcagtacgcgtcgtcactggacttgctccggctcttcgcctacggtaccctgaatgactacaagagtaattctggattccttccagcactgttgcctgaccaggtccgaaagctaaagcagctcagcgtgctaactctggcagagtcaactaagatactaccgtatgatcagctcatgcaagagttagacgtttcaaatgtaagagaactcgaagatttcctaatcaatgagtgcatgtattcgggtatcgttagaggcaaactggatcagctgagaaggtgctttgaggtacaatttgcagctggaagagatcttacacctgatcagctaaagacatgatagagactttgtctgattggttgggaacatcagatagactgttgcatcaaattcaggagaaaatcaagtgggctgacacaatgagtgagggtgaacagaagcaccagaaagatttgaagacagagtggaagaggccaaaaaatcatcnaggcagacattgacttacggggggcatgacgagtttctctctgaatctgggaggataatggattttgaaaaaggaccgccgtccgacaaaaaggaggaggcancccccggggtagttccattnagcccttacaattctcctccagaatgggaccggcggatccctggtatgagaatttttgaagcgcggag

SEQ ID NO: 83045 - protein, 172 aa, Zea mays
  misc_feature: Ceres CLONE 1568909
  misc_feature (63)..(159): Pfam Name: PCI Pfam Description: PCI domain
MAMDAERRQAELIAQFSAQAAALSSAPQLAALVLEATSHPALFAFSELLTLPALSKLTGTQYASSLDLLRLFAYGTLNDYKSNSGFLPALLPDQVRKLKQLSVLTLAESTKILPYDQLMQELDVSNVRELEDFLINECMYSGIVRGKLDQLRRCFEVQFAAGRDLTPDQLKT

SEQ ID NO: 83046 - DNA, 913 bp, Zea mays
  misc_feature: Ceres CLONE 1568910
  misc_feature: Translation starting site: 280
  misc_feature: Pfam Name: UDPG_MGDP_dh_C Pfam Description: UDP-glucose/GDP-mannose dehydrogenase family, UDP binding domain
  misc_feature: Pfam Name: UDPG_MGDP_dh Pfam Description: UDP-glucose/GDP-mannose dehydrogenase family, central domain
  misc_feature: SWISSPROT Homolog: EC 1.1.1.22 UDP-glucose 6-dehydrogenase
  misc_feature (750)..(750): n is a, c, t, g, unknown, or other
  misc_feature (764)..(764): n is a, c, t, g, unknown, or other
ctccccgcggtggcggccgctctagaactagtggatcccccgggctgcaggaattcgtctcacccctagaaaaaatgacatcctgaacctggtgtacttctgcaagtgcaatggcctgcccgacgtggtgaacttgtggaatgaagcgatcatgatcaactactaccacaatatccggttcgtgtactggtgtctgtcgtctatgttcaactccgttgccggccagaacatcgccctccttggcttcgccttcaagaaggacaccgtggaaccctcgggatgaccccggccatctatgtcaggaagggcctgtttggtgacgacgtccacatcagcatgtactactcctacgtgacggacgactacattcagcgggacctagccatgaacaaattctactggcaccacgccgatgcacctgcagccgacgagcacgacagccctgaagcttgtgagctagcaatgtggcacgcctactaagccacttacggcgcccactggctgtgcttcctgaccgagtgtgacgagttctagaccctggacttccagatgatcttcgacatacatgcataagcccgccttcttcatctacggccgcgacatcgtcaactcctagacgctgagagagatcgtcttcatcatctactgcatctgcaaggcgctctactcatgcctctatgacatgcccgcgggcgcctaagtcctccccacttacctatgcattggatcctcgcaagtattagagacaanctgctcgacgttcntaaatacagtatgcttctgcaggctacgctacacattttctcatgtgtgaagcataataaacgtcggacgggctgctagtatgccccgctgggtggtgttgcgttaacggagtaccctgatgatgtataattcacaggaccgttttgtg

SEQ ID NO: 83047 - DNA, 883 bp, Zea mays
  misc_feature: Ceres CLONE 1568917
  misc_feature: Encodes the peptide sequence at SEQ ID NO. 83048
  misc_feature (768)..(768): n is a, c, t, g, unknown, or other
  misc_feature (769)..(769): n is a, c, t, g, unknown, or other
  misc_feature (785)..(785): n is a, c, t, g, unknown, or other
  misc_feature (825)..(825): n is a, c, t, g, unknown, or other
ctccccgcggtggcggccgctctagaatagtggatcccccgggctgcaggaattcgtctcacccctagaaaaaaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctggctcaaggagatccctctccaccccnntcagaagtggatgctncagcagcagctcaaccaggacgacgacccttttcagctgnctggcgtcgccatgtactactgatacaccgtaccgtcgttctctggttgccgtttctg

SEQ ID NO: 83048 - protein, 252 aa, Zea mays
  misc_feature: Ceres CLONE 1568917
  misc_feature (30)..(215): Pfam Name: Ribonuclease_T2 Pfam Description: Ribonuclease T2 family
  misc_feature: SWISSPROT Homolog: EC 3.1.27.1 Ribonuclease T(2)
  misc_feature (227)..(227): Xaa is any aa, unknown, or other
  misc_feature (246)..(246): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTWLKEIPLHPXQKWMLQQQLNQDDDPFQLXGVAMYY

SEQ ID NO: 83049 - DNA, 936 bp, Zea mays
  misc_feature: Ceres CLONE 1568921
  misc_feature: Encodes the peptide sequence at SEQ ID NO. 83050
  misc_feature (654)..(654): n is a, c, t, g, unknown, or other
  misc_feature (850)..(850): n is a, c, t, g, unknown, or other
ctccccgcggtggcggccgctctagaactagtggatcccccgggctgcaggaattcgtctcacccctagaaaaaaactcgaagtacgagtacctccggagtccggatggctgcagcgatggacgtcgacgaagccggcggcgaggagaggcgaccgtcggagaaggagctcttccgcgccgccgagtccggcgacgccgccgcgttcgcctccctcgcccccgccgacctctccctgcgcaacgaggacggccgctccctcctccacgtcgccgccgctgccggccatccccaggtggtgctcgcgcttgcccagtgcggtggtgacgccgcggctagcgtgctgaatgcgcaggacgaggaggggtgggcgccgatccactccgccgcgagctccggcaactctcaaatcgtcgacatcctgcttgagcgaggtgctgatgctaacctggttactgatggtggccgaactgctcttcattatgctgcgagtaaagggaggcttaacatagctgaaaaactaatagcccatggtgctaatgtcaacaagaaagacaagtttggctgcacacctttgcatagagctgcaagcactggaaacgcggagctgtgtgattccctcattgaggaaggtgctgaagttgatgctgttgancagacaggacaaacacctcttacgcatgctgttatatgtgagaacaaaggggctgctcttctgctaattagacatggtgctgattgtgatgtcaaggacaaggaggctacccggccctgggcgagcatcgaacagcttcgacctgccctcatcgatgcagccaaggcatgctccgaggatgatcttgtgctctgcntcaagacgatggaaagggggtacgaagaactgtgctgagtcaaggtgttaaagctggtctggggggtaacaaaggggctctcaaat

SEQ ID NO: 83050 - protein, 260 aa, Zea mays
  misc_feature: Ceres CLONE 1568921
  misc_feature (119)..(151): Pfam Name: Ank Pfam Description: Ankyrin repeat
  misc_feature (86)..(118): Pfam Name: Ank Pfam Description: Ankyrin repeat
  misc_feature (152)..(184): Pfam Name: Ank Pfam Description: Ankyrin repeat
  misc_feature (185)..(217): Pfam Name: Ank Pfam Description: Ankyrin repeat
  misc_feature: SWISSPROT Homolog: EC 2.7.11.1 Non-specific serine/threonine protein kinase
  misc_feature: The sequence is a functional homolog of SEQ ID NO 1841 in the 10/374,780 US patent application
  misc_feature (183)..(183): Xaa is any aa, unknown, or other
  misc_feature (249)..(249): Xaa is any aa, unknown, or other
MAAAMDVDEAGGEERRPSEKELFRAAESGDAAAFASLAPADLSLRNEDGRSLLHVAAAAGHPQVVLALAQCGGDAAASVLNAQDEEGWAPIHSAASSGNSQIVDILLERGADANLVTDGGRTALHYAASKGRLNIAEKLIAHGANVNKKDKFGCTPLHRAASTGNAELCDSLIEEGAEVDAVXQTGQTPLTHAVICENKGAALLLIRHGADCDVKDKEATRPWASIEQLRPALIDAAKACSEDDLVLCXKTMERGYEELC

SEQ ID NO: 83051 - DNA, 919 bp, Zea mays
  misc_feature: Ceres CLONE 1568922
  misc_feature: Encodes the peptide sequence at SEQ ID NO. 83052
  misc_feature (658)..(658): n is a, c, t, g, unknown, or other
  misc_feature (661)..(661): n is a, c, t, g, unknown, or other
  misc_feature (681)..(681): n is a, c, t, g, unknown, or other
ctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgccacctagagatggatccgcaccaagagcaccaaggggtggtgggtggtggcggcngcngcaccagctttgtcgattcngggaacaaagtatacgtgggggaaccttgcatggggcgttgacaactcgactctggaggacctattcagtgagcaaggacaggtgctggatgctaaggtcatctacgacaggaattagcgcaggtcaaaggggggtttggtttcgtcaactatggctctggcgagggaggtcacaatggcttatcaaaccttgagggcttaacttgggatggtagacgatccgcagtccgggtgcgaa

SEQ ID NO: 83052 - protein, 245 aa, Zea mays
  misc_feature: Ceres CLONE 1568922
  misc_feature (79)..(150): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (174)..(174): Xaa is any aa, unknown, or other
  misc_feature (175)..(175): Xaa is any aa, unknown, or other
  misc_feature (182)..(182): Xaa is any aa, unknown, or other
MAAALFSTSLSPRFLALSSPKPAAPAASAFLPFTLPLRSVSAPAPARRVFEPVAVAVSSEYGTEGAEQQDGEFSEDLKLFVGNLPFSVDSAQLAGLFEQAGSVEMVEVVYDRMTGRSRGFGFVTMSSAEEAGAAVEQFNGYTFQGRPLRVNCGPPPPRDGSAPRAPRGGGWWRXXHQLCRFXEQSIRGGTLHGALTTRLWRTYSVSKDRCWMLRSSTTGISAGQRGVWFRQLWLWRGRSQWLIKP

SEQ ID NO: 83053 - DNA, 881 bp, Zea mays
  misc_feature: Ceres CLONE 1568923
  misc_feature: Encodes the peptide sequence at SEQ ID NO. 83054
  misc_feature (760)..(760): n is a, c, t, g, unknown, or other
  misc_feature (795)..(795): n is a, c, t, g, unknown, or other
  misc_feature (826)..(826): n is a, c, t, g, unknown, or other
  misc_feature (845)..(845): n is a, c, t, g, unknown, or other
tccccgcggtggcggccgctctagaactagtggatcccccgggctgcaggaattcgtctcacccctagaaaaaaagaaccaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaaccccggcagcgtcaaccaggtacccatcttcaagagctacagcctgccgccgcacgagtgcggctaccccggcagcgtcttcaacccgctcaacttcgcgcccacgctcgaaggctagggagatgagctcgccnacgggaggctgggcatgctggcgttcctgggcttnctgatcagcacacgtcaccgggaagggcccntcgacacctgctggagcanctggtcgaccatggcacacacatcatcaagaccctt

SEQ ID NO: 83054 - protein, 201 aa, Zea mays
  misc_feature: Ceres CLONE 1568923
  misc_feature (62)..(199): Pfam Name: Chloroa_b-bind Pfam Description: Chlorophyll A-B binding protein
MASVTARAPVAALRPSASLKSSSSSAAAFLGHSSRLGRTATASPTRRSLKAEAKGEWLPGLPSPAYLDGSLPGDNGFDPLGLAEDPENLRWYVQAELVNGRWAMLGVAGMLIPEVLTKAGLINAPQWYDAGKSEYFASSSTLFVIEFILFHYVEIRRWQDIKNPGSVNQVPIFKSYSLPPHECGYPGSVFNPLNFAPTLEG

SEQ ID NO: 83055 - DNA, 945 bp, Zea mays
  misc_feature: Ceres CLONE 1568926
  misc_feature: Encodes the peptide sequence at SEQ ID NO. 83056
  misc_feature (864)..(864): n is a, c, t, g, unknown, or other
  misc_feature (916)..(916): n is a, c, t, g, unknown, or other
ctccccgcggtggcggccgctctagaactagtggatcccccgggctgcaggaattcgtctcacccctagaaaaatccagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccgcctcgacgacgccgtcctctacgtcgacgtcgtccacgccaacgccgcccagggcgtcaagccgctcgtcggctccgcgcgcctcccgctccgcgacgtcctcgacgacgccggggtcgggggcaaggcctcgcgcagcctccgcctcaagcgcccctcgggccgcccccacggccgcctcgacgtccgcgtcgccgtcaaggagccgtccaggtactacgaccccaacccctacccggcccccgcggcctacgccaacacgggcggcggcacccgtgacccctacggctcgtccgctgctgctgccggcggctactacggctccggatgcggatacggttccggtgtggcgccttaaaaggtggccgccggctacggcgccgcgcagccctacaccgcagcgccccccgcgggggtgaccttcaacttacggggcggcgccgccgctcagccagcggcagcgtacggcgctcctcctgccgctgcatacggcgctcctcctgtcgccgcaccgnccccgtaaggaaaccgcgcggttgcttcccacgggaagagaaaaacaaaatnggtatggggaccgggcttgcattggcccc

SEQ ID NO: 83056 - protein, 186 aa, Zea mays
  misc_feature: Ceres CLONE 1568926
  misc_feature (7)..(95): Pfam Name: C2 Pfam Description: C2 domain
MGSRYEVEVTVGSARDLKNVNWRNGDLKPYAVVWIDSGSKCSTRVDLDNGESPAWDEKLLVPLPPTSRLDDAVLYVDVVHANAAQGVKPLVGSARLPLRDVLDDAGVGGKASRSLRLKRPSGRPHGRLDVRVAVKEPSRYYDPNPYPAPAAYANTGGGTRDPYGSSAAAAGGYYGSGCGYGSGVAP

SEQ ID NO: 83057 - DNA, 925 bp, Zea mays
  misc_feature: Ceres CLONE 1568927
  misc_feature: Encodes the peptide sequence at SEQ ID NO. 83058
  misc_feature (864)..(864): n is a, c, t, g, unknown, or other
ggagctccccgcggtggcggccgctctagaactagtggatcccccgggctgcaggaattcgtctcacccctagaaaaacattcattcacacaccacacctcccgaactacaagtttcgcttctcgtcgcgacgactgggcgagaccgccgccgccgcctgagttctgtagaaatggctgatggtgaggacatccagcctcttgtctgcgacaatggcactggaatggtcaaggctggttttgctggcgacgatgcaccaagggctgttttccctagtattgttggccgtcctcgccacactggtgttatggtagggatgggacagaaggatgcgtatgttggcgacgaggcacagtccaagagaggtattctcacgctcaagtatccgatcgagcatggtattgtgagcaactgggatgacatggagaaaatctggcatcacactttctacaacgagcttcgtgttgccccagaggagcaccctgtgttgctcactgaggctcctttgaacccaaaggccaacagggagaagatgacccagattatgttcgagactttcaatgttcctgccatgtacgttgcaattcaagcagtgctgtcactctatgccagtggacgtactactggtattgttctcgactctgggtgatggtgtgagtcacactgtgcccatttatgaaggatatgcccttccccatgccattcttcgtctggatcttgctggtcgggactcacagactccctcatgaaatctcactgagaggggttattcctcacaacctctgccgagcgagaaattgtgaggaacatcaaggagagcttgctatatagctctgactatgagcaaaagtggagactgccagnacagctctcagttgaaagactttgagctgcctgatggccagtatcccatcggcgcaaggga

SEQ ID NO: 83058 - protein, 158 aa, Zea mays; identical to SEQ ID NO: 75052
  misc_feature: Ceres CLONE 1568927
  misc_feature (4)..(159): Pfam Name: Actin Pfam Description: Actin
  misc_feature: SWISSPROT Homolog: EC 2.7.10.2 Non-specific protein-tyrosine kinase

SEQ ID NO: 83059 - DNA, 854 bp, Zea mays
  misc_feature: Ceres CLONE 1568928
  misc_feature: Encodes the peptide sequence at SEQ ID NO. 83060
  misc_feature (640)..(640): n is a, c, t, g, unknown, or other
  misc_feature (808)..(808): n is a, c, t, g, unknown, or other
  misc_feature (820)..(820): n is a, c, t, g, unknown, or other
  misc_feature (821)..(821): n is a, c, t, g, unknown, or other
cggccgctctagaactagtggatcccccgggctgcaggaattcgtctcacccctagaaaaacaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcnggccgctcggcgaagtcgtcgacccgctgtacccttggcggaagcttcaaccccctcggcctgggcaacaaacccgaaaggctttgcccaaactccaaggggaaagggacccaaaaaaggccccccccccccccaggtttttttattttgggggggggtttttttttnccgcgggcgccnnccccccccccccggggggggggggggggggggg

SEQ ID NO: 83060 - protein, 246 aa, Zea mays
  misc_feature: Ceres CLONE 1568928
  misc_feature (61)..(191): Pfam Name: Chloroa_b-bind Pfam Description: Chlorophyll A-B binding protein
  misc_feature (176)..(176): Xaa is any aa, unknown, or other
  misc_feature (232)..(232): Xaa is any aa, unknown, or other
  misc_feature (236)..(236): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGXPLGEVVDPLYPWRKLQPPRPGQQTRKALPKLQGERDPKKAPPPPRFFYFGGGFFFXAGAXPPPPGGGGGG

SEQ ID NO: 83061 - DNA, 780 bp, Zea mays
  misc_feature: Ceres CLONE 1568929
  misc_feature: Encodes the peptide sequence at SEQ ID NO. 83062
  misc_feature (312)..(312): n is a, c, t, g, unknown, or other
  misc_feature (367)..(367): n is a, c, t, g, unknown, or other
ctccccgcggtggcggccgctctagaactagtggatcccccggtgctgcaggaattcgtctcacccctagaaaaactgtgatgtaacacttatgtcactggcatatgccgggacaggaaatgtgcttaaggttcagaaacttcttggcatttgctcacagcatcttgagaaaggtgaaacacaccaagggccagctgtcctagggattgctcttattgctatggctgaagaattaggagctgaaatggctgtacgttcacttgagcgtcttctgcagtatggcgagcagaatataagacgggcagtccctcnttgctcttggtatactctgcatatctaatcccaaggtaaacgttatggtacacanctaagcagaattgagtcatgatgcagacgcccgatgtgtcgatggctgcattatctcattgggttgattgtgcctggacaaacatgcagaattactgcatgcttccaatctttcaagtatactacaaagaactgccacccgttttgggttaaattgcccagggcttgttcccccggaaaggctttgtaacccttccccttaccattcaaaaaattccttcccccccccaatggccttggggggcctttaacccttttccccccggggcttttttttaaaaccccccccccccggggaaaaaaccccaaaccccccctaaaattttttttccccgggaaaaagacccccacaaaaattttttttaattgcccaaaaaaatatttaaaaacccccctgtgtttaaccccttcgca

SEQ ID NO: 83062 - protein, 82 aa, Zea mays
  misc_feature: Ceres CLONE 1568929
  misc_feature (74)..(74): Xaa is any aa, unknown, or other
MSLAYAGTGNVLKVQKLLGICSQHLEKGETHQGPAVLGIALIAMAEELGAEMAVRSLERLLQYGEQNIRRAVPXCSWYTLHI

SEQ ID NO: 83063 - DNA, 1333 bp, Zea mays
  misc_feature: Ceres CLONE 1568930
  misc_feature: Encodes the peptide sequence at SEQ ID NO. 83064
  misc_feature (58)..(58): n is a, c, t, g, unknown, or other
  misc_feature (989)..(989): n is a, c, t, g, unknown, or other
  misc_feature (1072)..(1072): n is a, c, t, g, unknown, or other
  misc_feature (1073)..(1073): n is a, c, t, g, unknown, or other
  misc_feature (1075)..(1075): n is a, c, t, g, unknown, or other
  misc_feature (1077)..(1077): n is a, c, t, g, unknown, or other
  misc_feature (1088)..(1088): n is a, c, t, g, unknown, or other
  misc_feature (1141)..(1141): n is a, c, t, g, unknown, or other
attattttttttcctttttcgggtgctcgcaagcttataagggccctaactctataanatactaacttttttggtggggctccccgcggtggcggccgctctagaatagtggatcccccgggctgcaggaattcgtctcacccctagaaaaaaagcagaagcagcgcaatggcgagcatctccttggccctctcctccacaggcttcgccggcaaggcagtgaacgtgccgtcgtctctcttcggcgaggcccgcgtgacgatgcgcaagacggcggcgaaagcaaagccggcggcgagctccgggaggccgtggtacgggcccaaaagcgtgctctacctgggcccgctgtccagggcgcccccgaactacctgacgggcgagttgccggggggactacggttgggacaacccggggggtgtcgagtggacccgaaaaagtttccccaagaacccggaagctggaaagtgttgccccccccccctgggcattgatggggcacataggggcaggctggttcccggaactttcctgcccaccaaaaggggggttaagtttccggcaaggacattttgggttccaagggccgggtgcccaaaaatctttccaaaaaaggggggggggtgggaactccccgcggggaatcccggggaccctggtatcctgcgggggaagaaggaattcttctccccaatatttgggggccctggccctaggggtgacagtgtgtcccctgggggcgccctcaataaaaggggggtgcaccccgatgttctccacccgtgggggtggcccccattactctggagaaagagggccgctctggaataacaaaaacttattgtgattcccgcggtggggtgtcgcaccgtctcttttatgataacacaataggggtgcgaacctcctctccccacatagagaaatacccctttataggaggccctctcctgacacagcaaggacctctcataacatgtgtgctganatgatacacgtccatatttaagataaatcgggggggcgccagtttcacacgcggtgggttcttttatatttaggggcagctgnngntntctctctcgcncaccaatgagcggcagttttagtgttctcaccctgacatgaggaggagggccntccctctctatgtaaaaatactacgcgcgcggagataaatatgagttgctgagaggagcggacggtgtgaaaaaataattatccagcgatgtgggaggtggttttatgagcaccataattatttttgtacacacccccgattaaataaaaaaagaggatgtgtgaatactgggccacatcccacacagagag

SEQ ID NO: 83064 - protein, 108 aa, Zea mays
  misc_feature: Ceres CLONE 1568930
MASISLALSSTGFAGKAVNVPSSLFGEARVTMRKTAAKAKPAASSGRPWYGPKSVLYLGPLSRAPPNYLTGELPGGLRLGQPGGCRVDPKKFPQEPGSWKVLPPPPGH

SEQ ID NO: 83065 - DNA, 984 bp, Zea mays
  misc_feature: Ceres CLONE 1568931
  misc_feature: Encodes the peptide sequence at SEQ ID NO. 83066
  misc_feature (383)..(383): n is a, c, t, g, unknown, or other
  misc_feature (427)..(427): n is a, c, t, g, unknown, or other
  misc_feature (430)..(430): n is a, c, t, g, unknown, or other
ctccccgcggtggcggccgctctagaactagtggatcccccgggctgcaggaattcgtctcacccctagaaaaaacagagtcacttcgccacgaacaaaagcgcatcgatctcgctgtcgtcactcctcgtcacccagccacgaacagaggcaccacccagcatggccctgcaggcggcgctcctcccatccaccctctcatccgtccccaagaagtgcagcatcgccgtcgcggcgaaggacacggcattccttagcgtatcccagaagaaggtgcaggcggcgtcgctgtcggtgagaacgcgggtggcgacgacggcgcctgtggccacgccggggtccagcacggcggccaatgatggtaagatgacgtgcggcatgtncgtggtggtgatcacgggcgcgtcgtcgggggttgggcctggcngcngcccaaggcgctgccgagaccgcaagtggccacgtggtgattgccctgccgcgacttcctcaagggggccaaaggcgccaataggcgcccggaatggcggacggcagcttacccatcatgccacctggaactggcctcccctcaacagcgtgggggaatttcttgagaaagttccggggcgcccggaatgccccttaaatccccttggttggaaaagccgccattttacgggccccagggaaaggaacccaaattttccggggggagaggaaaaaaaaaaaagggcgggggtaacccaccgggggccttttcccctgggggcgccggcccggaaaaaaatgaaaaaattcaaatacccggccccccccgctaataatcccggggcccccccgggaaaaaaaaaacgggggggggaaacaacccccaaggggggggggggaaaccccccgccccccggggggggggggcgagcaaaaagcctcctctttaaaagggccaaaaaattctccgcgccggcggtgtaaaaagaaaataattattcccctcccccgcgg

SEQ ID NO: 83066 - protein, 263 aa, Zea mays
  misc_feature: Ceres CLONE 1568931
  misc_feature: SWISSPROT Homolog: EC 1.3.1.33 Protochlorophyllide reductase
  misc_feature (74)..(74): Xaa is any aa, unknown, or other
  misc_feature (89)..(89): Xaa is any aa, unknown, or other
  misc_feature (90)..(90): Xaa is any aa, unknown, or other
MALQAALLPSTLSSVPKKCSIAVAAKDTAFLSVSQKKVQAASLSVRTRVATTAPVATPGSSTAANDGKMTCGMXVVVITGASSGVGPGXXPRRCRDRKWPRGDCPAATSSRGPKAPIGARNGGRQLTHHATWNWPPLNSVGEFLEKVPGRPECPLNPLGWKSRHFTGPRERNPNFPGGEEKKKRAGVTHRGPFPLGAPARKKMKKFKYPAPPANNPGAPPGKKKRGGETTPKGGGGNPPPPGGGGRAKSLLFKRAKKFSAPAV

SEQ ID NO: 83067 - DNA, 959 bp, Zea mays
  misc_feature: Ceres CLONE 1568932
  misc_feature: Encodes the peptide sequence at SEQ ID NO. 83068
agctccccgcggtggcggccgctctagaactagtggatcccccgggctgcaggaattcgtctcacccctagaaaaattatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatgggagtcaagtaacatcatggaagaatgacaatgggggagacttgccttttcctcagcagcaaggctattttcaaaccctccaaaagctattccgtggtgggaataccaatctgctttcccccaatttggatcccatggaaaatccttggacaacttggaattcgcttgggaaacgggtttttgaactttttgacaaacaatcccacctccctttaccctttaaaaccccggcattttaaaaccttttgtgttgttccggatttctgaaagccctcccggagaaggaatttaaaaaattcggggcccccacaagtttttgaatttcccgtttaaaaaagttggcccttgggacccttccgggagattttggggtccccccctccccaattcggggaaaccacacacccgaagggggaaacccctttccccttaaaaatttggacaattacacccaaattttctcgtgtttttgaaaaaaagaaggggggggggtttctcaaaggcgggagaaaattgtgggcgccccccgcggcccttttaggggcgaggagaaatttttcccaaaaaaaggggggtggtcttttttttttttaaa

SEQ ID NO: 83068 - protein, 114 aa, Zea mays
  misc_feature: Ceres CLONE 1568932
MQLPSPFAELVKGPSGLEKVVLRGARNCCAEIYLYGSQVTSWKNDNGGDLPFPQQQGYFQTLQKLFRGGNTNLLSPNLDPMENPWTTWNSLGKRVFELFDKQSHLPLPFKTPAF

SEQ ID NO: 83069 - DNA, 928 bp, Zea mays
  misc_feature: Ceres CLONE 1568933
  misc_feature: Encodes the peptide sequence at SEQ ID NO. 83070
  misc_feature (722)..(722): n is a, c, t, g, unknown, or other
  misc_feature (774)..(774): n is a, c, t, g, unknown, or other
  misc_feature (777)..(777): n is a, c, t, g, unknown, or other
  misc_feature (803)..(803): n is a, c, t, g, unknown, or other
  misc_feature (873)..(873): n is a, c, t, g, unknown, or other
  misc_feature (893)..(893): n is a, c, t, g, unknown, or other
ctccccgcggtggcggccgctctagaactagtggatcccccgggctgcaggaattcgtctcacccctagaaaaacgcaccgtgattgccgagttcaccggcaacagcagtctcgtcgtgccgcaaactgtgagctgggtctccgctgttttcggcggtcgactagctcgccaaggcgtttttcaccagtgaagcatacttgtcatgcccagtgtcctcgccgtgtctgtaaagccgttgtggagttgttgttgttcgcctccacgccatgtgagacagcgtcgtcgatcccttcaaggtgctcgtcgtcgtctcctcatcgccttgccgaacgtctcggaccacaccagcctgtcgctggagaaacatagtgcagtacgatgccccatcaagtgttcggtgttatgcgcgaactagaagtcgttgctgatatcgcggtcttcaagttgagtttattttattggtacgctagtttatcacgtgatgcagaaaacgagtcaactcgactgtaagatgatgtaatgggtgggctactccacaaggtaatgctgatggatcaacctgaagaagaaccgactgaacaagtgccaacacaaaaggatggtcgtcaagtggtcgtcatctaacaaacacttacgtagtgttattccaggcaagccccggtgcatgcaacccccttctgttgggtactttgtctcaaatgctatgagttaagacaaggcnacacaaaatgttaatgggtaaagacattcgtcctttcaagcatttattcccntangatataatgatctttagacaaaggtnatgaaaagacgtaccatcatcatcaccgtatttataatgggagtagaagctatgaaacatgggaaatacntaaatatcctttgatttggncagttcctctttttattcatctgaataaccccctt

SEQ ID NO: 83070 - protein, 62 aa, Zea mays
  misc_feature: Ceres CLONE 1568933
PRGGGRSRTSGSPGLQEFVSPLEKRTVIAEFTGNSSLVVPQTVSWVSAVFGGRLARQGVFHQ

SEQ ID NO: 83071 - DNA, 902 bp, Zea mays
  misc_feature: Ceres CLONE 1568935
  misc_feature: Encodes the peptide sequence at SEQ ID NO. 83072
  misc_feature (21)..(21): n is a, c, t, g, unknown, or other
ctccccgcgggtggcggccgnctctagaactagtgggatcccccggggctgcaggaattcgtctcacccctagaaaaaactgcatcagagcacgaccacactacccacccacctccactactgaccgattcccagaaagctcgatctagcgcgcgcggctgcagagtgcagacgacgacgtacaccatggcgcggcggtccctggccctgctgctcgcgtcgtcgctcgccctcatgtcggccgccgtcgcatcggcggactcgtggctctacgacaagttcaacacggacggcaccgtccgcacccagtacgacgcgtcggggcaggaggtggcgatgctcagcctggaccgcagctccggcgccggcttctactccaaggagcagtacctgtactgcgagttcagcgtccagatgaagctcatccccgggcactccgccgggcacgtctcgtgcttctacctctcgtcgggcgacggcgacgggcacgacgagatcgacatggagttcatggggcacgcgagcgggcagcccggtgtgctgaacacgaacgtgtggggcaagcggcgacggcaagaaggacacccattcgaactcctgttggacccctcggcggattaacaaaccttaccattttttgggaaccgaaccaaatccgggtccagggggaccggaaatgtttccgggggttaagggttaacccaaactggcgtaccgaagggcgaggccctgtgggcttccccccacccctgggggaagggggctcttgggcccccccaaaaaggaaagggccccgggaaaatgttccccccccccttttttttttcctcccgcgggtgttccccccaaacccggggttggttgtaaaacccgggggaagggggtccctttggagacacccc

SEQ ID NO: 83072 - protein, 144 aa, Zea mays
  misc_feature: Ceres CLONE 1568935
  misc_feature (28)..(144): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MARRSLALLLASSLALMSAAVASADSWLYDKFNTDGTVRTQYDASGQEVAMLSLDRSSGAGFYSKEQYLYCEFSVQMKLIPGHSAGHVSCFYLSSGDGDGHDEIDMEFMGHASGQPGVLNTNVWGKRRRQEGHPFELLLDPSAD

SEQ ID NO: 83073 - DNA, 889 bp, Zea mays
  misc_feature: Ceres CLONE 1568936
  misc_feature: Encodes the peptide sequence at SEQ ID NO. 83074
ctccccgcggtggcggccgctctagaactagtggatcccccgggctgcaggaattcgtctcacccctagaaaaagactcgcgtcgcgtcatgtgcgtgtctctcgtctcgttgggattatattccttccccatcctcaccgcttaccaatcacccgataagtagcaggggcagggagaacgaagacgacgacgacgtacgccggccgtaagtgagccgagagcccccgatataccagctagctagataaccagccagcgcgagctgggagggcggcggcggcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggcgccggacctccgcggctacggcggcaccgccgcgccgcccgacgtcgcgtcctactccgccttccacgtcgtcggcgacgtcgtcgccctgctcgacgcgatcggcatcccaacaagatgtttgcattgcatggcgaagcaagtgttcgtggtgggtcacgactggggcgccatcatcgcgtggtacctctggctgttccgggcgggacgggtggcggcgctttgtaacaccagcggtccccttctggccaaattctttgtccggcccgcccgcgccgccttaaggcccatcgaattacttccaccgaacttacgggcccccctacttcttctgccgcttccagaaaagggattctcccccggccaacgccgggtacctgaatgaaccggatactggggaaacggcttcccctcctcgggggggggggaa

SEQ ID NO: 83074 - protein, 173 aa, Zea mays
  misc_feature: Ceres CLONE 1568936
  misc_feature: SWISSPROT Homolog: EC 3.3.2.10 Soluble epoxide hydrolase
MHVAESGPDGGDGAPAVVFLHGFPELWYSWRHQMAHLAARGYRCVAPDLRGYGGTAAPPDVASYSAFHVVGDVVALLDAIGIPTRCLHCMAKQVFVVGHDWGAIIAWYLWLFRAGRVAALCNTSGPLLAKFFVRPARAALRPIELLPPNLRAPLLLLPLPEKGFSPGQRRVPE

SEQ ID NO: 83075 - DNA, 913 bp, Zea mays
  misc_feature: Ceres CLONE 1568937
  misc_feature: Encodes the peptide sequence at SEQ ID NO. 83076
  misc_feature (395)..(395): n is a, c, t, g, unknown, or other
  misc_feature (853)..(853): n is a, c, t, g, unknown, or other
ctccccgcggtggcggccgctctagaactagtggatcccccgggctgcaggaattcgtctcacccctagaaaaaagtaatccgacggaaacgacaagggcgcggcgagggcggggacagggtcggggaggccctgggcgcgggggcgccaagcgcatggcatcgtcgagggtgatgccgtcgtcctcgccgtcgcacacggcctctgatctcgcgcgcctagcgcaggccgccagcaggcccggcggcgggggcagcgggctgggctccatgaacgtggaggagctcctccgcggcatctacagcgacatgcccaccccggcgccgcccgcgtcggagcccgaacgcccgatgtcgccggccccggcgccggtagtcgcccacgcgatgacggcngaggaggtgtggaaggagatcacccgccgaaggtggctatgggggaaccccgtgccccccccgtggcgggttagggtgccgtccccccttggtggtggtgggcccccggcggccccgaaaatgaccctggagacttcccctggccagggaagaaaggccccccgtaaaagaagatggggttttaaggggttttcggggccccctttgggcccgggaaatgggggttcccctgggccaaacacaaaggggcttgggtttgcctcgcgccccccaagagaaggggaatagttgaaaaaaaaaacccgctcctccctcggtattcccggtgagatgccccccccctctagttctccgctatataaaggtgtggtttttatataaacttcctattttttctttcctgcccctctccccggaaaaaatataaaaagttttttatatctccggaagtatattcnccgggggggacccccccccgcagggaggaagaaaaccacccttttttttatataaaaaat

SEQ ID NO: 83076 - protein, 175 aa, Zea mays
  misc_feature: Ceres CLONE 1568937
MASSRVMPSSSPSHTASDLARLAQAASRPGGGGSGLGSMNVEELLRGIYSDMPTPAPPASEPERPMSPAPAPVVAHAMTAEEVWKEITRRRWLWGNPVPPPWRVRVPSPLGGGGPPAAPKMTLETSPGQGRKAPRKRRWGFKGFSGPPLGPGNGGSPGPNTKGLGFASRPPREGE

SEQ ID NO: 83077 - DNA, 985 bp, Zea mays
  misc_feature: Ceres CLONE 1568938
  misc_feature: Encodes the peptide sequence at SEQ ID NO. 83078
  misc_feature (454)..(454): n is a, c, t, g, unknown, or other
  misc_feature (651)..(651): n is a, c, t, g, unknown, or other
  misc_feature (935)..(935): n is a, c, t, g, unknown, or other
ctccccgcggtggcggccgctctagaactagtggatcccccgggctgcaggaattcgtctcacccctagaaaaagtggcaacaagtatgtctagggaattctagttcttgccagcagggtgggagtgctggagtaggattttttattcattgcctgcttggaactaataacctgttcgctttaaggggttcttcaatcgaatcttatatagtgcttatattttaggttgagtggtttatcttttttccgccgggttctaatcctccttggataatgtgcagatggagagggttcgtgagaacaacttcgtcccgttcatccggtcaggggagtggtctgatattggaggtcgcgattacatggaagatgcccatgtgtgcatctctgatctggcgaagaattttggctctaactcagcggatgatgaagtcagaactacagtggagcagagttngggaagggtgttgtcaaaaagtgctggtctcattttgctttgaacccggcagaataacccatggatgacctccactaaaaccttttggatgaagaaagcatcaaaggttacccatgggatggatttttgtgaaatgcacttcactgaaatttaccccctggccatttggtgcttccccaccgatgatactcgcaaangatgcagaatttgccgccgggttttgtgttgattttgtggcaagggaacataaaccccatttatccaaagagcctatgctcctccgtagaagcaagtttaaagtttagcaagttagccccactccggacttggtcctattgaaagtcctctcccggagtgggaaaaaacgctttggcaaccagagttggccatttaaaaggaattttttccccttgggaaaattattatcccccaaaaacatttgttgggtccttgaagcacaaatgcccacaaatttgcaggnttttaagaaccaaaacaactctcttttccaggaaaatcttggaagataca

SEQ ID NO: 83078 - protein, 71 aa, Zea mays
  misc_feature: Ceres CLONE 1568938
  misc_feature (58)..(58): Xaa is any aa, unknown, or other
MERVRENNFVPFIRSGEWSDIGGRDYMEDAHVCISDLAKNFGSNSADDEVRTTVEQSXGRVLSKSAGLILL

SEQ ID NO: 83079 - DNA, 743 bp, Zea mays
  misc_feature: Ceres CLONE 1568939
  misc_feature: Encodes the peptide sequence at SEQ ID NO. 83080
  misc_feature (48)..(48): n is a, c, t, g, unknown, or other
  misc_feature (50)..(50): n is a, c, t, g, unknown, or other
  misc_feature (165)..(165): n is a, c, t, g, unknown, or other
  misc_feature (460)..(460): n is a, c, t, g, unknown, or other
  misc_feature (594)..(594): n is a, c, t, g, unknown, or other
  misc_feature (604)..(604): n is a, c, t, g, unknown, or other
  misc_feature (613)..(613): n is a, c, t, g, unknown, or other
  misc_feature (618)..(618): n is a, c, t, g, unknown, or other
  misc_feature (628)..(628): n is a, c, t, g, unknown, or other
  misc_feature (635)..(635): n is a, c, t, g, unknown, or other
  misc_feature (653)..(653): n is a, c, t, g, unknown, or other
  misc_feature (654)..(654): n is a, c, t, g, unknown, or other
  misc_feature (658)..(658): n is a, c, t, g, unknown, or other
  misc_feature (665)..(665): n is a, c, t, g, unknown, or other
  misc_feature (688)..(688): n is a, c, t, g, unknown, or other
tccccgcggtggcggccgctctagaatagtggatcccccgggctttgncnaggaattcgtctcacccctagaaaaactgtgatgtaacacttatgtactggcatatgccgggacaggaaatgtgcttaaggttcagaaacttcttggcatttgctcacagcatcnttgagaaaggtgaaacacaccaagggccagctgtcctagggattgctcttattgctatggctgaagaattaggactgaaatggctgtacgttcacttgagcgtcttctgcatatggcgagcagaatataagacgggcagtccctcttgctcttggtatactctgcatatctaatcccaagtaaaacgtatgggaccacacttaagcaaaattggagtccatgattgcagaaccccccaatgttgtccgaatgggctgccaatttatccctcattgggggtttggaattggggtgngcccttggggcccccaaaaaccacaattttgccccgaaattaagcctgggggcaatgggtcttcccgccacaaaatctcttttttttcccaagggttttttttttacccctccccccaaaaagaaaaaaagagngcccgggcgnccccctcanattcncgtggtgggnttgtttnttttgttggggtgtgtgnntttnattaaanaaaaaaaaattttttgtgggggncccccacacagggggcctcttctttttttgttttttcccacaccctcccgggaaa

SEQ ID NO: 83080 - protein, 81 aa, Zea mays
  misc_feature: Ceres CLONE 1568939
  misc_feature (25)..(25): Xaa is any aa, unknown, or other
MYWHMPGQEMCLRFRNFLAFAHSIXEKGETHQGPAVLGIALIAMAEELGLKWLYVHLSVFCIWRAEYKTGSPSCSWYTLHI

SEQ ID NO: 83081 - DNA, 869 bp, Zea mays
  misc_feature: Ceres CLONE 1568940
  misc_feature: Encodes the peptide sequence at SEQ ID NO. 83082
ctccccgcggtggcggccgctctagaactagtggatcccccgggctgcaggaattcgtctcacccctagaaaaaatggcgtcgagcgacctcgccgagagcctcctccccggcggcgggggcggagcctccgcctcacatgacgaatacgaggagcgcgcgtacgactccgaggacaagatctccatcgccgtgtcggattccgacggcgaagacgacggcacgccggcgtcgcgcccgcccttctcgtggcggaagctctggcgcttcacgggcccgggttttctcatgtgcatcgcgttcctggacccgggcaatctggagggggacctacaggcgggcgccgcggcggggtaccagctgctgtggctgctcttgtgggcaacgatcatgggcgcgctgatgcagctgctctccgcccggctaggcgtggccacggggaagcacctcgccgagctctgccgccaggagtaccctccctgggccactcgcgcgctctgggccatgacggagctcgcgctcgtcggcgcagacatacaggaggtgattggcagcgcgattgccatcaagatcctctcggggggggtgcatacgctctggggtggcgtcgtcatcaccgcgctcgattgctttcatcttctctcctggagaattatggcgtgaggaaactcgagcatttttcgctgtactgattgccactagggctgtttcatttgcgggtatggttggggaaacaaaagctagtgccaaggacttccggatcgggttgggggttcccaaaattgagtcaaagacattttaccaagggggtgggaattgggggctgcatcatagggccccccaaagggttttttgggttccacccatagg

SEQ ID NO: 83082 - protein, 195 aa, Zea mays
  misc_feature: Ceres CLONE 1568940
  misc_feature (82)..(196): Pfam Name: Nramp Pfam Description: Natural resistance-associated macrophage protein
MASSDLAESLLPGGGGGASASHDEYEERAYDSEDKISIAVSDSDGEDDGTPASRPPFSWRKLWRFTGPGFLMCIAFLDPGNLEGDLQAGAAAGYQLLWLLLWATIMGALMQLLSARLGVATGKHLAELCRQEYPPWATRALWAMTELALVGADIQEVIGSAIAIKILSGGVHTLWGGVVITALDCFHLLSWRIMA

SEQ ID NO: 83083 - DNA, 935 bp, Zea mays
  misc_feature: Ceres CLONE 1568943
  misc_feature: Translation starting site: 107
  misc_feature: SWISSPROT Homolog: EC 2.7.1.90 Diphosphate--fructose-6-phosphate 1-phosphotransferase
ctccccgcggtggcggccgctctagaactagtggatcccccgggctgcaggaattcgtctcacccctagaaaaagaaacccactccgctctcccgagatcggacacatggcggcggcagcagtgacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcggccagccctcggcgtcgctggtgccttcggccgagcccgcggcgaccaggccgctaaaggtcggtgtcgtgctctctggtggacaggcgcccggcgggcacaatgtcatctgcggcatctttgattaccttcaggagcgtgcaaaaagtagcaccttgcttggattcaaggaggcctgctgggatcatgaagtgcaaatatgtggaactcacttcagactttgtgtatccctacagaaaccagggcggattcgatatgatctggcagtggaagggacaagattgaacacccggagcagttcaggctagctgataaccagccaaaaagcttgaatttgatgggactgttggcatggggggggatgatcaaacccatggccggcctcctggggaaaccttggggcaaggacctgaaaacccgggttttgggtggccaaaaactttcgtgggaatctaaaggtaggggggcccccaacccttggattgaaaccccgggaaaaaacccccaaaatttgggattgtttcccttgccaaaaccccggaaaaacccccctttggggggttgtggggggggccgctcccaaaaaggggaagggctttaaacccc

SEQ ID NO: 83084 - DNA, 880 bp, Zea mays
  misc_feature: Ceres CLONE 1568944
  misc_feature: Translation starting site: 265
  misc_feature: SWISSPROT Homolog: EC 3.3.2.10 Soluble epoxide hydrolase
ctccccgcggtggcggccgctctagaactagtggatcccccgggctgcaggaattcgtctcacccctagaaaaagactcgcgtcgcgtcatgtgcgtgtctctcgtctcgttgggattatattccttccccatcctcaccgcttaccaatcacccgataagtagcaggggcagggagaacgaagacgacgacgacgtacgccggccgtaagtgagccgagagcccccgatataccagctagctagataaccagccagcgcgagcatgggtaggcggcggcgtgcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggcgccgggactccgcgggtacagaggcaccgccgcgccgcccgacgtcgcgtcctactccgccttccacgtcgtcggcgacgtcgtcgccctgctcgacgcgatcgggatccacaacagatgtttgcatgcatggcgaagcaggggttcgtggtgggtcacgactggggcgccatcctcgcgtggtacctctgcctgtcccggccggacccggtgggcggcgcttgtaaaaccaggggtcgctttcttgcgcacatctttttcgggggccccgcccgcgccgtttcgcctatcggattatttccccgcgactagggggccacctactaaatttgcggttttcagagaaaggatttttggccgggcaagcgcgggtactgaaataaacggatcgtggggaaccggtttaccccctggggggg

SEQ ID NO: 83085 - DNA, 872 bp, Zea mays
  misc_feature: Ceres CLONE 1568946
  misc_feature: Encodes the peptide sequence at SEQ ID NO. 83086
  misc_feature (362)..(362): n is a, c, t, g, unknown, or other
  misc_feature (387)..(387): n is a, c, t, g, unknown, or other
tccccgcggtggcggccgctctagaactagtggatcccccgggctgcaggaattcgtctcacccctagaaaaagcagaggcaaaagccccacgcttgagagtgagaagaaacagacgcatcgcttccttgtccatcctacctccccttccccccgcccaaatcccgtgacggtcgccgcccccgccgtgctctcgcccgcgcgggagacgacgcagcacccccccgcgtaggatccgcggcggtcggcaggatggtggtggccacggaggaaatggtggtctactgctttgacaccctcgtcgcctatttcaccggcgagcggccgccgcctcccgccttcgaggatggaaaccacccattngttgtgacctggaagaaggctgccnatggttcaaaaccacgccctccggggatgccataggaactctgggagtccccgtcagaattggcagcgggctttaagggactacgcccttaactagtgcggctgaaggaaccgacggctttccccccaatacaaatccaagggaacccccaacctttggaaggggccgggaatcttatcccccccggattttgaaaattggcaaaggaacccccccaaccgggaagggttggaaaaaacaggggttaatttttgggaatttaaaggccccaaaatcccaaaaaaaaaaaaaggggggccccccttttttccccaaaaaattccggggccccaaaagggtggggaccccctgggagaaaaatttttttgttccccccgggggggagaaggggggggttccaaaaaaaaaaccccccccagggcccctcggggggaaaaaaaaaaaaaaaagccccccccccccacaaaaaaacacccctgttaaaa

SEQ ID NO: 83086 - protein, 56 aa, Zea mays
  misc_feature: Ceres CLONE 1568946
  misc_feature (37)..(37): Xaa is any aa, unknown, or other
  misc_feature (46)..(46): Xaa is any aa, unknown, or other
MVVATEEMVVYCFDTLVAYFTGERPPPPAFEDGNHPXVVTWKKAAXGSKPRPPGMP

SEQ ID NO: 83087 - DNA, 953 bp, Zea mays
  misc_feature: Ceres CLONE 1568947
  misc_feature: Translation starting site: 103
  misc_feature (673)..(673): n is a, c, t, g, unknown, or other
  misc_feature (682)..(682): n is a, c, t, g, unknown, or other
  misc_feature (683)..(683): n is a, c, t, g, unknown, or other
  misc_feature (913)..(913): n is a, c, t, g, unknown, or other
acccgcggtggcggccgctctagaactagtggatcccccgggctgcaggaattcgtctcacccctagaaaaaagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatctacgccaccatcgagaagaccaagcgccggttcgagaactacggcaagttcgggctgctgtgcggcgccgactgcctgccgcacctcatcgtcagcggcgaccagcggcactggggcgagttcgtcaccccggggctgctcttcctctacatcgccggctggatcgggtgggtcggcaggagctacctcatcgccatcagcggcgagaagaacccgccatgagggagatcatcatcgacgtggagcntcgcacccnngctctcccatgggggttcatctggcccgtcgccgcctaccgcgagctcatcacgggggacctcgtcgtcgacgaaaagaaatcggctactactagctgcgcttgtccactgcctgcatggggcatataattgctgctgccgaggaagaacggatcccatgctgctaggaactcacaagctcatttttttaccgcccgggtttgccttgtgggaaccatcatgaagaattngtaattaggggggccttgggggctttcactggggccctgt

SEQ ID NO: 83088 - DNA, 920 bp, Zea mays
  misc_feature: Ceres CLONE 1568948
  misc_feature: Encodes the peptide sequence at SEQ ID NO. 83089
  misc_feature (389)..(389): n is a, c, t, g, unknown, or other
  misc_feature (390)..(390): n is a, c, t, g, unknown, or other
ctccccgcggtggcggccgctctagaactagtggatcccccgggctgcaggaattcgtctcacccctagaaaaaccccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgaacgggtcccaccgcttcatgatccagggctactcgctcgccaagggcatgggcgtcgggaagcacatcgccagcgacaccttcaccgtcggcggctaccagtgggcgatctacttctacccagacgggaagaccnncgagggacactccggctacgtctcgggtctcatcgcgctcgcgtccgacggcaccgacgtgcgtgcgctcttcgagctcacgcttctagaccagagtggccatggcaagcacaaggtgcactcgcactttgaccgctccctaagtccgggacgtacaccctcagtccgggggatcatggggggctataaaggtccttcgggcttatggccctgaacatcaaatttccttaaaatgatggctggaaaaaaccggacgggggggggtggagtcccacttgggtttttcccggcccctttctaaagggtcccagaccggaaaagggctttttttgggaccccttgggaccccgggaaagggggatggtctttttttggggacgggagaaaatttttgcccccttgtgggttgggggccccaccccccttttttaaaaaaatttcccccccccacccggtaaaaaaaaaaaaacccggggggggggaaaaaaagaaaactttttttattattaccccccgtggtgcgagggggt

SEQ ID NO: 83089 - protein, 160 aa, Zea mays
  misc_feature: Ceres CLONE 1568948
  misc_feature (90)..(90): Xaa is any aa, unknown, or other
MEDEDAGLGDGGEASPPHHAAASGDRARDLAASPTSSRSVTQTVNGSHRFMIQGYSLAKGMGVGKHIASDTFTVGGYQWAIYFYPDGKTXEGHSGYVSGLIALASDGTDVRALFELTLLDQSGHGKHKVHSHFDRSLSPGRTPSVRGIMGGYKGPSGLWP

SEQ ID NO: 83090 - DNA, 960 bp, Zea mays
  misc_feature: Ceres CLONE 1568949
  misc_feature: Encodes the peptide sequence at SEQ ID NO. 83091
acccgcggtggcggccgctctagaactagtggatcccccgggctgcaggaattcgtctcacccctagaaaaaaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagctacaaagttccttacgaccctaacctgattaccggcatccaaggcctgaatcagtactggagcaacatcaggtgccccagcaactactggcagagcagctgggaagaacgcctggaagaagggccggcgcttgcctcggcctcagcgagaaagactacttcgagactgccctcttcttcccgtagccggatcaacccatctcgttcgccctaaagccaaaggttccgagcccggattccgggcctctacgggctccaggaggatccccaaaggcctttaaggaggggattaaaccgaaccccggggatccctgtgaaaaaggggcccttttcaaaaagtaagggggtgttcaagtttatttttgggggggggggaaaaggaattttttattatgtcccccgcgcccaaaataaccccggctccaagggaaacccctctcccccccttcaaagagggggtgtcaagggaacttctacaaggaagaaaacccttttcaagggggggggggccaagaaaaaaaaacaccacccccccctctccttgttgttttttgggggggggggaaaaaaaaaaaaaatgtttcccgcgggagtttttttttttttcccccccataaaatgtttttt

SEQ ID NO: 83091 - protein, 152 aa, Zea mays
  misc_feature: Ceres CLONE 1568949
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSYKVPYDPNLITGIQGLNQYWSNIRCPSNYWQSSWEERLEEGPALASASARKTTSRLPSSSRSRINPSRSP

SEQ ID NO: 83092 - DNA, 899 bp, Zea mays
  misc_feature: Ceres CLONE 1568953
  misc_feature: Encodes the peptide sequence at SEQ ID NO. 83093
  misc_feature (728)..(728): n is a, c, t, g, unknown, or other
  misc_feature (802)..(802): n is a, c, t, g, unknown, or other
  misc_feature (843)..(843): n is a, c, t, g, unknown, or other
ctccccgcggtggcggccgctctagaactagtggatcccccgggctgcaggaattcgtctcacccctagaaaaaccctagaaaaagggaggaagctgcgagttggagggggccgggagaggcgtctctggttattgcttgtccctgcttcccggtgagctgctgggagtggacgggccgggaaggagacgagaagataagggcgccgcgcgcggccatggctggaagtgcgccggcgacggcgatggacaagaccagctttgccacctcgtgcagcctgctgagccagtacgtcaaggagaagaagggcggcctgctgcagggccttggtgccctcgccatggcgccggcagctggagaaggagctttccggccgccgaccaccatgaacttgctgtcagctctcgacgacgcgctgggccaagaagcgacaacagcgaagctggagatgtgatgaatgttgcccgacaagaaggtgcagtgcacgagattcacggatggtgcaggtcgtagcttcaggttaaggtgaaggataacttaccgtcgggtactctactcactttactgctctactactactactgctggtgacgaagttagcaagaaacgttcttctgctaccggtgggtcggtcggtcagccgttcgttggcgagattgtttgctgctggagacggacgtgctcgcagcagtttcgctggtccgtgaccgcgccatatgttgccacaantggtgggtttgtcggtacgttgaggaacgatttgtatgtagtgtgcacgtttccggtgcatcttgttctcctcnagcctgtcctgtatgtttacccccctgcaccccctcctccntctttgtagagagaaggtctgtatgtcaatggaagatggtggtctatttgatttta

SEQ ID NO: 83093 - protein, 78 aa, Zea mays
  misc_feature: Ceres CLONE 1568953
MAGSAPATAMDKTSFATSCSLLSQYVKEKKGGLLQGLGALAMAPAAGEGAFRPPTTMNLLSALDDALGQEATTAKLEM

SEQ ID NO: 83094 - DNA, 869 bp, Zea mays
  misc_feature: Ceres CLONE 1568954
  misc_feature: Encodes the peptide sequence at SEQ ID NO. 83095
  misc_feature (869)..(869): n is a, c, t, g, unknown, or other
caaagctggagctcccgtcgatggcgagtcgctctagaactagtggatcccccgggctgcaggaattcgtctcacccctagaaaaagaacgcatctcttctttctactttcttgtaacccaagacgaactcggtgaactctttctcctcgcgcagcaccggagcacaatcaaggattccagtccagtcctgccaatggagtgcgttttgggcttggttggccgcgacttcgcggtggtggcggccgacacctccgccgtgcagagtatcctcgtccacaagactgacgaggacaaagtaatggtcctcgactcgcacaagctgttgggcgcttcaggggagcctggtgaccgggtgcagtttacggagttcatacagaagaacctccacctgtaccagttccgcaacaccatcccgctgtcaaccgccgctgccgccaacttcacacgcggcgagctcgccacagcccttcgtaagaatccatacatggtcaatgttattctcggtggttacgataaggatgttggcgcctcactgtactacatcgactacattgcgaccttgcacaagatcgacaagggcgcttttgggtacggatcgtatttctgcctgtctctgatggacaggctgtaccgcccggacatgaccgttgagggagcggtagacctcgttgataagtgcagtaaaggagatcccggctgccggctgggttgtggcggccccgaaacttccttgatcaagaatcgtcccacaaaggaccggggccaggggagtaacccgaaggcggggaactctgtcgggcggacagtgggaccctggctggaaagcctgcaacttaacgggtggccccccctggagggaattgaaaan

SEQ ID NO: 83095 - protein, 224 aa, Zea mays
  misc_feature: Ceres CLONE 1568954
  misc_feature (1)..(181): Pfam Name: Proteasome Pfam Description: Proteasome A-type and B-type
  misc_feature: SWISSPROT Homolog: EC 3.4.25.1 Proteasome endopeptidase complex
MECVLGLVGRDFAVVAADTSAVQSILVHKTDEDKVMVLDSHKLLGASGEPGDRVQFTEFIQKNLHLYQFRNTIPLSTAAAANFTRGELATALRKNPYMVNVILGGYDKDVGASLYYIDYIATLHKIDKGAFGYGSYFCLSLMDRLYRPDMTVEGAVDLVDKCSKGDPGCRLGCGGPETSLIKNRPTKDRGQGSNPKAGNSVGRTVGPWLESLQLNGWPPLEGIE

SEQ ID NO: 83096 - DNA, 785 bp, Zea mays
  misc_feature: Ceres CLONE 1568955
  misc_feature: Encodes the peptide sequence at SEQ ID NO. 83097
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
ctccccgcggtggcggccgctctagaactagtggatcccccgggctgcaggaattcgtctcacccctagaaaaagtaagaataagggaggcaaaggctgctaaaaatgctattgcaccattgtccatgtaccttctggatccacagacacaatctcaacagggaagattgcttgctgctcttgctcttggtgatcttttccaaaacgaaggtcttgctcgttctactgatgctgttgcagcatgccgcgctctagtcaatcttcttgaagatcaaccaactgaagagatgaaagtggtagcaatatgtgccttgcagaatctagtcatgtacagccgagcaaataagagagcagttgcagaatccggtggtgtccaggtcctgctggatcttatcagttcaagcaatcctgacacttctgttcaggcagcaatgtttgtcaaacttctattcaataatcacactatccaggaattttggcgaccagtgaaacaggccagagttataactggcctctattggaaaagaaaaaattggccctccggggaagggcccaaacgaaaaaaaatccccaaaagccccttaaagggctttgcctttaaaaaaaccccccccccccgttttgggggggggcccccccccgtaaaaaacccccccccccccaccccnnnnggtgttaaggggggggggtgtgctccccgccccctcttttgtgtgtgaaacccccccccccccaacaaagaagagagtttgttggtgtggggggcgcccctcccacaagaaaaa

SEQ ID NO: 83097 - protein, 238 aa, Zea mays
  misc_feature: Ceres CLONE 1568955
  misc_feature (223)..(223): Xaa is any aa, unknown, or other
PRGGGRSRTSGSPGLQEFVSPLEKVRIREAKAAKNAIAPLSMYLLDPQTQSQQGRLLAALALGDLFQNEGLARSTDAVAACRALVNLLEDQPTEEMKVVAICALQNLVMYSRANKRAVAESGGVQVLLDLISSSNPDTSVQAAMFVKLLFNNHTIQEFWRPVKQARVITGLYWKRKNWPSGEGPKRKKIPKSPLKGFAFKKTPPPRFGGGPPPVKNPPPPTPXGVKGGGCAPRPLFCV

SEQ ID NO: 83098 - DNA, 887 bp, Zea mays
  misc_feature: Ceres CLONE 1568957
  misc_feature (134)..(134): n is a, c, t, g, unknown, or other
  misc_feature (190)..(190): n is a, c, t, g, unknown, or other
  misc_feature (656)..(656): n is a, c, t, g, unknown, or other
tggagctccccgcggtggcggccgctctagaactagtggatcccccgggctgcaggaattcgtctcacccctagaaaaactgtgatgtaacacttatgtcactggcatatgccgggacaggaaatgtgcttaangttcagaaacttcttggcatttgctcacagcatcttgagaaaggtgaaacacaccnagggccagctgtcctaggggatggctcttatttgctatgggctgaagaatttaggaacctgaaatggctgtacgttcccctgaacgtcttctgcagtatggccagccaaatttaaaacggccagccccccctggccctgggaaaaccccggcaatcccaatccccaagggaaacctttttggcccccctaacccaaatttttcccttttttcccacccccccattgtccccaggggccccaaaattttccccttggggttttatattgggccgcggcccccaaaaaaaatccccaaaaaaagtgggggggggcttcccaaaattttttttgtttttttttcccccaaaaaaaccgccccccccccccctttttttttttgtaaaaaaaacttcccaccggccctttttgtttctccccccaaaaaaaaagagtgttttttgaaaccctctctcccccccccaaatnttaaaaaaaaatattttttctctccccccccccccaaaaaattttgggggggggcgcttttatacaaccctccctcccccccccccccctttttttattaacacccccccccccccccgggaaaagaaccaaccccccccccccccctttttttttttgcggggagagcccccccccccttttttttttttttctccaaaaaaaaaaacaccccccccccccccccccccc

SEQ ID NO: 83099 - DNA, 896 bp, Zea mays
  misc_feature: Ceres CLONE 1568960
  misc_feature: Translation starting site: 135
  misc_feature: SWISSPROT Homolog: EC 4.1.1.39 Ribulose-bisphosphate carboxylase
  misc_feature (794)..(794): n is a, c, t, g, unknown, or other
  misc_feature (821)..(821): n is a, c, t, g, unknown, or other
ctccccgcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccagctagctatagctcctgcgtgagctagtagctagctagtgccatgcgtcgtctctgtcgttcggttttgcttcgggggtcacgtacccttttgcttgctgggttctctttccttttccnttttttttttcttttcccggccatggntcctttgctttcagtttcctctgctggatgggatgtatcattggttgcagcatggccttgcatgggctaaaaaaa

SEQ ID NO: 83100 - DNA, 884 bp, Zea mays
  misc_feature: Ceres CLONE 1568962
  misc_feature: Encodes the peptide sequence at SEQ ID NO. 83101
  misc_feature (772)..(772): n is a, c, t, g, unknown, or other
ctccccgcggtggcggccgctctagaactagtggatcccccgggctgcaggaattcgtctcacccctagaaaaattcaagcgttctacggctcctatttctctgacttctccctgagcctttgcggccggctggagctggacggtccccgggcagctcatgcagccagactgcgggagtcacctccatggactcggctgctactgcaaccctccccaaggttcagttgaggccaagatgcaacagctactttcaggtgaccggccaagtccatgcccacaccaaaacatgcgttgcctgctagtgtccgacccatatccacgggttgcttgtttcagctggaggaaggaggacattcctgccggtgtctgcatgttggatcacgtcaaggctcatcggtcactgatgccgacaggaagagcgatttgtcgctggagaacgtcaagacgtccgttgtatcccgcgacgatgaaaagattaatgtacgagtgcagttgcctggaaaggcgacgcaaaaggtgtttgatgaggctctgacgttcttggcccgtgatgcaccaccggttcctggttttaggaagtccaaaggagggaaaacatctaatatacccagcagcatcctgctgcatatgcttggcaagagccgggtcaccaaattcgttcttcaagaaatactgagcatcaccattgaagaatttgtcaagaaggaaaacctgaaggtgaaacctgagatccagacaacccagtcctaaggcgagatggagtccgcgttncgcgccaggatcagcatttgcgttcaatcgtgtgcttcagctcgagacacgtgactctgatgatccagagaagaaacctggctctgatgacgatttacaagcaggatcctgt

SEQ ID NO: 83101 - protein, 159 aa, Zea mays
  misc_feature: Ceres CLONE 1568962
MPTPKHALPASVRPISTGCLFQLEEGGHSCRCLHVGSRQGSSVTDADRKSDLSLENVKTSVVSRDDEKINVRVQLPGKATQKVFDEALTFLARDAPPVPGFRKSKGGKTSNIPSSILLHMLGKSRVTKFVLQEILSITIEEFVKKENLKVKPEIQTTQS

SEQ ID NO: 83102 - DNA, 807 bp, Zea mays
  misc_feature: Ceres CLONE 1568963
  misc_feature: Encodes the peptide sequence at SEQ ID NO. 83103
  misc_feature (405)..(405): n is a, c, t, g, unknown, or other
aaagctggagctcccgtcggtggcggccgctctagaactacgtggatcccccgggctgcaggaattcgtctcacccctagaaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcnctgacgtgcgccgacttcctgcgcgcgcccggcgtgcggacgcccgtgatcgtgcgcttctcgacggtgatccacgagcggggttccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcggggtgttcgactttcctgtcgcacctccccgagagcctgcacaccttcttctttctccttcgacgacgtggggcgtggccgtccgactaccggcaaaatggaaaggtttccggcgtgaaacacgttacacgtttcgggg

SEQ ID NO: 83103 - protein, 209 aa, Zea mays
  misc_feature: Ceres CLONE 1568963
  misc_feature (18)..(210): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRGVRLSCRTSPRACTPSSFSFDDVGRGRPTTGKMERFPA

SEQ ID NO: 83104 - DNA, 920 bp, Zea mays
  misc_feature: Ceres CLONE 1568964
  misc_feature: Encodes the peptide sequence at SEQ ID NO. 83105
  misc_feature (778)..(778): n is a, c, t, g, unknown, or other
  misc_feature (792)..(792): n is a, c, t, g, unknown, or other
  misc_feature (817)..(817): n is a, c, t, g, unknown, or other
  misc_feature (818)..(818): n is a, c, t, g, unknown, or other
  misc_feature (825)..(825): n is a, c, t, g, unknown, or other
  misc_feature (836)..(836): n is a, c, t, g, unknown, or other
  misc_feature (857)..(857): n is a, c, t, g, unknown, or other
  misc_feature (858)..(858): n is a, c, t, g, unknown, or other
ctccccgcggtggcggccgctctagaactagtggatcccccgggctgcaggaattcgtctcacccctagaaaaaattccttcagggaacggcttccatagcgctgaagcgaggcgtgccgcattgggttgttcgagagctcctagtgttgccctactacatgatggagggcgatctccccacgcccgcgaacgctagggttgttgccgtggtcaccggcggcaacaaggggatcgggctggaggtgtgccggcagctggcctgcagcggcgtcaccgtcgtcttgacagccagggacgacgcgaggggcgcggcggccgtggagaacctcagaggcctggggctctccgatgtcctcttccaccgactggacgttaccgacgctccgagcatcgctcgactcgctggtttcctcgagacccgtttcgggaagctagacatcctggtaaataatgccgcgattggcggggttgagtatgttcatgaccaagattgtggctcagtaacgagcgaggaaaaggcaaagttgagcggcatggacatggatcagaggcttggatggctgtgggagaattgccgggagacctacgacgatgcaaagacaggcctacgaacaaactactacggcacaaagcaagtaatcgagactttactgcctctactgcaagcctcctccgatgggaggatcgttaacgtctcctcccacttcggccagctaaggcttttccgaaacgaggagctgaagcgggagctgtacgacattgactacctcaccccgnagaggctggatggnctgctggacgttctaaatgacttgnnagcggcnatgtggagtcntcaacggctggcgatgtattnnctcgcgtacatgtggcctaggcggcatgacgcgtactcgagatctggcgaggcgcacccgac

SEQ ID NO: 83105 - protein, 252 aa, Zea mays
  misc_feature: Ceres CLONE 1568964
  misc_feature (13)..(193): Pfam Name: adh_short Pfam Description: short chain dehydrogenase
  misc_feature: SWISSPROT Homolog: EC 1.1.1.184 Carbonyl reductase (NADPH)
  misc_feature (206)..(206): Xaa is any aa, unknown, or other
  misc_feature (219)..(219): Xaa is any aa, unknown, or other
  misc_feature (225)..(225): Xaa is any aa, unknown, or other
  misc_feature (232)..(232): Xaa is any aa, unknown, or other
MEGDLPTPANARVVAVVTGGNKGIGLEVCRQLACSGVTVVLTARDDARGAAAVENLRGLGLSDVLFHRLDVTDAPSIARLAGFLETRFGKLDILVNNAAIGGVEYVHDQDCGSVTSEEKAKLSGMDMDQRLGWLWENCRETYDDAKTGLRTNYYGTKQVIETLLPLLQASSDGRIVNVSSHFGQLRLFRNEELKRELYDIDYLTPXRLDGLLDVLNDLXAAMWSXQRLAMYXLAYMWPRRHDAYSRSGEAHP

SEQ ID NO: 83106 - DNA, 841 bp, Zea mays
  misc_feature: Ceres CLONE 1568965
  misc_feature: Encodes the peptide sequence at SEQ ID NO. 83107
  misc_feature (694)..(694): n is a, c, t, g, unknown, or other
  misc_feature (695)..(695): n is a, c, t, g, unknown, or other
  misc_feature (709)..(709): n is a, c, t, g, unknown, or other
  misc_feature (710)..(710): n is a, c, t, g, unknown, or other
  misc_feature (715)..(715): n is a, c, t, g, unknown, or other
  misc_feature (754)..(754): n is a, c, t, g, unknown, or other
  misc_feature (755)..(755): n is a, c, t, g, unknown, or other
  misc_feature (759)..(759): n is a, c, t, g, unknown, or other
  misc_feature (760)..(760): n is a, c, t, g, unknown, or other
  misc_feature (776)..(776): n is a, c, t, g, unknown, or other
  misc_feature (782)..(782): n is a, c, t, g, unknown, or other
ggagctccccgcggtggcggccgctctagaatagtggatcccccgggctgcaggaattcgtctcacccctagaaaaaaatactcacagggccctcttctctcatctctcactccctcgctccgtctaccagtaccaccacgtccctcctcgtcgacgatctcgtagcggcggcgcacatggcgagcgacggcgcggcggctacgccagcgaaggttaccccaaagaaggccaatctcctcgacccgcactccatcaagcaccttctcgacgagaccatctccgaggtcgtgaagagtaagggctacaccgaggacacgcggctgggcaactggaagctggggatcggagccgccgtgattgctgtcgccctcctcgctcagttttaccccaagaagttcccgcagaaccgcgatttcctccttggctgcatcgccctatatccttttcttcattggtttgccctatcctttggttatgatgaatcggcgctagatctgatttctgttgaaaatcggggggaaatggtggccttggtgccggtgaacccctggacttaaaagacccccaacccccttgggggggccaaaaagggggggggccccgaagccccctggcccccccccccgagggaaaaagaaggggccccccctttttttgcccccccccccccccccgggggggggggggtggttnnattcccaaccaggnnagcgnttcgctttttgtagggccagcccgatcgaccccaccccnngggnntgaacccccccttccnacaccntgacccactggctggttaccgtgaccctcactaaagagggggactcacccatggcgacg

SEQ ID NO: 83107 - protein, 126 aa, Zea mays
  misc_feature: Ceres CLONE 1568965
  misc_feature (12)..(125): Pfam Name: SPC25 Pfam Description: Microsomal signal peptidase 25 kDa subunit (SPC25)
MASDGAAATPAKVTPKKANLLDPHSIKHLLDETISEVVKSKGYTEDTRLGNWKLGIGAAVIAVALLAQFYPKKFPQNRDFLLGCIALYPFLHWFALSFGYDESALDLISVENRGEMVALVPVNPWT

SEQ ID NO: 83108 - DNA, 923 bp, Zea mays
  misc_feature: Ceres CLONE 1568970
  misc_feature: Encodes the peptide sequence at SEQ ID NO. 83109
  misc_feature (741)..(741): n is a, c, t, g, unknown, or other
ctccccgcggtggcggccgctctagaactagtggatcccccgggctgcaggaattcgtctcacccctagaaaaaaccgagcaatcgcgcgcggccgccgaggtgccaaggcggcggcggtcggtcggtctgcgatatacgatggcggcgccttactacggaggtcctccggcggcgccggcccccgtggcggtggtgtccccgcagttctgtgcgccgtacgtggtgcccctgacggtgaccaagaaggccatcagcctctccgacggcgacttcaccgtcaccgacgccaacggcgccaccgtgctgcaggtcaagggcgccgtcttcagtatccgccaccgccgcgtcctcctcgacgccgccggccagcccatcctcaccatgctggagaaggtattcagcatgcacaacagatgggaggtgttcagaggggacagctcgaacgagagcgacctgctcttcaccgcgaagaaatcctcgatattccagctgaagacggagatggacatcttcctggcctccaacaccgcgcagcaggtgtgcgacttcaagatcaagggcagctacttcgagaggtcgtgcgccttctacctcggcaactccagcagcatgatcgcccagatgtaccgccagtttaccgtcaccaatgtgctgcttggaagggacacgtttggcgtcactgtgttcccgcacgttgactacgtgttcgtcgctgctctttgtgtgatactggatgagnatcatagggaaacgtccgactggagaacataccacacacaccaccaagcttctccacgttgctcgacatgctatgcttgtatcatcatcacaggtattctggcaatatatactttcatggtttgttatggaagtattatgagtaatacccctcccctgatcaataggtttaaaaggggccaa

SEQ ID NO: 83109 - protein, 261 aa, Zea mays
  misc_feature: Ceres CLONE 1568970
  misc_feature (16)..(197): Pfam Name: DUF567 Pfam Description: Protein of unknown function (DUF567)
  misc_feature (201)..(201): Xaa is any aa, unknown, or other
MAAPYYGGPPAAPAPVAVVSPQFCAPYVVPLTVTKKAISLSDGDFTVTDANGATVLQVKGAVFSIRHRRVLLDAAGQPILTMLEKVFSMHNRWEVFRGDSSNESDLLFTAKKSSIFQLKTEMDIFLASNTAQQVCDFKIKGSYFERSCAFYLGNSSSMIAQMYRQFTVTNVLLGRDTFGVTVFPHVDYVFVAALCVILDEXHRETSDWRTYHTHHQASPRCSTCYACIIITGILAIYTFMVCYGSIMSNTPPLINRFKRGQ

SEQ ID NO: 83110 - DNA, 1001 bp, Zea mays
  misc_feature: Ceres CLONE 1568971
  misc_feature (410)..(410): n is a, c, t, g, unknown, or other
  misc_feature (955)..(955): n is a, c, t, g, unknown, or other
  misc_feature (966)..(966): n is a, c, t, g, unknown, or other
  misc_feature (976)..(976): n is a, c, t, g, unknown, or other
  misc_feature (977)..(977): n is a, c, t, g, unknown, or other
caaagctgaagctccagtcgattggctcgagagatgaagtcttagtatatgtcttgagactaacagtaatcacgttttccctagaataacagcatgcttagtgctactttctccgcccaattggaggcaccccgaaccacaaaaaaaaaaggatgagaatttgatgccacaaacaagctcaaatgcttggtccttttgaaggttcgagaccagccatgtccttggcgccctgctggcctcctcgccgctgctggcgtccgcctgggaccgctgtacgaccgccacagccgcggcgcccgggttcgtgcacggagaggacggcggcaaggtgtacgtggggttctccggggtgcaggccgcgctgtctgcggcaggggcggcggtggccggtggtggcgcctacgtcttcncgccggtggggctcggcggggacgcggcggggcggatgttcgcgccgctgctcgcggccgaacccgactcgtcccgctgctggggggagccggttggccgtgccaggcccttgcgcctgcaatggcttcattgaaaactctgcgggtaaaccctggaatttcccggaatgcttcctggaaatgagaactcagggggttaagggggaagatccttgtttccacggggcccaaccttccccttcgggaggggcagaccaatttggcccaccccgtcggggggggggttagcactttaaccctgttggaaatactccaaacctcttcagaggcttccaaccagtggggtcaaccctgtgtatggtcttcaggggttccgtgggccgggtcagaccttattgtgaaaacctccgcctacctgaaggccatgttgcaggcccccccgcctccccgggggcaaaatcccgtggagttaaagccggttgtggggggggtgagatattaattgaaatagagagaaccacccccccccccaccccacacccccnacacaataaanaaaaaaaaannaaaaattattaggctgtggtgttg

SEQ ID NO: 83111 - DNA, 760 bp, Zea mays
  misc_feature: Ceres CLONE 1568972
  misc_feature: Encodes the peptide sequence at SEQ ID NO. 83112
ctccccgcggtggcggccgctctagaactagtggatcccccgggctgcaggaattcgtctcacccctagaaaaacaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgtccgggctgtccgccgttcccctaagacttcgcccaagaaccggcgaacctgaagggggatcccctccccccctggggccatgtttcgggggccccccggggtgggttttttccccaaaaagggtttttccccccaaaaggggggtaaaaatttttgagagaaaagcccttttggttaaaaggggggccccccaaatttttaggaggggggggggggggaacctccgggaaaccccccctttttaccccccgaaaaagaacccccccccccttggggggcccccaaatggggtttttttgggggccccccaaaaaaaacaaacaaatttttggggggggggcccccctatagaaattttttttcacccccccctttttctgggggggggggggttccc

SEQ ID NO: 83112 - protein, 95 aa, Zea mays
  misc_feature: Ceres CLONE 1568972
MAASTMAISSTAMAGTPIKVGSFGEGRITMRKTVGKPKVAASGSPWYGPDRVKYLGPFSGEPPSYLTGEFPGDYGWDTVRAVRRSPKTSPKNRRT

SEQ ID NO: 83113 - DNA, 976 bp, Zea mays
  misc_feature: Ceres CLONE 1568974
  misc_feature: Encodes the peptide sequence at SEQ ID NO. 83114
ccccgcggtggcggccgctctagaactagtggatcccccgggctgcaggaattcgtctcacccctagaaaaagccgcctcctccccactgcctcgtgtggccgtcgtctcccgttcggaacgccaagcccccctccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggacctgcaccggttcgtcaagtggcccaaggtcgtgcgtatccagcgccagcgccgcatcctcaagcagcgcctcaaggtaccaccggcgctcaaccagttcacccgcaccctcgactagaacctcgctacgaacctgttttagatgcttctcaagtaccggccctgaagacagggctgcaagaaggagaggctttctgagagggccaaagctgagaatgagggaaaaactggtgagtcgaagaaaaccatttgtttgggaaagttgcccttaaccttgggactttcctcattggaccgaaaaagggctcagcttggtggtctcccccctggacggggatccaattgaaacggggtggggggcttcccacccctgtcaaggaaaaatggaggcccctttccggctttgttaaaaagaaaggccccccctggaaccatttgtccacaaaaaaaatggcttcttttttgtgttcccccacttttcaaaacaaggaaataacttttggtctcccaaaatttttggaggcttttagggaaaacctctccaccaaatttttatagtgggggagaaaaagggggggggggcgctttggggaaaaaaatgggggggaaaaaaaagggcgcggaaaaatattcctccccaagagagggccccaaaaaaaaaatataatttcctggtggggtccccccctattttgggaaaaaaaaa

SEQ ID NO: 83114 - protein, 81 aa, Zea mays
  misc_feature: Ceres CLONE 1568974
MAPKRGGRAPVPAKKKTDKVTNPLFEKRPKQFGIGGALPPKKDLHRFVKWPKVVRIQRQRRILKQRLKVPPALNQFTRTLD

SEQ ID NO: 83115 - DNA, 869 bp, Zea mays
  misc_feature: Ceres CLONE 1568975
  misc_feature: Encodes the peptide sequence at SEQ ID NO. 83116
  misc_feature (488)..(488): n is a, c, t, g, unknown, or other
  misc_feature (494)..(494): n is a, c, t, g, unknown, or other
  misc_feature (559)..(559): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (622)..(622): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (672)..(672): n is a, c, t, g, unknown, or other
caaagctggagctccagtcgattgcagcagatctctatatagaggatgccccgggctgcaggaattcgtctcacccctagaaaaaattctcacgcccatcacaagtgaaggaaggctactggtgctggtgccggcactggcagccggtgcctaaccatatctacctcatataactttccactggccgtagtcggcttcttctctgaactgaagcaggggggagacaagcgccatggctgaggatgccagaggagagaagaaggatgcctacgcggcggcgccggcgtccaagttgccggcgaagcaacggggagggttcaggagcatgcccttcatcctagcgaatgacttctgcgaccggcttgcttcggtggggttcacgaccaacctgatctcgtacctcaccctgcagctgcacctgccgctcgtgggagggctcccccaaatttttcccccaatatacatatgggaactgctaaacttcactntccccncgctcatcggcggtctcataatgccaagcatcttttggcggcgcttctgggacatcacaattcgnttccatcattaaccaagtttcggggaatgtttgtgctcttacccnnncccttccgcgcggctncccctccttggcggnnnncccccttccaatatcaggnnnttggaaattgnccaggcggtcctccaaaccaaaaattcccgggggaaccggttttggccttgaacatgaaatgggaccggggggaaccccccctgaaaaaatggggttttgggcccaaccccttggattaaaccccaaagggcccggggcccaaaacccaaaggggagttcttaaacctcaaacttttgggcggggaggtggggagcg

SEQ ID NO: 83116 - protein, 112 aa, Zea mays
  misc_feature: Ceres CLONE 1568975
  misc_feature (86)..(86): Xaa is any aa, unknown, or other
  misc_feature (88)..(88): Xaa is any aa, unknown, or other
MAEDARGEKKDAYAAAPASKLPAKQRGGFRSMPFILANDFCDRLASVGFTTNLISYLTLQLHLPLVGGLPQIFPPIYIWELLNFTXPXLIGGLIMPSIFWRRFWDITIRFHH

SEQ ID NO: 83117 - DNA, 979 bp, Zea mays
  misc_feature: Ceres CLONE 1568977
  misc_feature (283)..(283): n is a, c, t, g, unknown, or other
  misc_feature (596)..(596): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
caaaagctggagctccccgcggtggcggccgctctagaactagtggatcccccgggctgcaggaattcgtctcacccctagaaaaagccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgnctcccgggccggccggtccttttttcaaaaacccccattggggaaattggttttggggggttttttccccgggggggggggggaaaaaaaaccccccttttggggggagaagcccccaaaaaaaaaaggtggcgttttctcccccccccccaaaaaaaaaaaacaaatttttttttttgggggggaggaaaaaaccttcttgtgtgggggggggggaaagaaaaaagaaaaaccacccccccccaccacggggcgtggggtgttttttttttggtggttgggggggagcacgcccccgaggcgcgtgcgtggngtgtttgggggtgtgggaggaggaggcggagggggagaggggaggacagggcgggcggcgtcgacggggcagggagaagggagcgggggggggtgggnnncgcgcggggtgggagatcgatggtcggtggggtgccagtcgggtcgtgtgtgtagagttgatggggttgggatcggagaggatgaataaagaagaagagagacagaggaggggaggggtagaaggatatgacgctatgggggtgggaatacatgatgggcggggcggcaagcccgacacccccactaaggtatatttgagaggaagtgtgcggttgggcggagtgccacggagcttcacgggcgagggagcgcgggtgcgggggggtaatgcgggtgggggag

SEQ ID NO: 83118 - DNA, 1333 bp, Zea mays
  misc_feature: Ceres CLONE 1568978
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (1059)..(1059): n is a, c, t, g, unknown, or other
  misc_feature (1113)..(1113): n is a, c, t, g, unknown, or other
  misc_feature (1138)..(1138): n is a, c, t, g, unknown, or other
  misc_feature (1152)..(1152): n is a, c, t, g, unknown, or other
  misc_feature (1154)..(1154): n is a, c, t, g, unknown, or other
ttcttgccctcctatttttacctttttttccgctggtctcttatacacacccatgtgtggttnnnngggggcttttctttaagtggggctccccgcggtggcggccgctctatactagtggatcccccgggctgcaggaattcgtctcacccctagaaaaaacaaatccaggcgtggccgtgcgaccatccctcccctcatggcgtcatcggcggcgcgatccctcgcgctcgtcgcgtctgcctcggcatcgctcggcgttcggcagcggtcgtgggctcccttggctgtctcttcctcttcggttgggcgggccctccccaagtcccggggggttcccacccataccccacccccaacgggggggcccataaaggggaaacaccgcccccccgggggttttttaaccccccccacccgggaataggaaacccccccccatgagtgccgtttttttttttttaaaacaaaaagggtttttttttttgtgtagataagaaaaaaaaagtttttccccccccccctccggggggaggggagtaacatcgccgcccccccccgggagaaaaaaaaaatagggggggggtatccccgccccaaaaaagagttgcctcggggttgtttgcctgtggtcacccgaagaaaaaaaaaagagtggtttttggaatgatttcgttccccttctctgcgggtggggcgtggattttttgagtagtaaaactcttacgctccgccgggatttctcgttttcctccctgcttgacgaggccaagagtgtgtgacaattttttttatttcttgtaacatatcttatgattctcttctatgttcccctggttcttggttgtggtagatacacccccacctgcttcgtctttttctcatttgttgtctggtgggggatggttgacattggtcttcgcgacccccttgttatgatgctctccgcttcgcgtgtgggcgcacgcacccccgttatttgtacgtgtggccagcgaaccagttcacaattcgacgtgcggcctgttgcccgtgttgccacccctcctcacctatctngctcgatgagcggcgtcaattagtcatatggcacaattatacggcacatctccnatcgctgcgcgtatcatagggtgcntctactctatgtgntntggtagcgtggttaatctaagcacgagtgcactggaacaccatactttatcatgtgctgcacttctaccctagcagttctaatctaatgattgtcgtctctgctcagcccccgtattatacgcacttggcccgcgtcgttctatgacgtataaacggtcgccgctcagagcggcagtgt

SEQ ID NO: 83119 - DNA, 936 bp, Zea mays
  misc_feature: Ceres CLONE 1568980
  misc_feature: Encodes the peptide sequence at SEQ ID NO. 83120
  misc_feature (738)..(738): n is a, c, t, g, unknown, or other
  misc_feature (741)..(741): n is a, c, t, g, unknown, or other
  misc_feature (759)..(759): n is a, c, t, g, unknown, or other
  misc_feature (783)..(783): n is a, c, t, g, unknown, or other
  misc_feature (899)..(899): n is a, c, t, g, unknown, or other
acccgcggtggcggccgctctagaactagtggatcccccgggctgcaggaattcgtctcacccctagaaaaaaaggcaacattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggaagctaaatcacaagaacattcgttgggctaccccaactcacaagcttcagatgcttcgcaattgatttctcaagcttcctttgatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgatcttgaatcacaggtttccaggttaacgtctgagaatgcatctttgctgaagcgactggctgatatgactcagaaatacagggacgcttccccgtgacataaaatctaacagttgatgttgagactatngangagaaagggtcgtcgtcnttgatgcatcacagacctttttcntcttttttttggtgtacgagaactcttactgcatccattatcgatcatacatttttactggggctctgtgttactcaccgtatcacgtttactctctctgatggctgcaaaggcangaaaagaatatgatggtcatagtcctatttaaaactg

SEQ ID NO: 83120 - protein, 181 aa, Zea mays
  misc_feature: Ceres CLONE 1568980
  misc_feature (121)..(181): Pfam Name: bZIP_1 Pfam Description: bZIP transcription factor
MAGGGAGDDDVVVVSCGGRGGGDPGAYAAVLKRKLDLYCAAVAKSMEAKSQEHSLGYPNSQASDASQLISQASFDGDIDGASLVTNSNVIEDDDFQGKPTNSGTSKELSDDDGDLEENTDPANAKKMRRMVSNRESARRSRKRKQAHLTDLESQVSRLTSENASLLKRLADMTQKYRDASP

SEQ ID NO: 83121 - DNA, 872 bp, Zea mays
  misc_feature: Ceres CLONE 1568981
  misc_feature: Translation starting site: 173
  misc_feature: Pfam Name: SPC25 Pfam Description: Microsomal signal peptidase 25 kDa subunit (SPC25)
  misc_feature (805)..(805): n is a, c, t, g, unknown, or other
  misc_feature (810)..(810): n is a, c, t, g, unknown, or other
  misc_feature (833)..(833): n is a, c, t, g, unknown, or other
  misc_feature (837)..(837): n is a, c, t, g, unknown, or other
ccccgcggtggcggccgctctagaactagtggatcccccgggctgcaggaattcgtctcacccctagaaaaaaatactcacagggccctcttctctcatctctcactccctcgctccgtctaccagtaccaccacgtccctcctcgtcgacgatctcgtagcggcggcgcacatggcgagcgacggcgcggcggctacgccagcgaaggttaccccaaagaaggccaatctcctcgacccgcactccatcaagcaccttctcgacgagaccatctccgaggtcgtgaagagtaagggctacaccgaggacacgcggctgggcaactggaagctggggatcggagccgccgtgattgctgtcgccctcctcgctcagttttaccccaagaagttcccgcagaaccgcgatttcctccttggctgcatcgccctatatccttttcttcattggtttgccctatcttttggttatgatgaatcggcgctagatctgatttctgttgagaatcgtgtggaattgttgcttgttgctgttgatccttgacttagatgactcgatacgtatgtggtgctgaatgtggtgctgctgatccttagctacaccaaggagaaggatgccatcctattcacgcaccctcctatggggttcttcagcagcactggcctcactatttcttctaaattacaagatgctcggacatgtacactctcacaatagcaagtgcggatccacagtctatctctgcaaacaagccagttcatttcactaagtagcgtacaaagtgtttaacaaagaaggaggtcntgtgnagggcctgttctggaggatgtcnaganctgatgatgactacacagtgagcgcagagttatgt

SEQ ID NO: 83122 - DNA, 893 bp, Zea mays
  misc_feature: Ceres CLONE 1568985
  misc_feature: Encodes the peptide sequence at SEQ ID NO. 83123
  misc_feature (641)..(641): n is a, c, t, g, unknown, or other
ctccccgcggtggcggccgctctagaactagtggatcccccgggctgcaggaattcgtctcacccctagaaaaaggagctctaccaccgtccaccatcaccgcctcgtgtgcagcgtgctcgctcacctcctctgtcgacgcaccaccccgaagcccccccgccgcgctcgcagggtgttcgacccttcgcccgcgcgccctcacgacatggcctcctccgtctccgccgccgccaaggccgccgcggcgttcgcgcacaaggtccagaaggagctggccgcgccggcgcagcgccgcgcgggcttgacccgccggaccaagccgtgcagcgtgcgcgccgtcgcttcgcccgcgcgcgccctgtcgtccaccggctcggtgaagagcgcgatgaccatgacggagaagatactggcgcgggcgtcggagcgcgcggcgttggagcccggggagaacgtgtgggtcgacgtcgacgtgctcatgacgcacgacgtctgcgggcccggcgccttcgacatcttcaagaaagagttcgggggaggacgcccagggtctggggaccgcgagaagctcgtcgtcatcccggaacactacatcttccaccagcgacgaccgcgcccaaccgcaacgtcgacatccntaggggacttctgggcgggagcagaaacaccaggtacttccttggacatcaagggacctccgcaattttcggggctaatccgggacttacaagggggtttgccacattcccactttggttagggaaggcccccgggccaacccggggaaaggttctccttgggggcccgaattcccccccaatgccaaaggcggggagcctttttggtcccgttttgccacctgggaatccggaaaacaccgggacccgggg

SEQ ID NO: 83123 - protein, 184 aa, Zea mays
  misc_feature: Ceres CLONE 1568985
  misc_feature: SWISSPROT Homolog: EC 4.2.1.33 3-isopropylmalate dehydratase
  misc_feature (145)..(145): Xaa is any aa, unknown, or other
MASSVSAAAKAAAAFAHKVQKELAAPAQRRAGLTRRTKPCSVRAVASPARALSSTGSVKSAMTMTEKILARASERAALEPGENVWVDVDVLMTHDVCGPGAFDIFKKEFGGGRPGSGDREKLVVIPEHYIFHQRRPRPTATSTSXGDFWAGAETPGTSLDIKGPPQFSGLIRDLQGGLPHSHFG

SEQ ID NO: 83124 - DNA, 914 bp, Zea mays
  misc_feature: Ceres CLONE 1568986
  misc_feature: Encodes the peptide sequence at SEQ ID NO. 83125
caccgcggtggcggccgctctagaactagtggatcccccgggctgcaggaattcgtctcacccctagaaaaaactgcatcagagcacgaccacactacccacccacctccactactgaccgattcccagaaagctcgatctagcgcgcgcggctgcagagtgcagacgacgacgtacaccatggcgcggcggtccctggccctgctgctcgcgtcgtcgctcgccctcatgtcggccgccgtcgcatcggcggactcgtggctctacgacaagttcaacacggacggcaccgtccgcacccagtacgacgcgtcggggcaggaggtggcgatgctcagcctggaccgcagctccggcgccggcttcaactccaaggagcagtacctgtacggcgagttcagcgtccagatgaagctcatccccggcaactccgccggcaccgtctcgtgcttctacctctcgtcgggcgacggcgacgggcacgacgagatcgacatggagttcatgggcaacgcgagcgggcagccggtggtgctgaacacgaacgtgtgggccagcggcgacggcaagaaggagcaccagttcgacctctggttcgacccctccgccgactaccacacctacaccatcatctggaaccccgaccacatcctgttcaaggtggacggggacgtgatccggggcctcaagcgctacgccgaacttgcgtacccgagcgcgaagcccatggcgctgcccgccacgctgtgggacggccgcttctgggccaccagaaagggaaagttgcccgtgggactggtccgccccgccctttttctgtttcctaccgggggttatcccccaaacgccggcttttgtttaccacccctggggaaaggggatccaattgggagagaccccaaaaagattggaca

SEQ ID NO: 83125 - protein, 244 aa, Zea mays
  misc_feature: Ceres CLONE 1568986
  misc_feature (28)..(208): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MARRSLALLLASSLALMSAAVASADSWLYDKFNTDGTVRTQYDASGQEVAMLSLDRSSGAGFNSKEQYLYGEFSVQMKLIPGNSAGTVSCFYLSSGDGDGHDEIDMEFMGNASGQPVVLNTNVWASGDGKKEHQFDLWFDPSADYHTYTIIWNPDHILFKVDGDVIRGLKRYAELAYPSAKPMALPATLWDGRFWATRKGKLPVGLVRPALFLFPTGGYPPNAGFCLPPLGKGDPIGRDPKKIG

SEQ ID NO: 83126 - DNA, 1104 bp, Zea mays
  misc_feature: Ceres CLONE 1568987
  misc_feature: Encodes the peptide sequence at SEQ ID NO. 83127
aaagctggagctcccggcgatggcggccgttctagaactagtggatcccccgggctgcaggaattcgtctcacccctagaaaaagtcgcctcacgctcacgctcacgctgcttgctcctcctcccccatccctccgcccctcccatggcgtccctcttcggggctcgccgccggcgatcgccggagtacgacggcgaggacgatagatccggcggagggagggccaagcaccgacgcctgtcgccggaggaggctgcggcgtcgccggcggacccgggcgcggcgacggggactagccacggctggctctccggcttcgtctccggagcgaagagggccatttcttccgttttgctgtcctcttcgcccgaggagaccggctcgggggaggacgggaggtgcgagggaggaaaactatctcttccccgtgagcacgaaggattgtgggggttattcggatcgcgcggcggacggttggctgatctgtggggtatgcgtgtgcgtcgttgctctccgcatggtgtgtagcctgtgttcgggtcagagtggggggcggcgcggcgagagggctgggatgcggggcggaggaaggtgggtgacgggggtgagtctttcgatgtgcgggcgggcgtggggtgtgtgttcaacctccccccctctgggcgcgggcgttgcggcacgtcgctgttgtcgggtatcatccagcgcgcgccgctgtctattgtgggcccgccctcgggctagggcgggcgtcatcgtcactcgtaagtgggctatactgcatagtgagggattgtctgatcctgcaatttaagagagcgtatagcgcatatcgcgtgaagtgctgacattgatgacagggctgtggcaggtaatggtgtgggttgagcggaggaggtgggtgtggtcagtaccgccacatctgtgccggttcgttatattctagctgtagagattcgctatgaagcgagtcggcgcgcactgtagcccgaggttgtgtgtgtggttgcccgctcggacgctggtaagtggctgctgttggggatctgtactagaggtttgattgtattgtccggcgcggggaatctgtgcgtcgtgtgaggg

SEQ ID NO: 83127 - protein, 127 aa, Zea mays
  misc_feature: Ceres CLONE 1568987
MASLFGARRRRSPEYDGEDDRSGGGRAKHRRLSPEEAAASPADPGAATGTSHGWLSGFVSGAKRAISSVLLSSSPEETGSGEDGRCEGGKLSLPREHEGLWGLFGSRGGRLADLWGMRVRRCSPHGV

SEQ ID NO: 83128 - DNA, 887 bp, Zea mays
  misc_feature: Ceres CLONE 1568988
  misc_feature: Encodes the peptide sequence at SEQ ID NO. 83129
ctccccgcggtggcggccgctctagaactagtggatcccccgggctgcaggaattcgtctcacccctagaaaattatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtcaagtaacatcatggaagaatgacaatggggaagacttgcttttcctcagcagcaaggctattttcaaacctccaaaagctattcgtggtggtataccaatctgctttccccaatttggatcacatggaaatcttgaacaacatggattcgctaggaaccggttttggactattgacaacaatccacctcctttaccattaaaccctgctattaaagcttttgttgatctgattctgaagccttctgaagaggatttaaagatctggccccacagttttgaaattcgtttgagagttgctcttggaccttctggagatttgagtctcacatcacgaatcaggaaacacacccccgatggaagacccttctcttatacatttgcatatcacacatacttctctgtttctgactaagtgaagggcgtgtcgaaggacgggaaacttgggactaccttgacaacttaaagcaaaggaacgtttccagagcaaggcgatgctagttgttttgaatcaaagttgaa

SEQ ID NO: 83129 - protein, 174 aa, Zea mays
  misc_feature: Ceres CLONE 1568988
  misc_feature (18)..(175): Pfam Name: Aldose_epim Pfam Description: Aldose 1-epimerase
MQLPSPFAELVKGPSGLEKVVLRGARNCCAEIYLYGGQVTSWKNDNGEDLLFLSSKAIFKPPKAIRGGIPICFPQFGSHGNLEQHGFARNRFWTIDNNPPPLPLNPAIKAFVDLILKPSEEDLKIWPHSFEIRLRVALGPSGDLSLTSRIRKHTPDGRPFSYTFAYHTYFSVSD

SEQ ID NO: 83130 - DNA, 897 bp, Zea mays
  misc_feature: Ceres CLONE 1568989
  misc_feature: Encodes the peptide sequence at SEQ ID NO. 83131
tagagctggagctccccgcggtggcggccgctctagaactagtggatcccccgggctgcaggaattcgtctcacccctagaaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtggttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaaagaagccatcctgatatcccttttggcttcctcgttctagtagtttaaggatttcttttctgacaccttggattcttacccattccccctggggctgctggttttcctgacaatcgaacagtttccccagtcttggctccctggaagtcctccctccctccatcttcagggggttggggtcctgactcaccttgcaccaaatgggtggttctttccggcggcgggggggccccccgggcctcagcttttggggttgtgaggggctattaaaaagcgccttggggataacatcctttgagggacccgtgttttggggggccccccggggggggcggtttggttgcccccctccgggttcccaaaatgagcctggttcggggaacgtgcccgggggcaacaaatggc

SEQ ID NO: 83131 - protein, 59 aa, Zea mays
  misc_feature: Ceres CLONE 1568989
  misc_feature (1)..(50): Pfam Name: AdoMetDC_leader Pfam Description: S-adenosyl-l-methionine decarboxylase leader peptide
MESKGGKKSSSSRSMMYEAPLGYSIEDVRPAGGAKKFQSAAYSNCAKEAILISLLASSF

SEQ ID NO: 83132 - DNA, 884 bp, Zea mays
  misc_feature: Ceres CLONE 1568990
  misc_feature: Encodes the peptide sequence at SEQ ID NO. 83133
ctccccgcggtggcggccgctctagaactagtggatcccccgggctgcaggaattcgtctcacccctagaaaaaaaaaaaaaccgaagccgcactctaccgcgctcctcccgaaccacagctatgctcgcccaccgcctcctcctcctcctcgccgtcgccgcggcgagcggcaccgccttcgctaagccgacggcgtacgaagccctcgctgactacgacttcccgccggggatcctccccaagggcgtggtcgcctacacgctcgacaacgccacgggcgccttcacggccacgctcgacgcctccgcgtccggcagcgggtcctccgtctgcgagttctccatccagggctcctactcgctccgctaccagaccaagatcaccggaaagatcgcccccgaccacctcaccgacctcgagggcgtctccgtcaaggtcctcttcttctggctcaacatcgtcgaggtcacccggcgcggcgacaacctcgagttctccgtcggcatcgtctccgcggacttcgggagtgaaaacttcctcgagtgccccacctgtggctgcgggttcgactgcaacaacctgctcatgctgcagaagcccggcgccgccaccgccaagctgcgcctgcggggtgccttctagaactcacttctgcagatttggtgactgctgctgtaagctgcctcgactagtagtgctgtatgtctagtagatgtgggtttataaagagggcaaacttgaaagatcccagcttttagatgtgggatggggtaaccaagtccaggactcgatgtcatgtttcaccaatggtttcgaacagttctggaaacagtccgagaagcattaagacctttcaatatttttaatttatacctccccagg

SEQ ID NO: 83133 - protein, 173 aa, Zea mays
  misc_feature: Ceres CLONE 1568990
  misc_feature (3)..(151): Pfam Name: DUF538 Pfam Description: Protein of unknown function, DUF538
MLAHRLLLLLAVAAASGTAFAKPTAYEALADYDFPPGILPKGVVAYTLDNATGAFTATLDASASGSGSSVCEFSIQGSYSLRYQTKITGKIAPDHLTDLEGVSVKVLFFWLNIVEVTRRGDNLEFSVGIVSADFGSENFLECPTCGCGFDCNNLLMLQKPGAATAKLRLRGAF

SEQ ID NO: 83134 - DNA, 1010 bp, Zea mays
  misc_feature: Ceres CLONE 1568994
  misc_feature: Encodes the peptide sequence at SEQ ID NO. 83135
  misc_feature (484)..(484): n is a, c, t, g, unknown, or other
ggagctccccgcggtggcggccgctctagaactagtggatcccccgggctgcaggaattcgtctcacccctagaaaaatattgaaaagttttctcaagagaagttatggtaccttgaccagatgttcaatgttttatctctggctggaaatcatgtgaaggatgacatatgtcatgcccttattgttgtactaagtaatacatcagagcttcaaggatattcagtgaggtcattgtataaggccttacaagaatatggtaaacagggaagtttagtaagagtagctgtttggtgcattggtgaatatggtgaaatgctggtgaacaatgttggcatgctggatggggaggagccaattaaggtaacagaatcagatgctgtggatgctgtagaggtccctcttaaccgctactcagcagatatgacaactggagcaatgtgtctggttgctcttctgaaactctcctcacgatttcctttgacntcagagtagataaaacaaatagttgcccagaataaagggaatgttgtcctttgaactacagcaaagatcaattgaaattcactttccattatacaaagacatcagtcctatcaggatcgtccctttgcttgaaacgcattacctgtgattagaatgaagcttagtttatctgggtgaaagcggggctaactgctacaccaatcaacctattttcagcaaataaaaattgctccaacaattcacttcctggaagcccttaagctttccaaattgggtgtagcaaaaaccccacctcagctccctttaagctaatttggcttggatttccagtccttgatggtgcccccaagtttccaaccgtttgcttctaataaaaaaacctaataaatgttttcaagaactttcgggggtttgggggggagttattccaccaaccaacggggtaacttaaccccaagcccaaatattctttagggactttcgggccatgggatcactccacacaaaaatggcacccccctaaaaa

SEQ ID NO: 83135 - protein, 123 aa, Zea mays
  misc_feature: Ceres CLONE 1568994
MFNVLSLAGNHVKDDICHALIVVLSNTSELQGYSVRSLYKALQEYGKQGSLVRVAVWCIGEYGEMLVNNVGMLDGEEPIKVTESDAVDAVEVPLNRYSADMTTGAMCLVALLKLSSRFPLTSE

SEQ ID NO: 83136 - DNA, 873 bp, Zea mays
  misc_feature: Ceres CLONE 1568997
  misc_feature: Encodes the peptide sequence at SEQ ID NO. 83137
  misc_feature (710)..(710): n is a, c, t, g, unknown, or other
  misc_feature (737)..(737): n is a, c, t, g, unknown, or other
tggagctccccgcggtggcggccgctctagaactagtggatcccccgggctgcaggaattcgtctcacccctagaaaaagctgcgcgtgctcgtgggcgggcggaattcggggttcttgcgcggtcccggtcccctcggcgattgcggacgctctctgcagatcttcgcgtaactccgggagcgcgccggagatgaactgcgggccgcccgaccagctgccgccggggtcggcgccgtcgtgcttcctcaacctgaactgggaccagtctatggccgccgaccagctcgacccggcgctcagctcgatggtctcctccccggcgtccaactcgacggccgccgccgcggttactgacggccgcgctctccacgggatctctccgcagcagcagtacggaggcactccgctcagctcgccccccaagctcaacctgttccaccaaactcgcccccagttccaccacttcccgccgccgcaggtcggcggcctgccaatcctggagaacctgatgccgatgggccatctagaccagttcctcgccgacccaggcttcgccgagcgcgcggcgcggctgtccggcttcgacggccgccccggtggaagtggctatggaggcgtcggcgtcccgggacagtttggcatcccggacgccggccccatcggcgcattgaagggagctggagctcggggaccggccgggaccagtcntcggtgtccaaatcggcgtccggcaanccggaaaatggccctcaaccaaggggctttccaacggcatgcgaaaaaaccgaaggcttccggggaggggcaaaggaagggacggccccgggtccccccccccgggcccccccaggagggatccaaggggaaaccc

SEQ ID NO: 83137 - protein, 227 aa, Zea mays
  misc_feature: Ceres CLONE 1568997
  misc_feature (173)..(173): Xaa is any aa, unknown, or other
  misc_feature (182)..(182): Xaa is any aa, unknown, or other
MNCGPPDQLPPGSAPSCFLNLNWDQSMAADQLDPALSSMVSSPASNSTAAAAVTDGRALHGISPQQQYGGTPLSSPPKLNLFHQTRPQFHHFPPPQVGGLPILENLMPMGHLDQFLADPGFAERAARLSGFDGRPGGSGYGGVGVPGQFGIPDAGPIGALKGAGARGPAGTSXRCPNRRPAXRKMALNQGAFQRHAKKPKASGEGQRKGRPRVPPPGPPQEGSKGKP

SEQ ID NO: 83138 - DNA, 1316 bp, Zea mays
  misc_feature: Ceres CLONE 1568998
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (73)..(73): n is a, c, t, g, unknown, or other
  misc_feature (74)..(74): n is a, c, t, g, unknown, or other
  misc_feature (284)..(284): n is a, c, t, g, unknown, or other
  misc_feature (500)..(500): n is a, c, t, g, unknown, or other
  misc_feature (527)..(527): n is a, c, t, g, unknown, or other
  misc_feature (780)..(780): n is a, c, t, g, unknown, or other
  misc_feature (935)..(935): n is a, c, t, g, unknown, or other
  misc_feature (942)..(942): n is a, c, t, g, unknown, or other
  misc_feature (1006)..(1006): n is a, c, t, g, unknown, or other
  misc_feature (1013)..(1013): n is a, c, t, g, unknown, or other
  misc_feature (1191)..(1191): n is a, c, t, g, unknown, or other
acggggggaacgggggggggaatcgannnnnnaaannannnnnnnnngnnnnnnggnnnannnnnannnnagnnctcccccggtggcagccgctctagaactagtggatcccccgggctgcaggaattcgtctcacccctagaaaaaaggacgacccaagcaggcaagcgagcagcaagtacatacatactaggcagccaggcagacatggcgcccaccgtgatgatgggcttgtgggccacccccggtcgcgccgttgcagggaggtaaagtccaccgcccgncctccccatgcgcccgccgactccttgagaagccttcggctaacgtcagccaacagcgggacggcatccgggggaatggtaagtgtgggccgggctaagcaggacaaagagtttggatgcacgctggccgaacctggtcctcacgtgtgcgacgggagaaccccgcataaaacaacttggtgaatacctgggggggcgaaaggggttggaataaancccccccctcgtccccccaaaaaaganagggggtttcttgggtgccggaaagggaacccccccccctcgccgcgggggtatattagggtggggggggggttatccgagacccttgtggtgaaacacgggggccaaggtgttcccgggggggaaaaaggaagcccgaagtaaagtgggggtacaaggaggatgtctcccgggagagggtccgcctctaaaattcttagtgggcggggaggagggccttgttcacactgccaggttatttgtgggcgtgttntttgtaacaggccttccagatggaggaaacacccatggtgttgtgtttgtgcccggactgatgtatgtctcgtcttccataaagggtctccccctgtggggcgagcgcatggaactatggtgatggtggggtcgccctgtgggacagagggttcncctgggnggggggagggggtgtagtgtttattgattctttcggtgtggcgcgcggggaagcgatatgaagnggttcgngtgagggtaagtgctacgtgttggcgtccctgtatttctatctcatggtggtcgggagtggattttcgcggggggggccggatttttgcgagcgagatcaatatagcggagtgtgtgtgacggtgatcacagcgttattgtgtttgtagtggcggcccgcctgtcaagttagggtggnagcgcgccgccatatagaggagtgctggtgtgagtggcttcgcacgccgatgtgctgcctgcgcttggtgggggtggaaaccacacaatgtgagatgggatgctcgttacctgcttgtgcgcggt

SEQ ID NO: 83139 - DNA, 880 bp, Zea mays
  misc_feature: Ceres CLONE 1569002
  misc_feature: Encodes the peptide sequence at SEQ ID NO. 83140
  misc_feature (605)..(605): n is a, c, t, g, unknown, or other
  misc_feature (653)..(653): n is a, c, t, g, unknown, or other
ctccccgcggtggcggccgctctagaactagtggatcccccgggctgcaggaattcgtctcacccctagaaaaaaaaccaagcaacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcaagtcccggcgcgctctcctcagagaactcggggagtcggcgcacgatgcgcccgtgctccccaccgatgtctccccgacgatttcgactggaggggacacgcgccgtcgggccccgtcagaccaggggtcgtgcgggtcgtgctggtcnttcaccgcgtctggagcgctggagggtgccacctacctcgcaacgggnaggctggagggctttcggagcaacattcgtcaactgggaccccaaggggggttctccgaacccggtccaggggtttcgggtggcaaggggggctaagaaaacggcttttcttttccccaaaggccggggccctaaagaggaaaagtaaccccttccccggggaggggggaaaagccattttacaccccaaattggtgccccctcaaaaacacggggtggtgggtggg

SEQ ID NO: 83140 - protein, 209 aa, Zea mays
  misc_feature: Ceres CLONE 1569002
  misc_feature (48)..(104): Pfam Name: Inhibitor_I29 Pfam Description: Cathepsin propeptide inhibitor domain (I29)
  misc_feature: SWISSPROT Homolog: EC 3.4.22.41 Cathepsin F
MAHRVLLLLSLASAAAVAAAVDAEDPLIRQVVPGGDDNDLELNAESHFLSFVQRFGKSYKDADEHAYRLSVFKANLRRARRHQLLDPSAEHGVTKFSDLTPAEFRRTYLGLRKSRRALLRELGESAHDAPVLPTDVSPTISTGGDTRRRAPSDQGSCGSCWSFTASGALEGATYLATGRLEGFRSNIRQLGPQGGFSEPGPGVSGGKGG

SEQ ID NO: 83141 - DNA, 877 bp, Zea mays
  misc_feature: Ceres CLONE 1569004
  misc_feature: Encodes the peptide sequence at SEQ ID NO. 83142
  misc_feature (745)..(745): n is a, c, t, g, unknown, or other
  misc_feature (831)..(831): n is a, c, t, g, unknown, or other
  misc_feature (870)..(870): n is a, c, t, g, unknown, or other
ctccccgcggtggcggccgctctagaactagtggatcccccgggctgcaggaattcgtctcacccctagaaaaaggcgcgcggcacctcaagctcctgcttttccattgctctgcgtctgcgtctgcgtctgcgtctgcactgcttcgcgtctccctccccccgcctccgcccccgccccggcaaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccaagagcaacgccgtcgtcgggctcaagctcaacgacggagggcccggcctcatcggctccgggaagctggccttcggcggcgccggaggcggcggcaccaaggccgatcgctacaacaacaacaacaacctccccaacaccgacaacaagaccgtgtacaacagcagcagcagcttcatgggcaacggcagcagctacgccaagaacaacaacaacaacgccggcatgctggcgttcgacaagatggggagctacggctacaacagcaacaacggcggcggtaataccaacaacaacagcaacgggcgtggaggtgaagagctacttcaacaagtcccgccgggtaggcggcgatgcactacaacaactacaacnactgcctcgccgggcgcggcaacaagaatggcggcgccggggagtacggcatgaagtagcacgccaagatcgtaggcgctgcggcngccactgacaagcagcggttcatgacgctgcctgcgtcngaagcgc

SEQ ID NO: 83142 - protein, 198 aa, Zea mays
  misc_feature: Ceres CLONE 1569004
MEGYDREFYQFSDQLRLQTAAFSGLSLGDSIWSPAGRRNNSNDVLFAASASPADAAKSNAVVGLKLNDGGPGLIGSGKLAFGGAGGGGTKADRYNNNNNLPNTDNKTVYNSSSSFMGNGSSYAKNNNNNAGMLAFDKMGSYGYNSNNGGGNTNNNSNGRGGEELLQQVPPGRRRCTTTTTTTASPGAATRMAAPGSTA

SEQ ID NO: 83143 - DNA, 994 bp, Zea mays
  misc_feature: Ceres CLONE 1569008
  misc_feature: Translation starting site: 164
  misc_feature: SWISSPROT Homolog: EC 3.3.1.1 Adenosylhomocysteinase
  misc_feature: SWISSPROT Homolog: EC 2.7.11.1 Non-specific serine/threonine protein kinase
  misc_feature (1)..(1): n is a, c, t, g, unknown, or other
naaagctggagctcccgtcgattggtggagcttactcttgggggatcccccgggcgtgcggaattcgtctcacccctagaaaaaaaagccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccccccccccctcctgcaacatcttctccacgcaggagcacgccggccgccgccatcggcgcggcgactcgggccgcccgtgttcccctgggaaggggggagaccctttgagggagtacctgggtggtggcacccggccgcctgccctttgactgggggccgaggccgggcgggcccccgaaccctctttggttcgacgaacggggcgggcgaacgcccaccgcttggttccgtccccccgaggggggggccaggggcgccggagcggcggggagtcccggagagaagaacccgggcggagggttcgcccgggaccggggagggccccacccaggaaacggcgtggaggtgcagaggagtcgtgggtgtcgccgttgttggcgcggcggagggggtttcgggggcttggggccccgaggaagtgtcgccgcggggcgtaggggggaggggcggttttccgggggtctccctgaagggggacccgcccccgggtgggctcaaggggctcttcgcccgaggtggggggaaccggcgggcgcggcgtgtgtgccccgccgcgaagagtgaacgggagtggcgcgcgcggggg

SEQ ID NO: 83144 - DNA, 929 bp, Zea mays
  misc_feature: Ceres CLONE 1569009
  misc_feature: Encodes the peptide sequence at SEQ ID NO. 83145
  misc_feature (828)..(828): n is a, c, t, g, unknown, or other
  misc_feature (906)..(906): n is a, c, t, g, unknown, or other
tggagctccccgcggtggcggccgctctagaactagtggatcccccgggctgcaggaattcgtctcacccctagaaaacacttggtggaagcatatgctcaatttgtgaaagattattacattaaaaaaatggagacaccaccatcctcgtatgatcgagaatatctgaaggaaacaactccacatgattctagttctaggctctggtggttccaagtttgcagtgaggttgcctactttcaagtggcacccaaaaatgacagcgttcgttctgcaaggatcaatacgaggtaccatttggacctatgcagacatgtctttggggaaggcgtttatcccgatgtgttcatgacgaacttgtattatggaggcacaagaatcgctgcttctaaaatcgtgtttacaaatggctcccaagacccatggcgccatgcctccaagcagaaatcatcgaaagacatgccgtcgtacataatgaaatgcagaaactgcggacatgggactgatctgaggggctgtccgcagtggcctttcaggatcgaaggggacgcttcgaactgctcgtctctcgctgtagtcaataccgcaagggagaggatcgccaagcacatcgacctgtggctgtcgcaatgcagcaaaccatcagtaggagcctggtaaccgcggactagtggttcatccactcgggctcgggaagagtggaaagaggtttggattggatgtcctggagcatacttgtgtcgggacttggattacgtgtttgtgcactttgaaaagcagaaaaagctgatggtggtaagcagcagtgcccggtaccccacagggtantgatgcaggcaggggtggtgctgtctgtgtcaatgccctcttccttttctggcgtgcgctgcaaatgaaacctgtcancgcccctttggtgcgccgccccc

SEQ ID NO: 83145 - protein, 176 aa, Zea mays
  misc_feature: Ceres CLONE 1569009
  misc_feature: SWISSPROT Homolog: EC 3.4.14.2 Dipeptidyl-peptidase II
METPPSSYDREYLKETTPHDSSSRLWWFQVCSEVAYFQVAPKNDSVRSARINTRYHLDLCRHVFGEGVYPDVFMTNLYYGGTRIAASKIVFTNGSQDPWRHASKQKSSKDMPSYIMKCRNCGHGTDLRGCPQWPFRIEGDASNCSSLAVVNTARERIAKHIDLWLSQCSKPSVGAW

SEQ ID NO: 83146 - DNA, 870 bp, Zea mays
  misc_feature: Ceres CLONE 1569010
  misc_feature: Encodes the peptide sequence at SEQ ID NO. 83147
  misc_feature (485)..(485): n is a, c, t, g, unknown, or other
  misc_feature (494)..(494): n is a, c, t, g, unknown, or other
ctggagctccccgcggtggcggccgctctagaactggtggatcccccgggctgcaggaattcatctcacccctagaaaaatcctccccccttcccctctctcgcccctcctccctccgtctcgtctcccaggtcatggcaaaagctggagcaccgggaaaaatagcaagtgggagataaacaggaagagctaggtgaatacttaggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcacagcgtggtgttccctggcgtccgctacttcgtggatctcctgctgcaaaacggcgaccagaacctgggcttcgcctcactcatgccgcagacgtcctccggcgaccagtgcgtgatgggggagggtngatcttgtngactcaccttcaaacagcttcccggactctgagcacgacgacagcgatgacaacgttgatgacctcccggcagctgagctcctcatgtgcgaggcagcatgaatctgaatcggcatcagcagcagcaccagaagcaggaactggtatctcatgggtagaggggaggagcctcatggacaggatcctcccaacaaaaggttatcgcatgacctacgccctgctcaaagaacatgtcaactttacaaaggacggcatccctccagtaacagggtccaaatggatggatggagggatgtcccaaccgagctttcttggaaaacgggtgaacctactcctttagaaggattttcctggtgaaatggtggcaaacacactt

SEQ ID NO: 83147 - protein, 65 aa, Zea mays
  misc_feature: Ceres CLONE 1569010
  misc_feature (53)..(53): Xaa is any aa, unknown, or other
  misc_feature (56)..(56): Xaa is any aa, unknown, or other
MMGGGLMMDHSVVFPGVRYFVDLLLQNGDQNLGFASLMPQTSSGDQCVMGEGXSCXLTFKQLPGL

SEQ ID NO: 83148 - DNA, 902 bp, Zea mays
  misc_feature: Ceres CLONE 1569011
  misc_feature: Encodes the peptide sequence at SEQ ID NO. 83149
ctccccgcggtggcggccgctctagaactagtggatcccccgggctgcaggaattcgtctcacccctagaaaaaatgccatttgctttgctgacgaatagctttcgatgatacactagtgttcagttaaccgtaggttgtttcgccacaggactcggtggaaatggagttcttcaccgagtacggagaggcaagccagtaccagatccaagaagtcattggtaaaggcagctacggggtagttgctgcagctgtagatacccgcaccggtgagcgggttgctatcaagaagatcaacgatgtgtttgagcatgtctcggacgccacacgcatactgcgggagatcaagctccttcggttgcttcgtcacccagacatagttgagattaagcacatcatgctccctccatctcggagggagttccaagatatttatgttgtttttgagctcatggagtctgatctccatcaagtgatcaaggccaatgatgacctcacccctgaacatcaccagtttttcctgtaccaacttcttcgtgctctcaagtacatccatgctgctaatgtatttcatcgtgacctaaagcccaagaatatactggctaactcggactgcaaactgaaaatatgtgactttggtcttgcccgtgcatcatttaatgatgccccttcagctatattttggacagattatgtggcaacgaggtggtaccgggcacctgaactatgtggttcttttttctccaatacactcctgcaattgatatttggagcattgggtgcatatttgctgaacttctcactggaaggccactattcctgggaaagaatgtgtacaccattagatattatacagatcttcttgggaactcatcatctgagaccttatctcggatccgaaag

SEQ ID NO: 83149 - protein, 246 aa, Zea mays
  misc_feature: Ceres CLONE 1569011
  misc_feature (13)..(227): Pfam Name: Pkinase Pfam Description: Protein kinase domain
  misc_feature: SWISSPROT Homolog: EC 2.7.11.24 Mitogen-activated protein kinase
MEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSNTLLQLIFGALGAYLLNFSLEGHYSWERMCTPLDIIQIFLGTHHLRPYLGSE

SEQ ID NO: 83150 - DNA, 835 bp, Zea mays
  misc_feature: Ceres CLONE 1569012
  misc_feature: Encodes the peptide sequence at SEQ ID NO. 83151
  misc_feature (712)..(712): n is a, c, t, g, unknown, or other
  misc_feature (717)..(717): n is a, c, t, g, unknown, or other
  misc_feature (807)..(807): n is a, c, t, g, unknown, or other
ctccccgcggtggcggccgctctagaactagtggatcccccgggctgcaggaattcgtctcacccctagaaaaaaactccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgctgctggcagggagaagtttgcttcagtcccatgtggcggtggcggtgtggctgttgtggcagctgcccctgctgctggcggcgctcctgcagctgaggcgaagaaagaagagaaggtggaggagaaggaagaaagtgatgacgacatgggcttcagcctcttcgactaagcctgtgcaatagtcaagagtattgtttttgagtcgcggaagcagagggaagaaaaatcgtagtcatgtttggactttaactttgttttatgttggaaagtacttgaaagacttttcctgtggtaattctaggcgtaggttgctgtgctggttggggtttactggtgaaccagagtttttctatctcccactatgaaaattgtaccntcagntacctggatgttcactattttgttggtacaaaaaaaaaaaaaaaagaagctagaacagagcggggcgtacggagatacaggttccaagcnaaagcagtgcaggcaggaacagtggacc

SEQ ID NO: 83151 - protein, 111 aa, Zea mays; identical to SEQ ID NO: 60604
  misc_feature: Ceres CLONE 1569012
  misc_feature (17)..(110): Pfam Name: Ribosomal_60s Pfam Description: 60s Acidic ribosomal protein

SEQ ID NO: 83152 - DNA, 917 bp, Zea mays
  misc_feature: Ceres CLONE 1569013
  misc_feature: Encodes the peptide sequence at SEQ ID NO. 83153
  misc_feature (836)..(836): n is a, c, t, g, unknown, or other
  misc_feature (881)..(881): n is a, c, t, g, unknown, or other
  misc_feature (882)..(882): n is a, c, t, g, unknown, or other
  misc_feature (917)..(917): n is a, c, t, g, unknown, or other
ctccccgcggtggcggccgctctagaactagtggatcccccgggctgcaggaattcgtctcacccctagaaaaaatccgagaccgggaggccttctctctctctctctctctctctggcgacggccatggtgcagcaacagcaacacagaatctacatcttgcagttcaggaagggcgagacggagcaggaggtggcatgcaaagtgtcgcagcccaagggcgtcgggcggcgggtcatgtactactaccaggactacggcagcggcggcggtggcaagagcggcaagacggtgcaacccagggcgctcggcgtgcggcgcttcttggccatgctcctgctctccttcctctgcgtggggacgctgttcgtggcgcccgtgtccttcctctccttcgtgcatagcgatgaaggcggcgcggcggcggcggccacggccgcgcgcggcggggtgtccgggccgtgctcggccgtggggaacaacagcctctgctgcgaccgcacgtcggagcgcgcggacatctgcttcgcgaggggggacttgcgcatgcactcggccagcgcgtcgttccagctcgtgtccaccggcaactcgacgccgggggagcggatacggccgtacacgcgcaagtgggaggcgaacgtgatggcgacgatcgacgaagtgcggctgcgccgcgtggcccccggcgaacgcgcgcggtgcgacgtgcgccacgacgtaccgggccgtggtgttctcccacgggcgggtacacggggaacgtgtaccacgaagtcaacgacggcatcctgccgctctttcgtgacggcgcgccacttcccggcgcgcgtggncgctggtgatcctcgagtacaccgactggtggatgacaaagtacnngcgacgtggtgtccccagctgtcggaagtcccgcn

SEQ ID NO: 83153 - protein, 263 aa, Zea mays
  misc_feature: Ceres CLONE 1569013
  misc_feature (237)..(237): Xaa is any aa, unknown, or other
  misc_feature (252)..(252): Xaa is any aa, unknown, or other
MVQQQQHRIYILQFRKGETEQEVACKVSQPKGVGRRVMYYYQDYGSGGGGKSGKTVQPRALGVRRFLAMLLLSFLCVGTLFVAPVSFLSFVHSDEGGAAAAATAARGGVSGPCSAVGNNSLCCDRTSERADICFARGDLRMHSASASFQLVSTGNSTPGERIRPYTRKWEANVMATIDEVRLRRVAPGERARCDVRHDVPGRGVLPRAGTRGTCTTKSTTASCRSFVTARHFPARVXAGDPRVHRLVDDKVXATWCPQLSEVP

SEQ ID NO: 83154 - DNA, 834 bp, Zea mays
  misc_feature: Ceres CLONE 1569014
  misc_feature: Translation starting site: 166
  misc_feature (495)..(495): n is a, c, t, g, unknown, or other
ctccccgcggtggcggccgctctagaatagtggatcccccgggctgcaggaattcgtctcacccctagaaaatcactcgtgtccgatggctcgcccccgccgcctcctctgacggtctgactgacccccgcctccccggagagcggctccgctgtctcgccggatatggcgccgcctcgtccccctcctaacccggcgggggagcagcagccgcagctccacggggtggtcatcatcacgctccctcccgcggaccagccctccaagggcaagaccgtcaccgccttcgcctacaccaacgaccccccgccccctcgctcgcccccggatccggttatggggtacccggcggcaacggaggctaggcggcggccgaggcgggcgctctcgacgcggcgggtggcgacggcggcgctcgtgctgggcgcgctcgcggtcgccgcctactactgcttctactcggacgtggccgtgcagttcctggggatggagcangaggaggagcagaggaacgagaccaggtctttcctgctgccgctctaccccaaggcgcgtcagggccgcgccctgcgcgagttcggggacgtcaagctcgccgccaggagggtagacgacggcggaagaaaggctaggaacaggatggaggtcgcgaaggcggccacggcgaggaccatttcacggcgttgctcccgatcaggggcatgtcttccccgatggcccagtatacacatctatctttattggcaacccctccagacatacttttcttgatgttgatactggaggcgacttgacgtggaatccagtgtgatgcaccatgtacaaactgcgcaa

SEQ ID NO: 83155 - DNA, 1152 bp, Zea mays
  misc_feature: Ceres CLONE 1569016
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (89)..(89): n is a, c, t, g, unknown, or other
  misc_feature (406)..(406): n is a, c, t, g, unknown, or other
  misc_feature (616)..(616): n is a, c, t, g, unknown, or other
  misc_feature (618)..(618): n is a, c, t, g, unknown, or other
  misc_feature (738)..(738): n is a, c, t, g, unknown, or other
  misc_feature (1119)..(1119): n is a, c, t, g, unknown, or other
  misc_feature (1152)..(1152): n is a, c, t, g, unknown, or other
ggggggggggcgcccccccccccgttttcttctttttataannnnnnnnnnnnnnnnnngggggggnnnnnccacaataagaggtcccncggtgggggcccctctaaactagtggatccccccggctgcaggaattcgtctcacccctagaaaaaattcacagcccctcccaggctccgaatcggcggccacttctcattcctcacttccgtcctcgcgcaccaccccctccagtcgggggggatggtgccttcgaaatcccgtccggcgccctagcgaacctcgggctcggccgggctccgggcccccccgggcctttcccagttcaggtcccccttccgaatttttttctgggggggggggggaggggtgcccttttttttaaggccctttttggaaaggtcgnagggggatttttttttttttccccccccaagcgggggggggggggggggggtcatttaaccccatttttctgggaacattaaaaaaaatacggggcccgggggggcccccggggcactcgcggagggggttttcccccccccccgcggggggtggggggcgccccccccccggggggtggggggtgcgccccccccccccccgggggaantngtgtgtggtgggattgtagtgatgggtaggcgctcccattccgtggctcttcgcgctctgggaaggcccgcagccccccgccgacagggcgaggtcgaggtcgggcggaatgatcggggnccggtgcagttgagtggccgcgccagaggagagaccgcgcgcggcggctctgcgtgccgtgtgcggcgtccggagccggacgtgcacagcgaggatgtgcgagacatcgcgatgcccgccgttgcttgggcgcgaccctcccgcgggcggcgctacacagcgatggctgaagtggcgcgtgggcgagagtggtaagccgggggcttcccaccccggtcgataggctgctggccgcgccgacatcgcgcgcgcgccgcgttgcgtaggtcggtgatagaggctggccgctgaccgtgccgccaacgtccaccgctactcactgggccggtgtacaccacgcgagtgcgactgcacctcctcccgcgcggcacccgcacggcncggcgacgtcgtctgtctctctcgcagcccggn

SEQ ID NO: 83156 - DNA, 882 bp, Zea mays
  misc_feature: Ceres CLONE 1569017
  misc_feature: Encodes the peptide sequence at SEQ ID NO. 83157
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (782)..(782): n is a, c, t, g, unknown, or other
  misc_feature (783)..(783): n is a, c, t, g, unknown, or other
  misc_feature (832)..(832): n is a, c, t, g, unknown, or other
ggagctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttgcttcggggtcaccgtaccctnnntgctgctggnnttctctttcctttttccttttttttttcttttccccggacatggtccanttggcttacagttttctctgctggatgtgatgtatccattgttgcaagca

SEQ ID NO: 83157 - protein, 170 aa, Zea mays; identical to SEQ ID NO: 73340
  misc_feature: Ceres CLONE 1569017
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 83158 - DNA, 1304 bp, Zea mays
  misc_feature: Ceres CLONE 1569019
  misc_feature: Encodes the peptide sequence at SEQ ID NO. 83159
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (796)..(796): n is a, c, t, g, unknown, or other
  misc_feature (935)..(935): n is a, c, t, g, unknown, or other
  misc_feature (1026)..(1026): n is a, c, t, g, unknown, or other
ctttgccccgcagttatggccctcttgtccccctctcacccgtaccacnnntttttttttacacctaagtggtgctccccgcggtggcggccgctctagaatagtggatcccccgggctgtttgaattcgtctcacccctagaaaaagccatcggggacgagggactgggagcctggatacttctgccgcgcggcgaccggtcgagcgaaatcgatctaccccaggtgcggcgggcgcggctttattctcaagattttttctgtgttctttagagagcagccatggacgagtggattcgccaaaccgaggtgtgggtgcaccaaaccgacagctggatccggcagcagcccccggagcagatctatgtagcggccgcggtgggttgccgtcacaatcctggtgcttatcgtagcatcttgtctgaaaacctctagaccaaactccttagttctatctgggggtttgccccccgtggtggggtgcccccccccccactaccggccttccgggtgtggatccccccccatcaaggaaaccgtttactttccattggaaataaaaaaaaatggtatacttttggttgctggctgttccggaggcaagaaacgggataagacctaaaggtttataacaatggcgcctattttaattcggatggttttcctgcgttaacatcgctttgggctccaaaaaccccacaaaccctttgtattataaagtcctccttgccactaaaaacactttcccatgccgcagatcggtcctttattgatgtgttgtgaaattccgcccccngaaataattatatgctggtggtcttctcactatcgtgctcaatatccttgtgcgcttgccgcactatgtatatcccccctttcgcgtgcacacaccttttgtcgggtatagatcaagactgctacaatcactgtgctgncgtgtacagagtataataaaagcgttgctcgcgcctgtgaggcgcgctattatgtttctctctgcgcacacgtaggctgattcatgtgttntcgtagtgttgtttactctgtccgctgtgttattagagagtaggtatatctctccacctacatacgtaagacacacgggtgtgggtgtcggagaaacaacaaactgcttggaatcttgcgactccttagtgcgaagcttatctctgtggatataacgccgcccgctatatgtctcctaatctgctgggtagaggtggttgtttcttatagagagacgtacccacactctgagcatcgagtgggtgcgcctccgatgacggatgaggagctgtaccact

SEQ ID NO: 83159 - protein, 50 aa, Zea mays
  misc_feature: Ceres CLONE 1569019
MDEWIRQTEVWVHQTDSWIRQQPPEQIYVAAAVGCRHNPGAYRSILSENL

SEQ ID NO: 83160 - DNA, 921 bp, Zea mays
  misc_feature: Ceres CLONE 1569020
  misc_feature (12)..(12): n is a, c, t, g, unknown, or other
  misc_feature (13)..(13): n is a, c, t, g, unknown, or other
  misc_feature (410)..(410): n is a, c, t, g, unknown, or other
ggagctccccgnncggtggcggccgctctagaactagtggatcccccgggctgcaggaattcgtctcacccctagaaaaaaaacggccaaacacaaaagcgagagcaaagcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgagagggaggagcgagggagcgcgcgggtagagaaaggcggggcggggggaggaaggaaaggaaggagcgccggccggagcagacgtcccctcgggggccctcggtcggatgagatcgacgatgaaggcgcagcacgccaacgggcggggggagcangagcccccttcctgacgttctacggcgctcacggctcgcccttcattacctttcgtcttcggggctctaacttttaaggaacttcttcctccaacgctgcaaccggcccctttctttccaacggcccccggcggcaaggcccggccccaaaaaaaaaaaccccagggcgggggcccccccccccgggggggcggaaaccggctttccccttttcccgggggggggccccgcccccccgggccggggggggttaactccccggcccaaaagggggaaattgggggttaaaaaaaaaaaaccggggcgggggcccttggttccccccggggggggaggggggggcccccttaaatttttagggccccggggtttcaaattttgccaggggggcaaccaggggccccccccccaaccaggggggggttaacccaaaaaaatttgggggggggggagacaccccccccccggggggggtcccctccctccccccccccctttttataagagagaa

SEQ ID NO: 83161 - DNA, 934 bp, Zea mays
  misc_feature: Ceres CLONE 1569021
  misc_feature: Encodes the peptide sequence at SEQ ID NO. 83162
  misc_feature (581)..(581): n is a, c, t, g, unknown, or other
  misc_feature (730)..(730): n is a, c, t, g, unknown, or other
  misc_feature (766)..(766): n is a, c, t, g, unknown, or other
ctccccgcggtggcggccgctctagaactagtggatcccccgggctgcaggaattcgtctcacccctagaaaaattcttgtgtgccaatcacctacgacgcctatcttccgccaactcctagccacgtgtccaccatgaacgacggctccctctctggcaaggtcatacgggctaatatacgccaagggctgcgcacaaatgcgaagaatatgactgcatccgtattgcgacagctgtgacctgactgctcctaaagcctcctggacaaaggcctggccatccaggccgatacattgagcctgatcacaacgaagggttcacctgtgggagcaccacttctgatactatctgccaagctcttcgacactcgtaggtcccactctttgagatactgactcccacctacgtacaatctagaagctgacgcacgccacatggcatatgaagttcctatcattgctcaggcaaatatggcggagtgtgaactgtctcacgcacatgcatactggaccccacatccaactttcacatgctatttaaactacagagctgggcattattgaggtagaaaattgatgtngctgacaggagcaacaacaattctaaggagtgaccttgtctacgattgcgggcaaagcttgaaccctgctgtcgacttgggccaggtggaaggcgcattcatccaaggagtaggcttctttacaaacgaggagtacacaacaaactctngaggggttggtcatccacgatggcacatggacgtanctgatccccacggacgacaccatcccaaagcagttgaacgttgagctgatcaacagcgcccgtgaccagaagcgtgtcctctcttccaaagcatccggcgaagcctcgctttctctagctgcctcgggcactgtcgcatgagggagccatccgagcccgcagtaagga

SEQ ID NO: 83162 - protein, 34 aa, Zea mays
  misc_feature: Ceres CLONE 1569021
MNDGSLSGKVIRANIRQGLRTNAKNMTASVLRQL

SEQ ID NO: 83163 - DNA, 901 bp, Zea mays
  misc_feature: Ceres CLONE 1569025
  misc_feature: Encodes the peptide sequence at SEQ ID NO. 83164
  misc_feature (763)..(763): n is a, c, t, g, unknown, or other
ctccccgcggtggcggccgctctagaactagtggatcccccgggctgcaggaattcgtctcacccctagaaaaagaaacgcgaagcagccccacactgcccacgcggacacgctctgcaccaccacctgccggccgttcccggctcgccgctgccgttgcgccctcgcgctcacacctccgccagcccaggtccatcgagcggagaaacccatggccccctcgccgatcctcgtccggccgccggcgctggcgaattcaccccttccgcctccccgatgcgtggccgcggtagcagcggcgccggcggttcggacggctccagcggccccattctctaggctccgtaccaagtgtaggttcgccgcatcggatgtgagagaagactactcttccactccgatagatattgtcgctgatgttaagacggagaagattgtggtgttaggaggaagtggattcgttggttctgcgatttgcagagctgctgtatccaaaggcattgaggttgtgagcttcagcaggtcaggaagaccatcttactctgatccctgggttgatcaagtcaattggctgccaggagatgttttctatgcaagatgggatgaagtattggttggggctactgctgttgtgtctacccttggagggtttggcaatgaagaacaatgaaaaggataaatggtgaggcaaatgtcatagcagtaaatgctgcaaaagaaaatggagtcccaaaattcattttaatctccgtccatgactacnaccttccatccccttcttctacatcgggttacttcactggcaagagaaggcagaaatctgagtcctttcaatacccagcctcgggtgtcgtggtgagccagcttcattacggtaaaagaagtaaatgcctcgaggtcc

SEQ ID NO: 83164 - protein, 152 aa, Zea mays
  misc_feature: Ceres CLONE 1569025
MAPSPILVRPPALANSPLPPPRCVAAVAAAPAVRTAPAAPFSRLRTKCRFAASDVREDYSSTPIDIVADVKTEKIVVLGGSGFVGSAICRAAVSKGIEVVSFSRSGRPSYSDPWVDQVNWLPGDVFYARWDEVLVGATAVVSTLGGFGNEEQ

SEQ ID NO: 83165 - DNA, 845 bp, Zea mays
  misc_feature: Ceres CLONE 1569026
  misc_feature (602)..(602): n is a, c, t, g, unknown, or other
ctccccgcggtggcggccgctctagaactagtggatcccccgggctgcaggaattcgtctcacccctagaaaaatccagcggctcaatcccagtcaatcatagagcagagcagcccgtgaccccgtgggcgtgtgctgcgactgcgaggagggaggagggaggaggaggaggaaaaagagtgccgccgtttcctgggggcagccagattccattccttgcgcaggagtactacggctactccttgtactatttcctagtagcaggctgccgtggaatcagctgcctcctgcctagagcaatgcgagattatcaacaccagcacagcctccctccctccctcggctgccttttcccactccttccagcgatcgatattcctccttccttccttccttccttcctcgtgaaggcgtcgagtgagtcctgcgttcttgctctcctctgctaagcacttgtcacaggaagaccccctcgtattcgcgtgctcttgccttcacacccgggacgggagttccttgctaggggagagagcttcccttgctcgtgtcctcactcactcactcattcaccgacggtcccagtggactgaggtgagacttcngtcggagccggccggactgaacatacaggatggccgccgcgccgccgtccaagggccgacaagctccagccgttcccgcccaaggaacagcttcccgggcgtcgccttctgcatcaccagcccccccgccatgggcggaggccatcttgctagggttccgccttttcgtcctcttgctgggcacccacggtcatcatacccagcgcgcttcgttcctcaaatggaaggcggaaaataaaaaga

SEQ ID NO: 83166 - DNA, 905 bp, Zea mays
  misc_feature: Ceres CLONE 1569029
  misc_feature: Encodes the peptide sequence at SEQ ID NO. 83167
ccgcggtggcggccgctctagaactagtggatcccccgggctgcaggaattcgtctcacccctagaaaaaattcccatcccattccccactctactcattcagcagatcccgtcactcgctctccacaagcagagcaccgcagcagaacgaggaaggatgctggccatcttccagaagcaggtggcgcacgcgccgcaggagctcaacagcccccgcgccggcgcgtcgcccagcaagccccggaaccccgacgagatcctgcgcgacttccacgccgcgcacccggccgccgccttctccgcctccttcggcggcggcgccgcgctcgcctgcgtcggcccctcctcctccgccaccgccaccggcaccgccacctaccagcggatgttctgcggcctggaccacatctactgcgtcttcctgggccgcctcgacaacctcagcggcctcatccgccagtacggcctgtgcggccgctccaccaacgaggcgatgctggtcatcgaggcctaccgcacgctgcgcgaccgcgggccctacccggtcgaccaggtcgtcaaggtactcgccggcgccttcgccttcgtcgtcttcgacaggcgctccggcgccgttcttcgcgccctcggcgccgccgtacccgggggagcgccggtgccgctgtactggggcgtccccggccgacgggtccgcggttgatcagcgaacaaccggaaccttgtcaagcgcgggctgggggaaaggccttaacggccctttccccccggggggttgttgtgtccaccggcgaacgagaagcgtcaaggaactttcaaagcaaccccatggaacaggggtccaagggccatgtccccccgcttctaaacgcgagatgagggcccctttgtggcgcgcggcccccctt

SEQ ID NO: 83167 - protein, 180 aa, Zea mays
  misc_feature: Ceres CLONE 1569029
MLAIFQKQVAHAPQELNSPRAGASPSKPRNPDEILRDFHAAHPAAAFSASFGGGAALACVGPSSSATATGTATYQRMFCGLDHIYCVFLGRLDNLSGLIRQYGLCGRSTNEAMLVIEAYRTLRDRGPYPVDQVVKVLAGAFAFVVFDRRSGAVLRALGAAVPGGAPVPLYWGVPGRRVRG

SEQ ID NO: 83168 - DNA, 995 bp, Zea mays
  misc_feature: Ceres CLONE 1569031
  misc_feature: Pfam Name: RNA_pol_Rpb2_1 Pfam Description: RNA polymerase beta subunit
  misc_feature: Pfam Name: RNA_pol_Rpb2_2 Pfam Description: RNA polymerase Rpb2, domain 2
  misc_feature: SWISSPROT Homolog: EC 2.7.7.6 DNA-directed RNA polymerase
tggagctccccgcggtggcggccgctctagaactagtggatcccccgggctgcaggaattcgtctcacccctagaaaaatttttggtttcgatgtgcaaaaggaaaccatttctattggaaacattcctataatgaattccttaggaacctttataataaatggaatataccgaattgtgatcaatcaaatattgctaagtcctggtatttactaccgctcggaattagaccataagggaatttctatatataccgggactataatatcagattggggaggaaggttggaattagcaattgataaaaaagaaaggatatgggctcgcgtgagtagaaaacaaaagatatctattttagttctattatcagctatgggtttgaatctaagagaaaccccccacataatgtttcctaccccgaaattttcttgtctttcctgaatgctaaggagaagaagaggatttgagtcaaaagaaaaagctattttggagtttttatcaacaatttgctttgtgtaggtgggggacctggtattttttcggagtcctttatgcgagggatttacaaaaaagaaatttttttcaacaaaaattggtgaatttaggaagaagttggtccaccaaattatgaatccggaaaacgtaatcttggatttcccctcagaaacaatacattccttggtttccccccaaaattgttttgggccccctacggaatcattttgatttgggaatgaaattttggaaacgggtattactttgacgaaggcccatttggatccccttggaaaaaaaaaacgtttttcgtttcggttgggaaattttgttaaaaaaataaatttgaaaagggtcttttgccgcttttaaaaattgggggtaaaaaaaaactcccgggagtattttttcgtgtagaagaacccgtccccaaattttgtgaacccccccttccccctccttttatttataatacctaagaacacctttttgagccaccc

SEQ ID NO: 83169 - DNA, 914 bp, Zea mays
  misc_feature: Ceres CLONE 1569033
  misc_feature: Encodes the peptide sequence at SEQ ID NO. 83170
  misc_feature (531)..(531): n is a, c, t, g, unknown, or other
  misc_feature (554)..(554): n is a, c, t, g, unknown, or other
tctccgcggtggcggccgctctagaactagtggatcccccgggctgcaggaattcgtctcacccctagaaaaaatcaccagcgtccgccaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaaaactctggatggacggaacatacgggttaatcatgctaacgagaggacaggtggcttccgcagcagcggtggttatggtggtggcngctatggtggtggtggttggtgnctatttttgcggttgctatgggtggcggctatggtggggggtaccggtggctttgtcgggcgcggcaatggggtacattggtggaggcagcggtggaaatggggggaaattcaggcaaaggggtgggtggggggcaattggcgtggtggtaataagggggtggccagtgggctccaaaagacataggtaggtatgagggttgacgtagggttggtgagaaaaaatgtgtggacaagagttgctttaagagaaaaccctgagggtcgacgggtgtgattatggtagtaatccatatagaagttacgtgtcgagttatacgtctgagaggggaagtgcggcgattgccattcgcggtcctgc

SEQ ID NO: 83170 - protein, 192 aa, Zea mays
  misc_feature: Ceres CLONE 1569033
  misc_feature (33)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (124)..(124): Xaa is any aa, unknown, or other
  misc_feature (131)..(131): Xaa is any aa, unknown, or other
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGXYGGGGWXLFLRLLWVAAMVGGTGGFVGRGNGVHWWRQRWKWGEIQAKGWVGGNWRGGNKGVASGLQKT

SEQ ID NO: 83171 - DNA, 1259 bp, Zea mays
  misc_feature: Ceres CLONE 1569034
  misc_feature: Encodes the peptide sequence at SEQ ID NO. 83172
  misc_feature (55)..(55): n is a, c, t, g, unknown, or other
  misc_feature (56)..(56): n is a, c, t, g, unknown, or other
  misc_feature (72)..(72): n is a, c, t, g, unknown, or other
  misc_feature (1259)..(1259): n is a, c, t, g, unknown, or other
cggtgggggctttcacctttataggggaccccacgtataatggttacaaacatannagccaacaacataaanaggggtccaccgcgggggcggccgctctagaatagtggatcccccgggctgcaggaattcgtctcacccctagaaaaattatttgctccgcgtcagctcccgttctccgccaaataaacccccgaaaagcaggagaggcgagaccctgaactggaaggctagggttagggtcccagctccccgttgcctgggcgagccgagtgatggccgccgctgccgcctccggcgcaactagtgccgccgcctcaccgtccccgctgatgcaactgccgtcgccgttcgccgagctcatcaagggcccctccggcctcgagaaggtcgtggctttgaggcgctcgcaactgctgtgccgagattttatcgtgatggagggccaataacatcagggaaagattgaaaatggggccccggtgggttttccctggccaacaaggctattgccaaacccccaaagagcttttccgtggtggtagtaacgagtggggcgttaccccaaatttggggatcacaatgggaacaatctggataccaaaaggggggatttcccctaagaaacccggggtttctggcacctaggttgagtaaacaatgtccggccctgacctttatccattcaaaaaccccctggcgtatattaaaacgcatgtgtggtctagaatatgggaatttgcggggaaggtccctgcgttttaaatgagggagattttttacaaggaaattattgtggccgccccaaaaggggctctgttgcaaatatttgtacccatatctcataaaaaggtatggagggccgtatggggagatgcctcttgctgcgggagagaaaatcgtgtagaactcctcctcgactttgcagaggcagtatgtcgcgggtataaccaattagttcgcgcctgggatcgtggttgaataccccctcttccttccttgataacatatattttcgccccatcgttttgcgggatgaggtcactacggcgggtgttgccgccacactagtaagttctctttggccggagtgtgcgggtagcgggctcgggggattcccctccgcgacatgtacgcgtggcgatagcctgtaataaggagtcgaaggaaagttttcgtctcctaagggcagtgggcagagccatgtttggtgtctgcaggtagtgtcactgtattgtaaaaggtctccaatcgcggtn

SEQ ID NO: 83172 - protein, 58 aa, Zea mays
  misc_feature: Ceres CLONE 1569034
MAAAAASGATSAAASPSPLMQLPSPFAELIKGPSGLEKVVALRRSQLLCRDFIVMEGQ

SEQ ID NO: 83173 - DNA, 899 bp, Zea mays
  misc_feature: Ceres CLONE 1569036
  misc_feature: Translation starting site: 382
  misc_feature: SWISSPROT Homolog: EC 1.1.1.219 Dihydrokaempferol 4-reductase
  misc_feature (600)..(600): n is a, c, t, g, unknown, or other
  misc_feature (699)..(699): n is a, c, t, g, unknown, or other
  misc_feature (828)..(828): n is a, c, t, g, unknown, or other
  misc_feature (829)..(829): n is a, c, t, g, unknown, or other
  misc_feature (847)..(847): n is a, c, t, g, unknown, or other
agctccccgcggtggcggccgctctagaactagtggatcccccgggctgcaggaattcgtctcacccctagaaaaaagctgctgccccttcgtcctcgcccctgcttgctggctggctggtctgctctgtcccgtccgtcctactcctacgagcagggaggccagcaggcagctagcacgcaacgactgcacgagctggttgacgagcgagcagggaggccagcaggcagctagcacgcaccgactgcacgagctgttttttctgacgagcaggttttattaatttggttgtgctgcatcgtgcgtgtgcaggagtcgacggtggagacggaggtgcgcgcggcgcacaacgtgctggaggcgtgcgcgcagacggacgccatggagcgggtcgtcttcacctcctccgtcaccgccgtcgtctggagcggcgccggcgccggcgtcggcgcccacagggaggaggtcgccgacgagaggagctggagcgacctcgccttctgcaggaagttcaagctgtggcacgccctggccaagacgctgtcggagaagacggcgtgggcgctggccatggacaggggcgtcgacatggtggccatncacgccggcctgctgctggccgcccccgggctcggggctcacgccgcgcacccctacctaaaggcgcccccgacatgtaccgacggcggcgtcctcgcntaccgtcgacgtcggcttcctgggcgacgcgcacgtcgcccgctacgagtcccccaccgcctacggccgctacctctgctttagcaacgccgtctgccgtcccgaggacccgtcaagctcgccagatgnntctggcgggcgggcaagntcgcgccgcaaggaagaactgatgtgttccaccgagggatcaggggcagacc

SEQ ID NO: 83174 - DNA, 926 bp, Zea mays
  misc_feature: Ceres CLONE 1569037
  misc_feature: Translation starting site: 128
  misc_feature (679)..(679): n is a, c, t, g, unknown, or other
  misc_feature (764)..(764): n is a, c, t, g, unknown, or other
  misc_feature (830)..(830): n is a, c, t, g, unknown, or other
ctggagctccccgcggtggcggccgctctagaactagtggatcccccgggctgcaggaattcgtctcacccctagaaaaaccccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgaacgggtcccaccgcttcatgatccagggctactcgctcgccaagggcatgggcgtcgggaagcacatcgccagcgacaccttcaccgtcggcggctaccagtgggcgatctacttctacccagacgggaagaaccccgaggacaactccggctacgtctcggtcttcatcgcgctcgcgtccgacggctaccgacgtgcgtgcgctcttcgagctcacgcttctagaccagagtggcaagggcaagcacaaggtgcactcgcactttgaccgctccctagagtccggaccgtacaccctcaagtaccgcggatccatgtggggctataaaaggttctttcggcgtaatgctcttgagcaatcagattttcttaaagatgattgcttgaagataactgtactgtggggtgttgtagtatncactatggattattccagccacattcaatagagggtccagagtctgacataggctatcatttttggactcttttgacactctggnaggtgtagatgtcatttttagtgtagcaggagagaagttcatgccccatagtggtatttgctgccngatcttcctttttagatctgaatttttcgacatgaatctgatgaagagagaacgaactggtccagggatggaatccagaaatcgtttttgatgatt

SEQ ID NO: 83175 - DNA, 870 bp, Zea mays
  misc_feature: Ceres CLONE 1569038
  misc_feature: Encodes the peptide sequence at SEQ ID NO. 83176
aagctggagctccccgcggtggcggccgctctagaactagtggatcccccgggctgcaggaattcgtctcacccctagaaaaaaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcgtcccgcccgcggaaccccgtcgccgacatcatccgctacaactccacggacgtggccttcgcgccgtacggcgagtactggcgcacggcgcggaaggtggtcaacacgcacctgctcagcgccaagatggtcttctccaaccggcgggagcgggaggaggaggtgcccctggttgttggcgcggaatccgcgacgctgccgagggcgtcccccggggacggcgcctcgacattaaggaacctgcctgggcgggctaaccccaagcgactttcttggtgccgcgcccgggccttcggggaagatcctccccggaaaaacagggccccggaaac

SEQ ID NO: 83176 - protein, 233 aa, Zea mays
  misc_feature: Ceres CLONE 1569038
  misc_feature: SWISSPROT Homolog: EC 1.14.13.68 4-hydroxyphenylacetaldehyde oxime monooxygenase
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNSTDVAFAPYGEYWRTARKVVNTHLLSAKMVFSNRREREEEVPLVVGAESATLPRASPGDGASTLRNLPGRANPKRLSWCRARAFGEDPPRKNRAPE

SEQ ID NO: 83177 - DNA, 855 bp, Zea mays
  misc_feature: Ceres CLONE 1569040
  misc_feature: Encodes the peptide sequence at SEQ ID NO. 83178
ggagctccccgcggtggcggccgctctagaactagtggatcccccgggctgcaggaattcgtctcacccctagaaaaaatcgcaccctatcctccccagtccccaccactccaccaccctctccccgcctcccgctgcgaccaccgcacccgcgaacttggcgggccgctcggcgctgcacaccaagccggggatggccgccgcgcttgcgagctcgccgcttgttcacctaactacctcccgcctccgcctccccaggccccaggcctccgcttccagttcgggtccagtctgctcgatcggcgtgtgcttgggatggaggctcaaggtcgggtggagagccctgaggcggcgcgaccggcttcgatgcttctccaccgacgggggcggcgggcacgagggggaaaagcgtggcgaggaggaggcatcggcaacggcggcggcatccccggcctcggttccagcggagacacaggtgggcgctggggaggagctgccgtccgagcggagtcggtcagggagcttttcttcctcgtcctcgtcgtccgggactcctggtgtatcaagtgagccaccgctgttgagttttagtgttgataatatcgatacagttaaactgttggaacttctaggcccagaaaaggttgatccagttgatgtcaaggcaatttaggaaaaactctttggttatacgacattctgggtgacaaaaaagaaacctttgggggaacttggggaaggagttcttttcattggggaacctccgcgggaaaagagaggaaacttttgcaaaacttcaaccgcaaggtacgtgaaccttcccggggaaagaataccaatctttttttggggggg

SEQ ID NO: 83178 - protein, 159 aa, Zea mays
  misc_feature: Ceres CLONE 1569040
MAAALASSPLVHLTTSRLRLPRPQASASSSGPVCSIGVCLGWRLKVGWRALRRRDRLRCFSTDGGGGHEGEKRGEEEASATAAASPASVPAETQVGAGEELPSERSRSGSFSSSSSSSGTPGVSSEPPLLSFSVDNIDTVKLLELLGPEKVDPVDVKAI

SEQ ID NO: 83179 - DNA, 960 bp, Zea mays
  misc_feature: Ceres CLONE 1569041
  misc_feature: Encodes the peptide sequence at SEQ ID NO. 83180
  misc_feature (744)..(744): n is a, c, t, g, unknown, or other
  misc_feature (769)..(769): n is a, c, t, g, unknown, or other
  misc_feature (802)..(802): n is a, c, t, g, unknown, or other
  misc_feature (856)..(856): n is a, c, t, g, unknown, or other
  misc_feature (862)..(862): n is a, c, t, g, unknown, or other
ctggagctccccgcggtggcggccgctctagaactagtggatcccccgggctgcaggaattcgtctcacccctagaaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctccccttgctaaagtcattcatgacaacttcggcattgttgagggtttgatgacaactgttcatgccatcactgccacccagaaaactgttgacggaccctcagcaaggnactggagaggtggcagggctgccanctttacatcatccctagcagcacggtgctgccnaggctgttgggaaaggtcttcctgatctgaatgcaagctcactggtatgtcctncgggtncctacgtgggatgtctcggtgttgacctcacgtcggatcgagaaggggcctcctttgagatatcagaagctttaagctgcttcgagggtcaccaagtg

SEQ ID NO: 83180 - protein, 223 aa, Zea mays
  misc_feature: Ceres CLONE 1569041
  misc_feature (4)..(154): Pfam Name: Gp_dh_N Pfam Description: Glyceraldehyde 3-phosphate dehydrogenase, NAD binding domain
  misc_feature (159)..(224): Pfam Name: Gp_dh_C Pfam Description: Glyceraldehyde 3-phosphate dehydrogenase, C-terminal domain
  misc_feature: SWISSPROT Homolog: EC 1.2.1.12 Glyceraldehyde-3-phosphate dehydrogenase (phosphorylating)
  misc_feature (197)..(197): Xaa is any aa, unknown, or other
  misc_feature (205)..(205): Xaa is any aa, unknown, or other
  misc_feature (216)..(216): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSARXWRGGRAAXFTSSLAARCCXGCWERSS

SEQ ID NO: 83181 - DNA, 925 bp, Zea mays
  misc_feature: Ceres CLONE 1569043
  misc_feature: Encodes the peptide sequence at SEQ ID NO. 83182
  misc_feature (759)..(759): n is a, c, t, g, unknown, or other
  misc_feature (768)..(768): n is a, c, t, g, unknown, or other
  misc_feature (802)..(802): n is a, c, t, g, unknown, or other
ctccccgcggtggcggccgctctagaactagtggatcccccgggctgcaggaattcgtctcacccctagaaaaaaggcaggcagtgtaggctccatcagatccaacgccaccagctagcagcagcagcagcagcatggccaccaccagcacgcctcgcctcgccaccctcctggtgctcctggcggcggcgtcaccgctgctgagcgcagctcaaaaggccgcccccaaggctccggcggcggcgaaggcggcgccagggccggcggcgtcgtcgtcgtccggcgcgggcgcggcggacgcggcccctcccacagacgtgaacaaggcgctcaaggacgaccagttcagcgagttcaagcagctgctgcacgacacgcgcgtggacacgcagatcaacgcgcagctgacggacagctacaacgggctgaccatcatggcgcccaccaacgccgccttcgacaagatgaaggccggcgtgctcaacgggctgtcgccgcaggaccagatccagctcgtcctctactgcgtgctgccccgcttctacagcctctccatgctcggcaccctcgacggcaaggtcaacacgcagggctccggccacgacgggccctacaggtacgacatcaagcggtcgggcaacaacgtcaacgtgtccacgggcgtcaactggatgctgctgggcagccccgtcagcaaggacttcccgctcgccatctaccccgtcgacaaggtgccgctcccctacgagctgttcgggnccaagccgnccaccccggcgcccgcgccggccccggcacccgnctagtccaagacatgatgaagaagaaggccgcggcatcgccgagccgccacggccgagacgaacactccgcttcgaacaacagaaggggggcgcgggccggcacgtccgcagctggacgccac

SEQ ID NO: 83182 - protein, 222 aa, Zea mays
  misc_feature: Ceres CLONE 1569043
  misc_feature (70)..(203): Pfam Name: Fasciclin Pfam Description: Fasciclin domain
  misc_feature (209)..(209): Xaa is any aa, unknown, or other
  misc_feature (212)..(212): Xaa is any aa, unknown, or other
MATTSTPRLATLLVLLAAASPLLSAAQKAAPKAPAAAKAAPGPAASSSSGAGAADAAPPTDVNKALKDDQFSEFKQLLHDTRVDTQINAQLTDSYNGLTIMAPTNAAFDKMKAGVLNGLSPQDQIQLVLYCVLPRFYSLSMLGTLDGKVNTQGSGHDGPYRYDIKRSGNNVNVSTGVNWMLLGSPVSKDFPLAIYPVDKVPLPYELFGXKPXTPAPAPAPAP

SEQ ID NO: 83183 - DNA, 831 bp, Zea mays
  misc_feature: Ceres CLONE 1569049
  misc_feature: Translation starting site: 217
  misc_feature (705)..(705): n is a, c, t, g, unknown, or other
  misc_feature (761)..(761): n is a, c, t, g, unknown, or other
ctccccgcggtggcggccgctctagaactagtggatcccccgggctgcaggaattcgtctcacccctagaaaaaagcaacgtgctcggtttcttcctccctcgaatcggctgcaccccgtgccgcgatacgaaaacccaccaaaccctaaccctagctgcagtgccactaccgcccgcttgcccggtctccggagaggaagccgacccaagcaaggatgccgtccgggtcagcgacgcaatttcggtacacgcagacgccgtccaaggtgctgcacctgcggaacatgccgtgggaatgcaccgaggaggagctcgtcgagctctgcaaacccttcggcagggtcgtaaacaccatgtgcaacgtcggcgccaaccgtaaccaggcattcgtcgagtttgcagatcaaaaccaggcaatttcaatggtgtcctattatgcttcatcttcagaacctgctcaagttcgcggtaaaactgtctatatccagtattcaaacaggcaagaaattaccaacaataaaggcactggggattcttctggcaatgtcctacttgtaacttttgaaggcgttcagcctaatgatgttaccatagaagtcattcatttggtattttcggcatttggatttgtcacaagatagctacttttgagaaagcagctgggttccaggcacttatccagtatactgatgcccccactgctnctgaagctaaaaactcattggatggaaagaagcatcccaaatatttacttccaagncatatcagtgcctggcacatgcgcataacctccctgcacataaggattgtgatatccaatttcagtcgcc

SEQ ID NO: 83184 - DNA, 856 bp, Zea mays
  misc_feature: Ceres CLONE 1569054
  misc_feature: Encodes the peptide sequence at SEQ ID NO. 83185
  misc_feature (573)..(573): n is a, c, t, g, unknown, or other
  misc_feature (618)..(618): n is a, c, t, g, unknown, or other
  misc_feature (683)..(683): n is a, c, t, g, unknown, or other
  misc_feature (763)..(763): n is a, c, t, g, unknown, or other
ctggagctcaccgcggtggcggccgctctagaactagtggatcccccgggctgcaggaattcgtctcaccccctagaaaaaacccctccggacgaaatctgacccgggccacactccgctgctccgccatggcgatccgctccaaggcctggatctcgctgttgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacgagatccaagggttcccaaccatcaggatcttcagggaccaggggaagaacattcaggaatacaagggccctagggaggctgatggcattgtcgattacttgaggaagcaggttggccctgcgtccnagggagatcagtcaccggaagatgcggtggccccttatcgatgancagaagatctacatttgtggtatcttcgcagaattcagcggcactgaatttccaaacttcatggnagtcgcagaaaagctgaggtctgactacgactttggccacactttgcatgccaaccaccctccacgtggtgatgcagcgntgggaaagcccattggtcaggctgctgaagccattttaatgagcttgttgttgacagcagggattttgattgccctgccctgatggagtttat

SEQ ID NO: 83185 - protein, 162 aa, Zea mays
  misc_feature: Ceres CLONE 1569054
  misc_feature (35)..(143): Pfam Name: Thioredoxin Pfam Description: Thioredoxin
  misc_feature: SWISSPROT Homolog: EC 5.3.4.1 Protein disulfide-isomerase
  misc_feature (149)..(149): Xaa is any aa, unknown, or other
MAIRSKAWISLLLALAVALSARAEEEPAAAAEGEAVLTLDVDSFDEAVAKHPFMVVEFYAPWCGHCKKLAPEYENAAKALSKHDPPIVLAKVDANEEKNRPLATKYEIQGFPTIRIFRDQGKNIQEYKGPREADGIVDYLRKQVGPASXGDQSPEDAVAPYR

SEQ ID NO: 83186 - DNA, 926 bp, Zea mays
  misc_feature: Ceres CLONE 1569059
  misc_feature: Encodes the peptide sequence at SEQ ID NO. 83187
  misc_feature (711)..(711): n is a, c, t, g, unknown, or other
  misc_feature (753)..(753): n is a, c, t, g, unknown, or other
  misc_feature (818)..(818): n is a, c, t, g, unknown, or other
  misc_feature (878)..(878): n is a, c, t, g, unknown, or other
  misc_feature (889)..(889): n is a, c, t, g, unknown, or other
ctccccgcggtggcggccgctctagaactagtggatcccccgggctgcaggaattcgtctcacccctagaaaaaactcacacgcccagcaccgcagcacgacaccatcgcgccctggccatcctcccgttcacgtgcacctaccgcacgcaccaccgcggaaagtaaccccgagatccagcgccatcggcacgaccaggcctgtccagggatggggcggagaggggagccctactacgtcgaagcggcgccgccggtggacgtgaacaagaacacagagtggttcatgtacccgggcgtctggaccacctacatcctcctgctcttcttcgcttggctcctcgtcctctccgtctctggttgctcccccggagcagcctggaccgtcgtaaacctcgcgcacttcgccatcacttaccacttcttccattggaagaaaggaaccccttttgctgctgatgaccaaggcatctacagcagattgacatggtgggagcaaattgacaatggtcagcagcttactcggaacagaaagtttttgactgtggtacctgtggtgctgtatctgatcgcatcgcacttgactgactacaagcagccgatgtttttcctcaatacaatggcagtttttgtgctagttgtggcaaaattgccaaacatgcacaagggtcgcatatttggaatcaatggagacatcctgagaccactgcangaagtacatggatgcaatgccatgatgtgatgaagagctaancagaaccagcagtgtggttctcaaactgacacaactgtctgtaatatatgtacaggtttaggaangactgtaaatggtactctaccatagagctttgccagcggaactgggcttggttgtgccgntgctgctttcnttttgagtccactggaggggaaaacgtactcggtaaa

SEQ ID NO: 83187 - protein, 176 aa, Zea mays
  misc_feature: Ceres CLONE 1569059
  misc_feature (18)..(161): Pfam Name: ORMDL Pfam Description: ORMDL family
  misc_feature (167)..(167): Xaa is any aa, unknown, or other
MGRRGEPYYVEAAPPVDVNKNTEWFMYPGVWTTYILLLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTMAVFVLVVAKLPNMHKGRIFGINGDILRPLXEVHGCNAMM

SEQ ID NO: 83188 - DNA, 884 bp, Zea mays
  misc_feature: Ceres CLONE 1569062
  misc_feature: Translation starting site: 494
ctccccgcggtggcggccgctctagaactagtggatcccccgggctgcaggaattcgtctcacccctagaaaaaacggacactaaccctagcgctcccgacgcgccgcggagcgatggcgatggacgcggagcgtgcggcacgcggagctgatcgggctcttctgcgctcaggcggcggcgctttcatgggctcccctgctcgccgcgctggtgcttgaggccaccttcctcccggacctcttggccttctccgagctgctcaccgtcccgtgccctctccagggtgagctggcacgcagtacgcgtcgtctctggacttgctccggctcgtcgcctacggtacccggaatgacgacgagagtagtggtggattcgttgcagcactgttggctgaccaggcccgagagctaaagcggctgatcgtggtaactctggcacagtcaactaacatgctaccgcatgagcagctcatgcaagatttagacgctgcacatgttagagaactccaacatcctcctcatcgatgagtgcatgtattcaggtatcgttagacgcaaactggatcagctgagaaggtgctttgatgtacaatttgcagctggaagagatcttacacctgatcagctaaagacatgagagagactctgtctgattggctgcgacatcccatagacgggtgcatcaaatccagagaaaatcaggtgggctgaacgacgtagcgacgtgaacagaagcacctgaaagattttgagaccgaccggatgaggcaaaagatcatcatgcagacttcgcttacgggggatgaccagtttctgcctgatcgggaggatatggattcgaaaaggaccgctcccacaaaaagaggggcaacccctggctaatt

SEQ ID NO: 83189 - DNA, 877 bp, Zea mays
  misc_feature: Ceres CLONE 1569063
  misc_feature: Encodes the peptide sequence at SEQ ID NO. 83190
  misc_feature (651)..(651): n is a, c, t, g, unknown, or other
  misc_feature (743)..(743): n is a, c, t, g, unknown, or other
tggagctccccgcggtggcggccgctctagaactagtggatcccccgggctgcaggaattcgtctcacccctagaaaaactcttcctcggcgacctccacgccggtctagagccggcagcgctgcggcggagcaccaaccgagctccgatcccaccccgctcccaaccgcgcagccctgtccatggcgcgcgcggtgcggcggcgagcccccatgcattcccgccgccggagcgcggcctgctaagcgacgaccattcctctccgcgcgcccacctccctctctccctctcctaaatccactcccccacgtgtcttcatgggccctccgtcctacaccgcctccccctgcacggggtctgccctcttctccaacacccgagcgccgccgccgccaccgcggcttcttatcagatggggcccggggccgccgtcggccgtggggaggcacggaggccgcgtagctccgtcgcaggagaggcgcggccccgccccgtcgcaggagaggcgccgacccgccccgtctcaggagaggcgccgacccgctccgtctcaggagaggcgccgcccctcggagtcttcgtcccagtctcaccagctccaggaaacgaagcggcactggaaggcgggggagttcccggggaccgctgccnatggaggaagtgggcgggcggaagccgccccgcactaggggaacgggcattcgaagggccggggaagtttccggggacggacggggggtcgngccgcccccgcgccgccggaaggggaagccgcactggaaagcccggcgagttttccgggcgccgcggccggcccccgggtcggggaacgcccgagcactccccctcaaggaacgtcaagaaagcgggctgggag

SEQ ID NO: 83190 - protein, 123 aa, Zea mays
  misc_feature: Ceres CLONE 1569063
  misc_feature (112)..(112): Xaa is any aa, unknown, or other
MGPPSYTASPCTGSALFSNTRAPPPPPRLLIRWGPGPPSAVGRHGGRVAPSQERRGPAPSQERRRPAPSQERRRPAPSQERRRPSESSSQSHQLQETKRHWKAGEFPGTAAXGGSGRAEAAPH

SEQ ID NO: 83191 - DNA, 946 bp, Zea mays
  misc_feature: Ceres CLONE 1569064
  misc_feature: Encodes the peptide sequence at SEQ ID NO. 83192
ctccccgcggtggcggccgctctagaactagtggatcccccgggctgcaggaattcgtctcacccctagaaaaactccgcctcccaagtcccacccccactccctcgctcaccagaggaactagcggaccaggcaaagccgagccgcaccgcaaccgcgaagatcttgcgtggcctccttttcccagctcgtcactgtgccgctcgtgccctacactcccggtccgcccaaccaataatccatccatccatccatccaccaccaccccgctgcggcgatgtgcggcggcgccatcctctcgggtttcatcccgccgtccggggtggcggcggcggcggcggcggccaagaagcagcagcagcagcagcagcggtgccgtgtgactgcggacctgctatggccggggcccggcagtaagggagctccccaggacaaggaggaggacttcgaggccgacttccgcgagttcgagcgcggcctcggcgaggatgacgtggacagcgccggcgaaggcggcgaccccgaggtccaggagcttcctccgccggagccgacgaggtttgccttcgccaccgcggccaaggcggcagttgatggcgtgatgactcctcctccaaaggatgtccaaggagatagagcagtaaaaaagcgcggccggaagaaccagtacaggggaatcaggcagcggccttggggcaaatgggcagctgagatcagggaccctaaacagggcgtccgcgtctggctcgaaaccctacacccgccgaaggagcagctagggcatacgacgccgaagctcgcatgatcggcggcaagaaaacgaaaggtgatttttcccgatgacgcgacaggcactcgtccagggcaacgaccgatgagatcttttaccccctgtaagacgacgaccacacaccaccttgatctgtttgcgaagtttgcgtccggg

SEQ ID NO: 83192 - protein, 175 aa, Zea mays
  misc_feature: Ceres CLONE 1569064
MCGGAILSGFIPPSGVAAAAAAAKKQQQQQQRCRVTADLLWPGPGSKGAPQDKEEDFEADFREFERGLGEDDVDSAGEGGDPEVQELPPPEPTRFAFATAAKAAVDGVMTPPPKDVQGDRAVKKRGRKNQYRGIRQRPWGKWAAEIRDPKQGVRVWLETLHPPKEQLGHTTPKLA

SEQ ID NO: 83193 - DNA, 858 bp, Zea mays
  misc_feature: Ceres CLONE 1569065
  misc_feature: Encodes the peptide sequence at SEQ ID NO. 83194
  misc_feature (418)..(418): n is a, c, t, g, unknown, or other
  misc_feature (525)..(525): n is a, c, t, g, unknown, or other
  misc_feature (603)..(603): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
ctggagctccccgcggtggcggccgctctagaactagtggatcccccgggctgcaggaattcgtctcacccctagaaaaagtgtgctatacgacctgccaagtggcaagagcgccaacgccgtctccttgccatggccatcctgaacagagctgacactagtcacactaccaccgcatccaacggcagcgccaccccggctgcccccgttgccattgccatgccttcgcttcctcacccgccactggacgccgacgagttccgcaggcagggacgcctagtcgtggacttcatcgcggactactacgcgcgcatcgacgggtacccggtgcgcccggccgtcgcacctggggttcctgatccggcagcttcccgaggcagcgccggcgcggccggagcccgacgcgctcgccgcgggncctgcgcgacgtgcgcgacctcatccctgcccggcgtcacgcactggcagagccctgcgccactttcgcgcacttcgcggcacgggccagccaacgtgggcgccctncggcgaggccctcgccgcgggggctttaacgtgaaacccctttcacgtggggcccgcattcgccggcggcacccaagnctatagaagtcgttcctcccagacttggctcggcaagggggctgcatcttcctggaagagcctgctgttctccgcgaaagcgcccggggcacccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 83194 - protein, 158 aa, Zea mays
  misc_feature: Ceres CLONE 1569065
  misc_feature: SWISSPROT Homolog: EC 4.1.1.25 Tyrosine decarboxylase
  misc_feature (96)..(96): Xaa is any aa, unknown, or other
  misc_feature (157)..(157): Xaa is any aa, unknown, or other
MAILNRADTSHTTTASNGSATPAAPVAIAMPSLPHPPLDADEFRRQGRLVVDFIADYYARIDGYPVRPAVAPGVPDPAASRGSAGAAGARRARRGXCATCATSSLPGVTHWQSPAPLSRTSRHGPANVGALRRGPRRGGFNVKPLSRGARIRRRHPXL

SEQ ID NO: 83195 - DNA, 912 bp, Zea mays
  misc_feature: Ceres CLONE 1569066
  misc_feature: Translation starting site: 201
  misc_feature (770)..(770): n is a, c, t, g, unknown, or other
  misc_feature (912)..(912): n is a, c, t, g, unknown, or other
ctccccgcggtggcggccgctctagaactagtggatcccccgggctgcaggaattcgtctcacccctagaaaaaaacgagcgcggtctcatcgtctcatctctggtgcgaacctccccgtcccaagagcgctcttttttccttcggcttcgcgctccaagcatcgcctaccccaagtcccaacctaattctctccaaccgatgctatcctggtctgtcgacggcaggagaacggcacgaagccggagttcgggctggccccgcagggggtcgagcaggcgcgcgcggccggcgaaaagttccggaaggtaccggatcgttgccccactgctgtggattctatgtgcggtagtgaatctggcccgtgtatttttcgttttgcgtgtgcaggagcttgacgagattggtgtgccggtgggttccgtcaagattcgttactcgccgttctcacggaccaccgagacggctagagtggtcgccggtgtgctcggcatcccctttgaagctcctagttgcgaagcggtgctgggacttcgtgagcgctactttgggccatcatatgagttactttcacatgataagacatatggtcagtagatgaagcacatccctgtatggctcctgaaggtggcgagagcgtcgcagatgttgctagtagattttcagctgtgctgttatctgcagagacacagtttcatggctctgcaattcttattgtcagccatggggacccactacaaatctttcaagctgtcctcagtggagcaaggnagaacatgtctttccttgacgatctcaccaactgaaggtgaagatactgacgatctcaccaacctggaagtgaaagaacgatggtgggcatcattctgtcacagcatcgtaagtttgcgctcatcacggagagctgcgccan

SEQ ID NO: 83196 - DNA, 913 bp, Zea mays
  misc_feature: Ceres CLONE 1569068
  misc_feature: Encodes the peptide sequence at SEQ ID NO. 83197
  misc_feature (778)..(778): n is a, c, t, g, unknown, or other
  misc_feature (832)..(832): n is a, c, t, g, unknown, or other
ctccccgcggtggcggccgctctagaactagtggatcccccgggctgcaggaattcgtctcacccctagaaaaagtttgcatctccatccacctgtcctcgcgtctcccttcccagatccatcgactcgctcgggccgcccctcccgtcgtccccgttcgaaggtgcggcagccggcaggcgagcgatttgattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgcttcaggacaatcactagcagctactaccgcggagctcatggaatcattattgtatatgacgtgacagaccaagaaagcttcaataatgtgaagcaatggttgaacgagatagaccgttatgcaagtgataatgttaacaagctccttgttgggaacaagagtgaccttactgccaacaaagttgtggcaactgagacagcaaaggcgtttgctgatgagatgggcatcccattcatggagacgagtgccaaaaacgccatcaacgtggagcaggccttcatggctatggctgcatccatcaaggataggatggccagccaaccagccgcggccaacgctaggccagcgaccgtgcagatccgcggggcacccngtcaccagaagacgtcttgctgctcgtcctagattgcctcatttctttggtccntgtgactatttctacggttgtgcgcgcacgcaatgtatttgcattatcctgatagctctattcgttggcagatgatagaga

SEQ ID NO: 83197 - protein, 203 aa, Zea mays
  misc_feature: Ceres CLONE 1569068
  misc_feature (10)..(171): Pfam Name: Ras Pfam Description: Ras family
  misc_feature (10)..(124): Pfam Name: Miro Pfam Description: Miro-like protein
  misc_feature: SWISSPROT Homolog: EC 2.7.11.1 Non-specific serine/threonine protein kinase
  misc_feature (194)..(194): Xaa is any aa, unknown, or other
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNAINVEQAFMAMAASIKDRMASQPAAANARPATVQIRGAPXHQKTSCCSS

SEQ ID NO: 83198 - DNA, 806 bp, Zea mays
  misc_feature: Ceres CLONE 1569070
  misc_feature: Encodes the peptide sequence at SEQ ID NO. 83199
  misc_feature (722)..(722): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (804)..(804): n is a, c, t, g, unknown, or other
ctccccgcggtggcggccgctctagaactagtggatcccccgggctgcaggaattcgtctcacccctagaaaaagcaacctcccactgcattctcgaattccgattcccaatccagcaaaccctaccagccttttgcaaactcagagagggacccgatggcacccaaggcggagaagaagccggcggcgaagaagcccgcagaggaggagcccgcggccccggcggagaaggctcccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgttacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatggaatggttgtcatctgaaaagtgatctgagcagtgcaatatataattctggcatactnatctcgcaaannnnnnnnnnnnnnnnnnnnnnnnnnnnnnnnnnnnnnnnnnnnnnnnnnnnnnnnnnnnnnnnaaaaaaantt

SEQ ID NO: 83199 - protein, 152 aa, Zea mays
  misc_feature: Ceres CLONE 1569070
  misc_feature (59)..(129): Pfam Name: Histone Pfam Description: Core histone H2A/H2B/H3/H4
MAPKAEKKPAAKKPAEEEPAAPAEKAPAGKKPKAEKRLPAGKSAGKEGGVDKKGRKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 83200 - DNA, 971 bp, Zea mays
  misc_feature: Ceres CLONE 1569072
  misc_feature: Encodes the peptide sequence at SEQ ID NO. 83201
  misc_feature (347)..(347): n is a, c, t, g, unknown, or other
  misc_feature (441)..(441): n is a, c, t, g, unknown, or other
ggagctccccgcggtggcggccgctctagaactagtggatcccccgggctgcaggaattcgtctcacccctagaaaaagctcctctccttcctctctcttctccagcgccttccccctgctccctcttatcgtctccgcgctctaaaatggcctcacactccgccacacagtaaacaaaacgacgggcccactccccgacggctgacgccctcccacggccccttccatgaggcagctgcacctctcgccgcagctctccccctccccggtcctctcctcttacttctcgccgccgccggcggaggcctcgtcctggcggcggcggctgcaccggggacggtgcttncaacgccgctctcctcgctgcgggatcccaacaaggccacgctccgcaaggcctcgtccaacgtccccttcgcctcggcgggtggccgggagcngcatccccaatggaccgccgccccgccgaacaacgacaaggctgatgaaggaggcctaagggccaaggcccggcccaaggggcacctcaccggggaacccctggtcccaaggaaccccctacccgggtgggtttcccaaaggggggggttttgggggcggcccggatataactggttcaaaagaaccaaaaaataaaaaacctttccccaaagacaattttcccaaggggtttcttttgtacgaggctattggggccccaccccggaaaatgccccccggtttcccaccttgggttaatgccggggattgtggaagggttcccccccattttcccccccaaaaaccttttaaaacagtggcaccgcggggcatattttttttgggggggagggggaccgcgggcaaaatatttttgttccaacaacgggggaaaacaatgtggcgggggggggggggcgcgcccttttatccgaaaaaaaccccccccagaaataaaaattcttttaatggggggagaagaaaaaaaaaa

SEQ ID NO: 83201 - protein, 90 aa, Zea mays
  misc_feature: Ceres CLONE 1569072
  misc_feature (40)..(40): Xaa is any aa, unknown, or other
  misc_feature (72)..(72): Xaa is any aa, unknown, or other
MRQLHLSPQLSPSPVLSSYFSPPPAEASSWRRRLHRGRCXQRRSPRCGIPTRPRSARPRPTSPSPRRVAGSXIPNGPPPRRTTTRLMKEA

SEQ ID NO: 83202 - DNA, 929 bp, Zea mays
  misc_feature: Ceres CLONE 1569074
  misc_feature: Encodes the peptide sequence at SEQ ID NO. 83203
  misc_feature (695)..(695): n is a, c, t, g, unknown, or other
  misc_feature (761)..(761): n is a, c, t, g, unknown, or other
cggccgctctagaactagtggatcccccgggctgcaggaattcgtctcacccctagaaaaaggggcgctctcctcctcctcctcctccgtctctcccctctccactctcccccctatccgtctctctctgtcctttctggatcgacggctgggcgccgccgcccttcgtcaggtcttcgccggcggcgattacacaccaggttgagcaaatattcttccaccaatggcgagagaaccgagtcctgaaatagatgatgaacttttcaatgaagtttatgggaaagcatacagcggcccagttgcatcagctacaaatagtgtgactcctaaaggaaatgctgagaagaggcccctgactcgtgataagtcagatgatgaagatgaggccccagatcctaatgctgttcccacggacttcactagccgagaggctaaggtctgggaggctaaagctaaggctacagaaaggaactggaagaagaggaaggaggaagaaatgatttgtaaaatatgtggagacccaggccattttactcagggttgcccctccacacttggggcaaataagagaaatgcagacttttttgaaagagttccagcaagagataagcaagtcagagatcttttcaatgagagggtaataagccagattgagaaagatgtggggtgtaaaatcagaatggatgagaagtccntgtttgtcagtggaaaggatagattatattatccaaaggtgtttctgctgtgcataaattattcangaagggtaggggtaacatagtccaagcagtccgatcacgatcgctctaggtcgctgtacaaacactactgagtttcgttcaaaactctgattctctcgctcactagcccagaaattttgattctcatggtcccatatccagaatgcatcactccccaaagtaaggatc

SEQ ID NO: 83203 - protein, 185 aa, Zea mays
  misc_feature: Ceres CLONE 1569074
  misc_feature (158)..(158): Xaa is any aa, unknown, or other
  misc_feature (180)..(180): Xaa is any aa, unknown, or other
MAREPSPEIDDELFNEVYGKAYSGPVASATNSVTPKGNAEKRPLTRDKSDDEDEAPDPNAVPTDFTSREAKVWEAKAKATERNWKKRKEEEMICKICGDPGHFTQGCPSTLGANKRNADFFERVPARDKQVRDLFNERVISQIEKDVGCKIRMDEKSXFVSGKDRLYYPKVFLLCINYSXRVGVT

SEQ ID NO: 83204 - DNA, 921 bp, Zea mays
  misc_feature: Ceres CLONE 1569076
  misc_feature: Encodes the peptide sequence at SEQ ID NO. 83205
  misc_feature (708)..(708): n is a, c, t, g, unknown, or other
  misc_feature (832)..(832): n is a, c, t, g, unknown, or other
  misc_feature (859)..(859): n is a, c, t, g, unknown, or other
  misc_feature (860)..(860): n is a, c, t, g, unknown, or other
ctctccgcggtggcggccgctctagaactagtggatcccccgggctgcaggaattcgtctcacccctagaaaaaggcgcgcggcacctcaagctcctgcttttccattgctctgcgtctgcgtctgcgtctgcgtctgcactgcttcgcgtctccctccccccgcctccgcccccgccccggcaaaaaagcaaaacacggccatggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccaagagcaacgccgtcgtcgggctcaagctcaacgacggagggcccggcctcatcggctccgggaagctggccttcggcggcgccggaggcggcggcaccaaggccgatcgctacaacaacaacaacaacctccccaacaccgacaacaagaccgtgtacaacagcagcagcagcttcatgggcaacggcagcagctacgccaagaacaacaacaacaacgccggcatgctggcgttcgacaagatggggagctacggctacaacagcaacaacggcggcggtaataccaacaacaacagcaacggcgtgggaggtgaagagctacttttcacagtccngcggggagggcggcgtagcacatacacaacaatctacactgcctcgcctggcggcggcaacaagaatggcgggcgccggggagtacggcagggagaacacgccaagatcgagggcgcggctgcnggcaccgacaagcagcggttcagaacnnctgccggcgtcggaggcgctgccccgggggcaggccatcggcgggttacatctcgtctgca

SEQ ID NO: 83205 - protein, 239 aa, Zea mays
  misc_feature: Ceres CLONE 1569076
  misc_feature (169)..(169): Xaa is any aa, unknown, or other
  misc_feature (220)..(220): Xaa is any aa, unknown, or other
MEGYDREFYQFSDQLRLQTAAFSGLSLGDSIWSPAGRRNNSNDVLFAASASPADAAKSNAVVGLKLNDGGPGLIGSGKLAFGGAGGGGTKADRYNNNNNLPNTDNKTVYNSSSSFMGNGSSYAKNNNNNAGMLAFDKMGSYGYNSNNGGGNTNNNSNGVGGEELLFTVXRGGRRSTYTTIYTASPGGGNKNGGRRGVRQGEHAKIEGAAAGTDKQRFRTXAGVGGAAPGAGHRRVTSRL

SEQ ID NO: 83206 - DNA, 867 bp, Zea mays
  misc_feature: Ceres CLONE 1569079
  misc_feature: Translation starting site: 197
ctccccgcggtggcggccgctctagaactagtggatcccccgggctgcaggaattcgtctcacccctagaaaaattcccgttccccaattcgaaatcgagtcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacggccccactgtgcagcttgaggccaccacgcagttcaggaagctgctctccatagagcgtagtcccccaattgaagaggtgatcagcacaggagtcgtgccccgattcattgagttccttacacgtgaggaccatccacaactccagtttgaggctgcatgggcgctcaccaacattgcatcaggcacatcagagaacactaaggtggtgggttgagagtggtgctgtgccccatcttgttaagctccctcactcccatagcgaggatgttcgtgaacaggctgtatgggctttaggtaaatgtgctggtgactccccaaagtgccgtgatctggtgcttagccatggtgggctattccccttgctggcacagcttaatgagcatgctaagctctcgatgctgagggatgcacatg

SEQ ID NO: 83207 - DNA, 821 bp, Zea mays
  misc_feature: Ceres CLONE 1569082
  misc_feature: Encodes the peptide sequence at SEQ ID NO. 83208
  misc_feature (492)..(492): n is a, c, t, g, unknown, or other
ggagctccccgcggtggcggccgctctagaactagtggatcccccgggctgcaggaattcgtctcacccctagaaaaaactccccactaccagctgctccctccctccttcccttccctcctacctctctctctctcttcctccgttcgtctcttgactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagaccctgatcaggaagctcaccaggggcggcaagcacgcggagctgtggtcgcagcccaatggcngcggcaaccagggcccacagggcaataaatggccagcagcagaaacagcagcagcccgcagaaccagacccagaaaccccccggccaaaggccaaaagcaaggggcccattcctcagcaaggaatggggcccaaacaaaaaaaccccaaccgcggggccccaaaaaggacccggggggaaaacccgggggggggaaaaaagaaagttgggggggggggtttggggggggggggcccccttttatgggggggggggcccccccagggggggggttttgttaaaaaaaaaaaaaaccaccggggggggaagaaaaataatcccaccctccc

SEQ ID NO: 83208 - protein, 175 aa, Zea mays
  misc_feature: Ceres CLONE 1569082
  misc_feature (16)..(76): Pfam Name: HMA Pfam Description: Heavy-metal-associated domain
  misc_feature (83)..(83): Xaa is any aa, unknown, or other
MTKDEEFKLVKIQNHALKVNIHCDGCKHKVKKLLQKIEGVYSVAIDVDNHKVSVTGDVDSETLIRKLTRGGKHAELWSQPNGXGNQGPQGNKWPAAETAAARRTRPRNPPAKGQKQGAHSSARNGAQTKKPQPRGPKKDPGGKPGGGKKESWGGGFGGGGPPFMGGGAPPGGGFC

SEQ ID NO: 83209 - DNA, 822 bp, Zea mays
  misc_feature: Ceres CLONE 1569083
  misc_feature: SWISSPROT Homolog: EC 2.7.11.1 Non-specific serine/threonine protein kinase
  misc_feature (582)..(582): n is a, c, t, g, unknown, or other
  misc_feature (594)..(594): n is a, c, t, g, unknown, or other
ctccccgcggtggcggccgctctagaactagtggatcccccgggctgcaggaattcgtctcacccctagaaaaaaccaaaggccacagcgaagacgacgacgtcgccgccacacagtcctgcgtcgcgaacgggcgcaggacgacctgcctctacagaagcagcgctgcaccggcgaacaagcatagggccgcatatccccggattccccgcgaagctagagctcgggaacgtacagaactggcctcctgccggaacaggcccgtccaagtcgttgttggagacgttgaagtaggagagaaagtggaggctctccagcgccctggggatctcgcccgtcaggcggttgctggacaggtccagcacctccaggttcgtgaggttgccgacggcctgcggaacctccccgcgcaggctgttgaagctcaggttgagctgcgtgagtcccttcaggcggccgatctccggcggcaccgcgccggtgagcccgttgtcgccgaggttcagcagcttggggcagtagttcgccctgtggtactggagcgacgcggccatgtagacgggcagcggggacgcggcctgnctcgaagacccnaccgtcgtcgtcgtcatcgtccacggtcttctcggacttcagcatcgggtagatccgccagcgcccgtcgggatctcccccaccagggctgttggttggacacgtcccgaacgaacaaggaggctcagggcgcctgacccagggccggggatccggccccccttaacccgtttgctggacaagaaaccacttctcccaggttttttcagcccttaaaccccagggaag

SEQ ID NO: 83210 - DNA, 948 bp, Zea mays
  misc_feature: Ceres CLONE 1569084
  misc_feature: Encodes the peptide sequence at SEQ ID NO. 83211
  misc_feature (448)..(448): n is a, c, t, g, unknown, or other
  misc_feature (459)..(459): n is a, c, t, g, unknown, or other
  misc_feature (498)..(498): n is a, c, t, g, unknown, or other
  misc_feature (503)..(503): n is a, c, t, g, unknown, or other
  misc_feature (594)..(594): n is a, c, t, g, unknown, or other
  misc_feature (608)..(608): n is a, c, t, g, unknown, or other
  misc_feature (613)..(613): n is a, c, t, g, unknown, or other
  misc_feature (644)..(644): n is a, c, t, g, unknown, or other
ggagctccccgcggtggcggccgctctagaactagtggatcccccgggctgcaggaattcgtctcacccctagaaaaaaccttccaccctcccccactttctcctcctcaccgagtcacaaagccaaaccctaattcacggccgccggagatgggacaaggttctcccggcgggatgggcaagcagcccggccttccgggcgaccgcaagcagggagacggcaagaaagagaagaaatatgaaccacccgctgccccttcccgtgtcggccggaagcagaagcggcagaagggctccgaggcggcggcgcggctccccgccgtggcgccgctctcaaagtgccgccttcgcctactcaagctcgaacgcgtcaaggactaccttctcatggaaagaagagttcgttgccagccaggagcgcctgcgccccagcgaggataagacggangaggaccgatnccaggtcgacgacctccgcggcactcccatgaaacgtcngatcngctggaggagatcatcgacgagacccatgccatcgtctccctcgtccgtccggtcccgagtactacgtcgggatactttcccttcgttgantaagacaagctcgnagccntggatgtgccattctgatgcacaacagggtnctgtcagtgggttggtattttggcagacgaagttgatccctatgggttcctgtgatgaaagttgaaaagggcacctttggagtcttatgcctgacattggtgggctgggatgctccaattcagaaattcaagaagcagttgaactccccctaaacatcctgagctatatgaggacattgggatcaggcccccgaaaggagttttctatatgggggaccctgaacagggaaaatctactcgcaaagctggtgccatttttcttcagcaacgttttgcttgttgttgggaggtaatgatccaaagc

SEQ ID NO: 83211 - protein, 96 aa, Zea mays
  misc_feature: Ceres CLONE 1569084
MGQGSPGGMGKQPGLPGDRKQGDGKKEKKYEPPAAPSRVGRKQKRQKGSEAAARLPAVAPLSKCRLRLLKLERVKDYLLMERRVRCQPGAPAPQRG

SEQ ID NO: 83212 - DNA, 1026 bp, Zea mays
  misc_feature: Ceres CLONE 1569086
  misc_feature: Encodes the peptide sequence at SEQ ID NO. 83213
  misc_feature (182)..(182): n is a, c, t, g, unknown, or other
  misc_feature (219)..(219): n is a, c, t, g, unknown, or other
  misc_feature (563)..(563): n is a, c, t, g, unknown, or other
  misc_feature (564)..(564): n is a, c, t, g, unknown, or other
  misc_feature (770)..(770): n is a, c, t, g, unknown, or other
  misc_feature (833)..(833): n is a, c, t, g, unknown, or other
  misc_feature (878)..(878): n is a, c, t, g, unknown, or other
  misc_feature (883)..(883): n is a, c, t, g, unknown, or other
  misc_feature (884)..(884): n is a, c, t, g, unknown, or other
  misc_feature (886)..(886): n is a, c, t, g, unknown, or other
  misc_feature (891)..(891): n is a, c, t, g, unknown, or other
  misc_feature (964)..(964): n is a, c, t, g, unknown, or other
  misc_feature (980)..(980): n is a, c, t, g, unknown, or other
ggagctccccgcggtggcggccgctctagaactagtggatcccccgggctgcaggaattcgtctcacccctagaaaaaagggtttcgtcgcttccagccgccgccgcgtccgcctcgccaagcgcagcagccgccgcagcacatcgctctcttgatctcagccatggcggatgtggagcagncacaggacacgccgaagctctttcaccgctggacctncgatgatgtccaggtgaacgacttctccctgaacaaatacctcgcgtggacccgaccaaacccccattttcccgcccccaccccgggggggccctcccaaaaaagggttcccaaagagccgtggcccctattttgaaccccctaaaaaaccccccttttggggggggggcccaaccccgaaaaaatgggggggggcccccccctttaaaaaccccccggggaataatttttcgggcgcgggggaagccccaccccctgggggggtggggaaacaaaataaaaaaggggcgcccggcgggagaacccccccctttttttttttttcttttttttaaaaaacaacnntttttctcctcccccccgggggggagggggccaccccccccccccccccccccccgggggggggggggggggtgcttttgaaaaaaaaaaaaaacaacccgcgggggtgggaagaaaaaaacaaataacacccccccccccccccccccccccccccccaacaacaaaagaaaaaaatgtggggggggggcgcccgcccgagcggnggggagagccgcccccccccgcccagaaaataaaaaaaaaaagttgcgcgccccccccccgcncaccccttgctttaataataaataagttgtgggcgcggggtgcgnccccnncnaaacntttagaaggagagaagagaggagggcgcgcccccccccccccctccctcctctctttcttttttttgttgggngggggggggggggggnaaagaaaaaaaaaaaagaaacaaaaaccccgcaacgcgcgcccccg

SEQ ID NO: 83213 - protein, 63 aa, Zea mays
  misc_feature: Ceres CLONE 1569086
  misc_feature (7)..(7): Xaa is any aa, unknown, or other
  misc_feature (19)..(19): Xaa is any aa, unknown, or other
MADVEQXQDTPKLFHRWTXDDVQVNDFSLNKYLAWTRPNPHFPAPTPGGPSQKRVPKEPWPLF

SEQ ID NO: 83214 - DNA, 1269 bp, Zea mays
  misc_feature: Ceres CLONE 1569090
  misc_feature (1153)..(1153): n is a, c, t, g, unknown, or other
  misc_feature (1198)..(1198): n is a, c, t, g, unknown, or other
  misc_feature (1199)..(1199): n is a, c, t, g, unknown, or other
  misc_feature (1269)..(1269): n is a, c, t, g, unknown, or other
cccctgtccttcgctttttgtgactcttttatttcatttttttatttttgtttgtaattaattttctttatttttcacctcaccgggggggcggccgctctagaatatgtggatcccccgggctgcaggaattcgtctcacccctagaaaaaacaacgtgctcggtttcttcctccctcgaatcggctgctccccgtgccgcgatacgaaaacccaccaaaccctaaccctagctgcagtgccactacctccccgcttgcccggcctccggataggaagccgacccaagcatggatgccgcccgggttagcgacgcaatttctgtaaacccaaaccccttgtatggcgctgcacctgctgacaacgccgttggaatgttccgaggaggagcccttcaacctctgttgagcctcccgcagggtcgtaaaccccacccgcaacgttcggcggcaaccggttactgggcatttgtgcgccccccacacattgttaaccaggcaacttgcatgggggtcggaattacgacgccaatcatgtgtaacggggttgcggggggggtggtagaaaactggcttgttcccctgttattccgaacctgacaatgaaatttcccgaccattccttagggccccgggggaatccgttcttcgccaaatgttcgtacactgtgtatcttctctgacacgggctgttcccccccctcacggagggcttgcccctcctgtaaagcccacccccgcttttggtcatctttctccaggcctgtttgtgggaccacccttatcacccggcgaagtggccgcttggctggctcgtgaaacaacacactcaccgtggagcgtctcccacttgggcaccagtagtttactccacccatattctatgtatcgggtactatgcaaaatgtgctctccctttgagaaaagctcgaattaagagtctctagagtcggagaaaggcgcccacaaacggagtccgcgctacatcgtaagtgttggtgcaccgcgcccccataatcagaactgctcgcgttgtgtagatagccactccctgtccaactggttctagcgtgcctccccgttggcccccgattgagtcgcgtattaaagatgagttatgaagattgatcacgtgggcgtcttcttttgactcntacgttgtggttcactcgcagtgtgatcgtcgcctcgtctcttgnnaattttaagatacagctcgtggttacggggtgtgttgtagagggtgtctgcgcactcgcgcagtacgcgn

SEQ ID NO: 83215 - DNA, 1024 bp, Zea mays
  misc_feature: Ceres CLONE 1569091
  misc_feature: Encodes the peptide sequence at SEQ ID NO. 83216
  misc_feature (853)..(853): n is a, c, t, g, unknown, or other
acccgcggtggcggccgctctagaactagtggatcccccgggctgcaggaattcgtctcacccctagaaaaaatgctttcctcctttataacccctgccgcgctagctgtctctccaccgcatcgaccggacggtctctctctcgtctctcccgacgcgcctccacggccggccccgccccggctcgctagcctcctcccactcccagtaccagcccccgcccctccagcaccaccagcagctcgccttcagaccatgagacgggtcggaggagacctgcagggcgacagcacaactcctcgggccgcggcggcggggcacgccatgatggagcttcatgccaaccgatcggccgtcgtcgggggcgccatggtggtggggcttaacccgcccccccaggccctgtggcgggacagcaaggcgcttccgccggggggccggcccccgccgcggctcatcaggcgacgtgtccgcccaggctcacggtggaaaggacctgctgcgtcaaccgtggccactgggggccccgggaaagtacgcaaaacccgtggatgggacgaatcttcacctgggtaaaccccgggaaccccggggttccactaaaaccgtcgcctcaatggggggcccctccgggaggtccccgggccaagagtcccacccactgggtttatgagaagtgtgttggagatggggagggggtttgtcgttctgacctaaaacgaccctttccctgtctcacgagggtaaaatgatgggctgcgctacacaaggagcgccccgtaggggcctaaagattctcttccttgttgggcgccgcgccaatccttaactgttggtcccctatgggctaaancaccccttgaatccgggaatctcataaaagacgaggcgcataaaaacgaactgggagtatactattgtgccctgtcatttggactgctcccagaacaaataatctcgtggtggtgggaccaagagagccctcatgtgtgtgagtggccccccgtgtgtgagatagtggagg

SEQ ID NO: 83216 - protein, 106 aa, Zea mays
  misc_feature: Ceres CLONE 1569091
MRRVGGDLQGDSTTPRAAAAGHAMMELHANRSAVVGGAMVVGLNPPPQALWRDSKALPPGGRPPPRLIRRRVRPGSRWKGPAASTVATGGPGKVRKTRGWDESSPG

SEQ ID NO: 83217 - DNA, 898 bp, Zea mays
  misc_feature: Ceres CLONE 1569092
  misc_feature: Encodes the peptide sequence at SEQ ID NO. 83218
ctccccgcggtggcggccgctctagaactagtggatcccccgggctgcaggaattcgtctcacccctagaaaaaagagcatagagctagcaatacatcgctagctcacttgatatacatattgcatcggcataaaaactgaatttaccatggcccacttgatctcttctgcaatcgcaggcgcgggcaacttggtcgctgatggaatcagtggtgtcactggcgtagcgtcgcaggttgtagaaggcgtagaggacactttaggcagtatcgtagaagcaatcgaccaaggagtcaaggatgaggaccaactggatttgcccaagtacgtgtgtttcaagggagataatggtctgtacctgagtgctcgaacagttgaaggccacccctacctgcagtttgcatcggaagacattggcgacccaagtgtgaggttcatcacctacaaccacaaggtgaacggcaaacgggtggtgcgcttcaagtcgaaccatctcggcaagttctggaggcggagccccaactggatctgggccgacaccgacgacaccagcaccaacaactccgacaccctgttcgaggtcatcaagatcgacgaggatggtgtgtacgcgctccggaacctcggcaacaaccacttctgccacaggctgacctacgacgggcaaggagagctgcctgaaacgccacaatttcgaccatccagaaaggagcgccccatccaagatccgaaaaaaccgtcccccccccaaaagaatcccacaatccggggtacccccccccaggggggcccaaaaattttttcacaaaaaagggcaaaaaaccctcttccctcctgaagaggggggggaaagggggccccccccgggaaaaaaaaaaacaccccctcccccccctga

SEQ ID NO: 83218 - protein, 229 aa, Zea mays
  misc_feature: Ceres CLONE 1569092
  misc_feature (55)..(193): Pfam Name: Agglutinin Pfam Description: Agglutinin
MAHLISSAIAGAGNLVADGISGVTGVASQVVEGVEDTLGSIVEAIDQGVKDEDQLDLPKYVCFKGDNGLYLSARTVEGHPYLQFASEDIGDPSVRFITYNHKVNGKRVVRFKSNHLGKFWRRSPNWIWADTDDTSTNNSDTLFEVIKIDEDGVYALRNLGNNHFCHRLTYDGQGELPETPQFRPSRKERPIQDPKKPSPPQKNPTIRGTPPQGGPKIFSQKRAKNPLPS

SEQ ID NO: 83219 - DNA, 899 bp, Zea mays
  misc_feature: Ceres CLONE 1569093
  misc_feature: Encodes the peptide sequence at SEQ ID NO. 83220
  misc_feature (569)..(569): n is a, c, t, g, unknown, or other
  misc_feature (575)..(575): n is a, c, t, g, unknown, or other
ccccgcggtggcggccgctctagaactagtggatcccccgggctgcaggaattcgtctcacccctagaaaaactccttcctggacaaaatcatcagctcccgaaatccaaattgaaacagttgcaggcgattctgagctcgggttttgttccggggacggattcctgtgccggcggacgggatgtcaggccctctcgaccgatttgctaggccatgctttgaagggtttgtacataacgatgaaaggaaagagagcagatctgatgcagacaactcagaaggagataagaagactaagattgggtctttcaagaaaaaagcaattaatgcggggaacaaattcaggcattccttgagaaggagaagcaaaaaaaagaccgaaaggggggattccatcaaggacataagggacgttaaagagcttcaagatgttgagacattccgacaatgcttaattgatgaggatttgctgccaccacagcacgatgattatcacatgatgttaaggtttctaaaagcacggaaattttgaagttgagaaagctaagagtatgtggtcagacatgatncattgnaggaaggaattcggagtcgaaaaataaaggaatttgactcccccgaggtagataaagtgaccgagtattccccacaattttttctggggttgaataagagggggaaacctttcctctttgaatttgtggggaaattttgtggaaaccagcctattccaagggccaccctctgaacggggttgaaaaaccccgtttcacaaaatttgggaaggggcttctccaagaaaatatttcccggttgggccccttgtgggataaaaaaacacaaaaaacccccccccccccttttttttagagtcctcccgggcgggcgtttttacaaag

SEQ ID NO: 83220 - protein, 116 aa, Zea mays
  misc_feature: Ceres CLONE 1569093
MSGPLDRFARPCFEGFVHNDERKESRSDADNSEGDKKTKIGSFKKKAINAGNKFRHSLRRRSKKKTERGDSIKDIRDVKELQDVETFRQCLIDEDLLPPQHDDYHMMLRFLKARKF

SEQ ID NO: 83221 - DNA, 837 bp, Zea mays
  misc_feature: Ceres CLONE 1569094
  misc_feature: Translation starting site: 621
  misc_feature: SWISSPROT Homolog: EC 1.14.13.68 4-hydroxyphenylacetaldehyde oxime monooxygenase
tggagctcacccgcggtggcggccgctctagaactagtggatcccccgggctgcaggaattcgtctcacccctagaaaaagccattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccaagaacacatcttcgcgtcgcgggccgcgtccatgggccgccgagatcatccgctacggcccctcggacgtcgcgttcgtgccctacggcgagtactgccggcagggcaggaaactcctcaccacgcacatgctcagcaccaaggaggtggcattcctcccgccatgccgaaaagaagaggtgcggctcctcatgaacaagatcgggcgggtgccaccgcccgcccccgggggggggggaccttagcgatctccggtccggtaacccaaaaacctggttgggcccccggtgtctggcccctcccaccgaaaccaaggccgaaaagggttgttcacgagctgaaaaa

SEQ ID NO: 83222 - DNA, 1097 bp, Zea mays
  misc_feature: Ceres CLONE 1569096
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (788)..(788): n is a, c, t, g, unknown, or other
  misc_feature (900)..(900): n is a, c, t, g, unknown, or other
ctcttctctttcgctgtccttgtcgtctgttgtgtggtcctcctatgttgcgcttttttaaatttnnnnntttttaaagctgggactccaccgcgtgtggcggccgctctagaactagtggatcccccgggctgcaggaattcgtctcacccctagaaaaaccctagaaaaagggaggaagctgctagttggagggggccgggagaggcgtctctggttattgcttgtccctgcttcccggtgagctgctgggagtggacgggccgggaaggagacgagaagataagggcgccgcgcgcggccatggctggaagtgcgccggcgacgggcgatggacaagaccagcttttgccacccaccgtgcagcctggctgagccaagtaccttcaagggagaaagaagggcgggctgctgcagggccttgtgccctcgccatggcgccgcagctggaaaagagctttcggccgccgaccaccatgaaattccccccagcctctcaacaaagcgcttgggccaagaaaggggaaaaaggcgaaccccgggaaaatgggcaaaaaaagttgcccccgaaaaaaaaaaggggcgcagtggccccccaaaaatcttccccgcgattgtgggtgccaagaggtctccttaaccctctctcccgggtgttttaaagggggggcaaaaagaggaataaataaaatcttttttccccccccctctctcgggggggggaaaaatctctccttatatgtcccacccaaactcttgtttaatagaggggggagagcctctttctncaataaggtgactattatttttcgtcgggggtggggtggggacccacagaaattctttttggcaacaaaaaaaaaaaaaggtgtgttctttcttcgtgcgaagaacacccgngagggggggtgtcgtgcatggacgggttccaacccctcttttttctcttttgtggagaaaaataatatgtttttttcctcccctagagaaaaaaaaaatatttgtgcctccccaaaaaatttgtcccgcggggggcgcacgaaacccccccccattttgtttgtcccccacaagaaaagggtggtgtcccccccccc

SEQ ID NO: 83223 - DNA, 984 bp, Zea mays
  misc_feature: Ceres CLONE 1569098
  misc_feature (804)..(804): n is a, c, t, g, unknown, or other
  misc_feature (807)..(807): n is a, c, t, g, unknown, or other
  misc_feature (859)..(859): n is a, c, t, g, unknown, or other
  misc_feature (865)..(865): n is a, c, t, g, unknown, or other
  misc_feature (870)..(870): n is a, c, t, g, unknown, or other
  misc_feature (871)..(871): n is a, c, t, g, unknown, or other
  misc_feature (879)..(879): n is a, c, t, g, unknown, or other
  misc_feature (882)..(882): n is a, c, t, g, unknown, or other
  misc_feature (888)..(888): n is a, c, t, g, unknown, or other
  misc_feature (902)..(902): n is a, c, t, g, unknown, or other
  misc_feature (905)..(905): n is a, c, t, g, unknown, or other
  misc_feature (911)..(911): n is a, c, t, g, unknown, or other
  misc_feature (939)..(939): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
ggagctccccgcggtggcggccgctctagaactagtggatcccccgggctgcaggaattcgtctcacccctagaaaaaatacccttcccatttctcgtggcgcccacgggccacggccacgccgtagatctcctcctcgtcgcagggctccggcggtctcgccggcggtgagctgaagcgatggagctctggagcaagctgcgaaacctggatgcctacccgaaagtgaacgaggaattcttaagcccgaccctttcggggggttttttaacattttttccctccaggggaaacccccccccttttttttccgaaaaaccatttttttttttttttccgccaaaaaaaaaacccccctgtttccccccggggggggaaaacccccctttttttttgttggtccccccccccccccccttttttttaaagggggggggaaaaaaagggggggcggggggaacccccttttttttggggggcgcgaaaaaaaaaaaaaaaaaaacccccccccggggggggggtttataaaaaaaaaagggggggggcgccccccaaaaaaaaaaaaacaaccccccggggggggggggggggccccccaaaaaatatttttttttttttttttttttgtgtgggaaaaaaaaaaatacccccccccccccccccccccccttttataaacaaaaaaaaaaaggggggggggcggccccgcccttctttatttttttgtggggggggggggggggggggtggttataaaaaaaaaaaaaaaaaaaggggtcgcccccccccttttttttatatttnttntccctaaattttttttgattcctcaaaagaaagacacaaacaaattgcccgncccccnttccnnccccacanaanaaaaanaaaaaaaaaaaaanaanaaaggnagcccggccaccgggcgtggtgtagtgnaggtgacgcggnnnnagtaaagaaaaaagcaagagtnnnactcca

SEQ ID NO: 83224 - DNA, 928 bp, Zea mays
  misc_feature: Ceres CLONE 1569100
  misc_feature: Encodes the peptide sequence at SEQ ID NO. 83225
  misc_feature (746)..(746): n is a, c, t, g, unknown, or other
  misc_feature (766)..(766): n is a, c, t, g, unknown, or other
  misc_feature (767)..(767): n is a, c, t, g, unknown, or other
  misc_feature (786)..(786): n is a, c, t, g, unknown, or other
  misc_feature (841)..(841): n is a, c, t, g, unknown, or other
  misc_feature (862)..(862): n is a, c, t, g, unknown, or other
  misc_feature (865)..(865): n is a, c, t, g, unknown, or other
ggagctccccgcggtggcggccgctctagaactagtggatcccccgggctgcaggaattcgtctcacccctagaaaaaagtcttccaaaacgaagcaaaagcaaccgtcgagcttgcaacgccttacgcctccacactcaacagtcatggtcgtcatgggcaaggagcagcaacaacacgaggaggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccgtacatcaacaactacatcctgctgagccagctggagcacggcctgctggcgcggcacgtgccgggcccagcgccggcgcgcgtggccttcgtcggctccggcccgctcccgctgagctccctggtgctcgcggcgcgccaccttccgggcgcctccttcgaaactacgacatctgcggggaggcaacgacgncggcgcgggcgctgtttgcnncgcgacggcgcgctccagncgcgcatggcgtccgcacctcggacgtggcggactgaaccccgggagctggcgtnttacgacgccgtgtttctggncgnccctggggggcatggccgccgaaggaaaaagcccgcctgtggcccacctcggaagcacatgcc

SEQ ID NO: 83225 - protein, 260 aa, Zea mays
  misc_feature: Ceres CLONE 1569100
  misc_feature (39)..(254): Pfam Name: NAS Pfam Description: Nicotianamine synthase protein
  misc_feature: SWISSPROT Homolog: EC 2.5.1.43 Nicotianamine synthase
  misc_feature (207)..(207): Xaa is any aa, unknown, or other
  misc_feature (214)..(214): Xaa is any aa, unknown, or other
  misc_feature (232)..(232): Xaa is any aa, unknown, or other
  misc_feature (239)..(239): Xaa is any aa, unknown, or other
  misc_feature (240)..(240): Xaa is any aa, unknown, or other
MVVMGKEQQQHEEEEVQGKVVQEEVQVVQETVVPVPSEEDKEAEAALVHKISSLAAAIAKLPSLSPSPEVNALFTELVTACIPRSSVDVERLGPELQEMRGGLIRLCADAEALLEAHYSDLLASFDNPLEHLSLFPYINNYILLSQLEHGLLARHVPGPAPARVAFVGSGPLPLSSLVLAARHLPGASFETTTSAGRQRRRRGRCLXRDGALQXRMASAPRTWRTEPRELAXYDAVFLXXPGGHGRRRKKPACGPPRKHM

SEQ ID NO: 83226 - DNA, 1012 bp, Zea mays
  misc_feature: Ceres CLONE 1569101
  misc_feature (193)..(193): n is a, c, t, g, unknown, or other
  misc_feature (194)..(194): n is a, c, t, g, unknown, or other
  misc_feature (244)..(244): n is a, c, t, g, unknown, or other
  misc_feature (247)..(247): n is a, c, t, g, unknown, or other
  misc_feature (256)..(256): n is a, c, t, g, unknown, or other
  misc_feature (258)..(258): n is a, c, t, g, unknown, or other
  misc_feature (259)..(259): n is a, c, t, g, unknown, or other
  misc_feature (523)..(523): n is a, c, t, g, unknown, or other
  misc_feature (734)..(734): n is a, c, t, g, unknown, or other
  misc_feature (735)..(735): n is a, c, t, g, unknown, or other
  misc_feature (751)..(751): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (874)..(874): n is a, c, t, g, unknown, or other
  misc_feature (876)..(876): n is a, c, t, g, unknown, or other
  misc_feature (877)..(877): n is a, c, t, g, unknown, or other
  misc_feature (943)..(943): n is a, c, t, g, unknown, or other
  misc_feature (946)..(946): n is a, c, t, g, unknown, or other
  misc_feature (948)..(948): n is a, c, t, g, unknown, or other
  misc_feature (949)..(949): n is a, c, t, g, unknown, or other
tccccgcggtggcggccgctctagaactagtggatcccccgggctgcaggaattcgtctcacccctagaaaaagctcgtctcttctggaaccgtccctcgctcgtcatctttccgccttcgctacgcaattcctgtccacgctgcgggccagttgtgacgaccgcgaagctcgtcagagaaagaagagagccnngcaggcggcgggcgatcgagatggcgccagagaacccccggaaggatcanggnagaggagangnnagatttatgctggaggatggaggcatcaaggaaaccccggccccacctccaggactgcgggattcccaacaggaggacaataaccggcacccctaaaaagggggggagggaacggggtttgtttccccccctcttttccatccccaaaaggggccccaggtttctgggaaaaccatttgtttttttacaatagtttggttcaccaaatctttgttttgtggggcccctcttacaaaaaaaaacccccccccccctttttttggnaaacgcggggggggttcccaccaaaaatatccctttttttttgtcggagaggggggaagaaaaaaaaaatttttttttaaaccccccccccaaaacaacttttttttaataaaaaaagagagaggggtgtttttttttttttttgttggcggggggggggaggatctttttttttttggagggggggggggggggccgccccccccccccnnaccaaaagaaaaaggnggggagggtggggtctccccccccccctccccccccccaaaaaagaaagaaaggggggggggcgggcccccccccnnnnaccatttagtgggttgggggggcgcgcttctccccccccccccncnnaaagagggaggaggaaaggagagggatttcttcctcccccacaccggcggggggggaggggggggngcncnnttctttttttttttttttttttaccccaaaaaagaaaggaggggggggcggccgccccccccc

SEQ ID NO: 83227 - DNA, 872 bp, Zea mays
  misc_feature: Ceres CLONE 1569103
  misc_feature: Encodes the peptide sequence at SEQ ID NO. 83228
  misc_feature (632)..(632): n is a, c, t, g, unknown, or other
ctccccgcggtggcggccgctctagaactagtggatcccccgggctgcaggaattcgtctcacccctagaaaaaactcgccgtctgccttctgcgcctccatttcggcctctgtcccttgcaagttcaatctcacctccaaccatgggtaaagagaagtcccacatcaacatcgtggttattggccatgtcgactctggcaagtcgaccaccacaggacaccttatctacaagcttggaggcattgacaagcgtgtgatcgagaggtttgagaaggaggctgctgaaatgaacaagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctcctttgcgtcacccttggagtgaagcagatgatttgctgctgcaacagatggatgcacccactccaaatacttcanggcacgttatgaagagattgtgaaggaagtctcatcctacctcaagaaagttgggtacaacccctgatagattgcttttgtcccccatttctggttttggagggcgacaacatgatttgagaggtcacccaactcttgactgttacaaaaggcccaccccttgcttgaggctttttgacccagatcaccaaggccaagggagccctttagaacaagccccctgcggtctgcccccttcag

SEQ ID NO: 83228 - protein, 166 aa, Zea mays
  misc_feature: Ceres CLONE 1569103
  misc_feature (5)..(167): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (163)..(163): Xaa is any aa, unknown, or other
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLCVTLGVKQMICCCNRWMHPLQILXGTL

SEQ ID NO: 83229 - DNA, 873 bp, Zea mays
  misc_feature: Ceres CLONE 1569104
  misc_feature: Encodes the peptide sequence at SEQ ID NO. 83230
ggagctccccgcggtggcggccgctctagaactagtggatcccccgggctgcaggaattcgtctcacccctagaaaaaattccattcccaacttggctgcccaacccttgcgtcggtagacggcggccgcggcgaggatagagggttccctgaggaggcagtgatggagaccatggctaagtacaaccgaagcaacccggcagtgaagcggatcctgcaggaggttaaggagatgcagtccaacccctcacccgacttcatggccctccccctcgaggaagacatcttcgagtggcaatttgctatccttggcccgagagacagcgagtttgagggtggaatctatcatggcaggatccagcttccctcggattatccattcaagccgccgtccttcatgctactcacgccaagtggacgctttgagattcagaagaagatttgtttgagcatatccaattatcaccctgagcactggcagccatcatggagtgtgcgcacagcgttggtgggccttgattgcattcatgccaaccaacccctggtgggggcatggggctcattgggatttacaaaaggaagatagacgggccacttggtataaaatcacgtgtagcaccgccaaaatttgggtccccagaacgacaaaaactattggatgagatccatgagcaaaggctcagtaagctccctcctgtccccaaaggctaccaattggtgcaaagaggagcctacgaattacccgcatctgacccttcggcgaacttgcaaaaagggtaattgagggaaaaccctttgggtccgtttcaaaccccctaagggccctcccgggcccgaatctaaaacgggggtacaaaaaaaccggggggaacc

SEQ ID NO: 83230 - protein, 140 aa, Zea mays
  misc_feature: Ceres CLONE 1569104
  misc_feature (16)..(137): Pfam Name: UQ_con Pfam Description: Ubiquitin-conjugating enzyme
  misc_feature: SWISSPROT Homolog: EC 6.3.2.19 Ubiquitin--protein ligase
METMAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVGLDCIHANQPLVGAWGSLGFTKGR

SEQ ID NO: 83231 - DNA, 830 bp, Zea mays
  misc_feature: Ceres CLONE 1569107
  misc_feature: Translation starting site: 169
  misc_feature: SWISSPROT Homolog: EC 1.10.3.2 Laccase
  misc_feature (455)..(455): n is a, c, t, g, unknown, or other
  misc_feature (479)..(479): n is a, c, t, g, unknown, or other
  misc_feature (565)..(565): n is a, c, t, g, unknown, or other
  misc_feature (567)..(567): n is a, c, t, g, unknown, or other
  misc_feature (588)..(588): n is a, c, t, g, unknown, or other
ggagctccccgcggtggcggccgctctagaactagtggatcccccgggctgcaggaattcgtctcacccctagaaaaatcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaaacgggcagtacccggggccgacgctggaggtcagggagggtgacacgctcgtcatcaacgtcgtcaaccgggcgcagtacaacgccaccatccactgggcacgcatccggcagataaggactgggntgggctggacgggccggaagttcntgacgcagtgccccatcaggcccggcggcagctacaagtacccggttcacatccaggggcaggaggggcaccctgtggtggcacgncncacagctccttggctcagggncaccgtctacggcggcgctcatcattcggccccagggaggaacaagacctacccatttcgccaagcctttgcgagaagtcccccgtcatcctccgggaaattggtggggattccaaacccgaattcacgttcattccgggaggggccaaaggaacccgggggggggtccccaaagttttcgaaagcgttttacccaattaaagggccagcccccggggaaactttgtacaaagtgtttccaa

SEQ ID NO: 83232 - DNA, 997 bp, Zea mays
  misc_feature: Ceres CLONE 1569108
  misc_feature: Encodes the peptide sequence at SEQ ID NO. 83233
tccccgcggtggcggccgctctagaactagtggatcccccgggctgcaggaattcgtctcacccctagaaaaatccagttcgtggagtggagtcaccacagaatcaaagaaaagctttcccccgatcctctcgcggacaccagcgatgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccgcctcgacgacgccgtcctctacgtcgacgtcgttcacgccaaccccccccagggcgtcaagccgctcgttgggtccgcgcgcctcccgcttcgcgacgtcctcgacgaaccccgggttcgggggcaaagactcgcgcaacctccgcctcagcgccccttcgggccgcccccaccggccgcctcgaacttccgcgtcgccttcaaggaagccgccagggtattagaaccccaacccctaccgggcccccgcgggcttaagcccaaaacgggggggggggacccgggaaccccttacggttcgtccccttgttggttggccgggggttaatatcgggttccgggaggcggaatacggttcccgtggtgggcgcccctcttagggtgggggggggggtttatgggggccggccaatcccttaaaaccggagggcgccccggggagggggtaacccctttccaacctagaggggcccccgcccgcccccctttaacacaaggggagggggtaaggggggttccttccgggccgcttgataatagggggtctctccctgttctcccccccaccccccccctaaaggaaaaacggggcccgttgtcctctccaacggggagaaaaataaacaatcatgggggggagtttcgaccc

SEQ ID NO: 83233 - protein, 176 aa, Zea mays
  misc_feature: Ceres CLONE 1569108
  misc_feature (7)..(95): Pfam Name: C2 Pfam Description: C2 domain
MGSRYEVEVTVGSARDLKNVNWRNGDLKPYAVVWIDSGSKCSTRVDLDNGESPAWDEKLLVPLPPTSRLDDAVLYVDVVHANPPQGVKPLVGSARLPLRDVLDEPRVRGQRLAQPPPQRPFGPPPPAASNFRVAFKEAARVLEPQPLPGPRGLKPKTGGGDPGTPYGSSPCWLAGG

SEQ ID NO: 83234 - DNA, 1046 bp, Zea mays
  misc_feature: Ceres CLONE 1569110
  misc_feature (725)..(725): n is a, c, t, g, unknown, or other
  misc_feature (731)..(731): n is a, c, t, g, unknown, or other
  misc_feature (733)..(733): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (895)..(895): n is a, c, t, g, unknown, or other
  misc_feature (948)..(948): n is a, c, t, g, unknown, or other
  misc_feature (964)..(964): n is a, c, t, g, unknown, or other
  misc_feature (1011)..(1011): n is a, c, t, g, unknown, or other
  misc_feature (1016)..(1016): n is a, c, t, g, unknown, or other
  misc_feature (1021)..(1021): n is a, c, t, g, unknown, or other
  misc_feature (1022)..(1022): n is a, c, t, g, unknown, or other
  misc_feature (1023)..(1023): n is a, c, t, g, unknown, or other
  misc_feature (1026)..(1026): n is a, c, t, g, unknown, or other
  misc_feature (1028)..(1028): n is a, c, t, g, unknown, or other
  misc_feature (1029)..(1029): n is a, c, t, g, unknown, or other
ggagctccccgcggtggcggccgctctagaactagtggatcccccgggctgcaggaattcgtctcacccctagaaaaatataattggaacagaaagcattaaaagggtattacctgttggggatcgtttgttggattggtgtgagaggactcttgtcatgggggtccttaatttgacacagacagctttagtgatggaggtaagtttctagaagtgggagctgccatttctcaggcctagtcattattctccgaaggggcaaatccttgatttggggggccaaactcaccgggccctttgaaaaaaattttctcccaaagagagacctttaaagggtggcccccctttcggaaaaaaaaacaaaacacccccagagagggggggaggtttccccccgggggaaaacctctttgagaaaatttcccccggggttttaaaaaaaaaaacccccctttatttatttttttttggcggggggggtttttgttttttttttttttttttggggggcctctttttttttttttttttttttttttttcggggaggggggggaagccctccctccccatcacaaaaaaaaaaaaaatatttttttttttttttggggggggggggggggggtgtgttctcctccccccccacaaaaaaaaaaaaaaataaaaaaaattttttttgtgggggggggggggggggggtgtgtttttcctccccccctcacaacnccccananaaaaaaaaataatttttttttttttttttttttttttttggagggaaggaagagagagagggtggttcctttttttttcttctcccccccctccccccccccccgggcgagggagttggtattgtgtttttacgatgnnnttaccccccccccctctctctnacaccccccgccccccgcccctctgttcttttgtttgataataaaaagaaaanttacaacaattttggngggagggaggcgcggcggcggcgatacattcaaatacataaaacaancaaancaagnnnttnannaaatataaaatgatatt

SEQ ID NO: 83235 - DNA, 909 bp, Zea mays
  misc_feature: Ceres CLONE 1569114
  misc_feature: Translation starting site: 300
tccccgcggtggcggccgctctagaactagtggatcccccgggctgcaggaattcgtctcacccctagaaaaactttttttctctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgtagccatatgctggggaattgcatattgtgtcaagggtggtccagaaaaagagctaaaagcaatacagtacttggagagaagagagtgtgagtacgaccagaaaatatcccatgatttcctacaggaaagagatccccttgaaaccagctgtgacgggcgtcttagtgtccgtttcccctccaaatccaattggcaacaagtactatcttgcccctgcccctctgcaggatatggcaaggaaaattgctacgccaatgcccccaactggcttaaaaaaggaattacctgttcccaggggagaagcgcttacccgccatttccaccaaaaggattcgatctatgaacctgcaaacaagggaaggaaggggcccaacaaaaaaaaggaaaccaaaatcctgtgggcccatgcgtcccctgaaatcacggcccctctt

SEQ ID NO: 83236 - DNA, 845 bp, Zea mays
  misc_feature: Ceres CLONE 1569115
  misc_feature: Encodes the peptide sequence at SEQ ID NO. 83237
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
gagctccccgcggtggcggccgctctagaactagtggatcccccgggctgcaggaattcgtctcacccctagaaaaaattaaacgcgggcgatcaagatggcgcacgaccccagcctgggcttcgcggactacttctcggcggcggcggcggcgggcgccacggcgatggacgacgacgtcggggcgccggagctctatggcctgcatgccgacgacatggagttcctcggcatgcgtggcctggccgccatgccccccgccgcggcacaccaccagcaccaccaccatcacggccacagcaaggccggtgcgctcctcgacgacgacgacgcgggggtggggccagacgtcagcggctccgcggacgacgccaccatgcgcttcctgagcgagcagcagcagcagcagcaccaggcgccgctgtcgctgtcgctgtgccggccggacgtggcgacgacgttgcacgagcagcagcacctcgccggcggtggctcctcgtcccggtaccatcaggagcagcagccggcggcgtgggtgcagcagcagcacgactactcgccgtcgccgcagcagcacgcgtggcacctgcgcagcttccgggttctcgtcccgggccaaaaggtctgcaagagtttttccacctcccccgtgaaaagaaaaagggcttccccctcccccaaaaggccccaggggcccaaaaaaaaccgggccttccnnnnnnnnnnnnnnnaaaaaaaaaggggggcgggcccccagagggggggtttttcctttccggggccccctggggggcgccccccccccccccaaaaaaaaccccttttgagagaccccggcggggtgc

SEQ ID NO: 83237 - protein, 249 aa, Zea mays
  misc_feature: Ceres CLONE 1569115
  misc_feature (207)..(207): Xaa is any aa, unknown, or other
  misc_feature (208)..(208): Xaa is any aa, unknown, or other
  misc_feature (209)..(209): Xaa is any aa, unknown, or other
  misc_feature (210)..(210): Xaa is any aa, unknown, or other
  misc_feature (211)..(211): Xaa is any aa, unknown, or other
  misc_feature (212)..(212): Xaa is any aa, unknown, or other
MAHDPSLGFADYFSAAAAAGATAMDDDVGAPELYGLHADDMEFLGMRGLAAMPPAAAHHQHHHHHGHSKAGALLDDDDAGVGPDVSGSADDATMRFLSEQQQQQHQAPLSLSLCRPDVATTLHEQQHLAGGGSSSRYHQEQQPAAWVQQQHDYSPSPQQHAWHLRSFRVLVPGQKVCKSFSTSPVKRKRASPSPKRPQGPKKNRAFXXXXXXKKRGAGPQRGGFSFPGPPGGRPPPPQKKPLLRDPGGV

SEQ ID NO: 83238 - DNA, 995 bp, Zea mays
  misc_feature: Ceres CLONE 1569118
  misc_feature: Encodes the peptide sequence at SEQ ID NO. 83239
  misc_feature (414)..(414): n is a, c, t, g, unknown, or other
  misc_feature (416)..(416): n is a, c, t, g, unknown, or other
  misc_feature (418)..(418): n is a, c, t, g, unknown, or other
  misc_feature (482)..(482): n is a, c, t, g, unknown, or other
ctccccgcggtggcggccgctctagaactagtggatcccccgggctgcaggaattcgtctcacccctagaaaaaaagcagatcttgtgaccctccctcagccgcgtcgcgtcccatcctacgatccaaaggtctctctgctcgcagccatggcgaagaactacccgaccgtgagcgccgagtacagcgaggctgtcgagaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaagggagagttccnantncctctctacgccgatttctaccagctcgcgggagttgtggccgtggaggtcacccggtgggccntgagattcccttccacccccggtaggggagacaagcctcaacccccaccctgagggcggccttcctgacgccacttaagggttccgaccacctgaagcaagtttttttggcaagcaaatgggctttgaacgatccggaacatggttgccctttcctgggggccacacccttggggaaggggccccaaaaaaggggtctggttttcagaggggccctggactaacaaaccctttgggcttttggaaactcttttcttcaggaaaattcgtgagggggaaaaggaggagccctttttccacccccaatggaaaaacccctggtgaaacaacccttttttccccccctttgggaaaaaaattgccgggaaagaaaagggtttttttggataacaaaaagagcccccccacgcctccccaaaaggggtgtgggtgttcaaaaaacccccctggggaggaatctcccgccgccggagagaaaaaaggggtctttctcggggggagagagaaaaaaaaa

SEQ ID NO: 83239 - protein, 128 aa, Zea mays
  misc_feature: Ceres CLONE 1569118
  misc_feature: SWISSPROT Homolog: EC 1.11.1.11 L-ascorbate peroxidase
  misc_feature (89)..(89): Xaa is any aa, unknown, or other
  misc_feature (90)..(90): Xaa is any aa, unknown, or other
  misc_feature (112)..(112): Xaa is any aa, unknown, or other
MAKNYPTVSAEYSEAVEKARRKLRALIAEKSCAPLMLRLAWHSAGTFDVSSRTGGPFGTMKHQSELAHGANAGLDIAVRLLEPIKGEFXXPLYADFYQLAGVVAVEVTRWAXRFPSTPGRGDKPQPPP

SEQ ID NO: 83240 - DNA, 884 bp, Zea mays
  misc_feature: Ceres CLONE 1569120
  misc_feature: Translation starting site: 138
  misc_feature (376)..(376): n is a, c, t, g, unknown, or other
  misc_feature (532)..(532): n is a, c, t, g, unknown, or other
ctccccgcggtggcggccgctctagaactagtggatcccccgggctgcaggaattcgtctcacccctagaaaaaagccatcacacgcatactgcatacacaacgcagagcatcagaagcagctgcgatctgatcgacatggctgccgccaccatggctatcacctcccgcgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacanccgcggggctgtcggcggaccctggagaccttcgccaagaaccgcgagctggaggtgatccactgccgctgggccatgctcggcgcgctcgggtgcgtgttcccggagctgctcgcccgcacggcgtcaagtcggcgaggcggtgtggttcaagcnggctcccagatcttcagcgagggcggctcgactacctcggcacccgaagcgggtcacgcgcaaagcacctgggcatctgggcgtgccaggtgtgctcctggagcccctccaggggttacgggtccccgggggcccccttgggggaggggggccaaccccttttccccgggggggagtttaaaacccttggggttcccaaaaaccccgaagggttccccagacccagggggaggaaacaaaaaagcccccccccccttttccccaagttggggttccttggggagggtttttccccgggaagggcccccttaaaaaacccggaaacaatgggcaaaccccaaaaaaaaaaggg

SEQ ID NO: 83241 - DNA, 906 bp, Zea mays
  misc_feature: Ceres CLONE 1569124
  misc_feature: Encodes the peptide sequence at SEQ ID NO. 83242
  misc_feature (794)..(794): n is a, c, t, g, unknown, or other
ctccccgcggtggcggccgctctagaactagtggatcccccgggctgcaggaattcgtctcacccctagaaaaaacaaacccaaagcagagagggagagaggaccaagggagagagaggagagagagcgatcgagagatgaggagggagcttgcctcccccttagctactgccgccgctgccacggccggtgcctccttctcggctgccgcctcgctccggggctggtgggacgatgtcaacgagtcgccccagtggcaagacggggccttcttctccctcgccgccgcctacgccctcgtctccgccgtcgcactgattcagctcgtcaggatccagcgccgggtgcccgagttcggatggaccacgcagaaagtcttccacctcatgaacttccttgtcaatggggtccgtgctctggtgttcggcttccatgtccatgtcttcctccttcgcacaaaagtatacaagttggtgttgctagatctccccggcttgttgtttttctccacctacaccttgctcgtgctcttctgggcagaaatataccatcaggctaggagtctcccaacggacaagctaaggcctgcatacattgccgttaacgccatcatatacgttgttcagctttgcatatggatatacctcggaataaatgataatgccgcgtttgagctggccagcaaaatattcgttgtagctgtctcctttgttgcgctttctgggtttcagtatatggtggaaagggtgttgtcttgctgagacgtttccctatgaatctaaggggcggcaaangagctgtatgaggtggggacggtgaagcaatttgtgttactgctttctgataagatgggtggggtccgctatctgcattgatgcgaaggatctccgagttttggacattcat

SEQ ID NO: 83242 - protein, 207 aa, Zea mays
  misc_feature: Ceres CLONE 1569124
  misc_feature (14)..(208): Pfam Name: DUF1084 Pfam Description: Protein of unknown function (DUF1084)
MRRELASPLATAAAATAGASFSAAASLRGWWDDVNESPQWQDGAFFSLAAAYALVSAVALIQLVRIQRRVPEFGWTTQKVFHLMNFLVNGVRALVFGFHVHVFLLRTKVYKLVLLDLPGLLFFSTYTLLVLFWAEIYHQARSLPTDKLRPAYIAVNAIIYVVQLCIWIYLGINDNAAFELASKIFVVAVSFVALSGFQYMVERVLSC

SEQ ID NO: 83243 - DNA, 790 bp, Zea mays
  misc_feature: Ceres CLONE 1569125
  misc_feature: Encodes the peptide sequence at SEQ ID NO. 83244
  misc_feature (325)..(325): n is a, c, t, g, unknown, or other
  misc_feature (347)..(347): n is a, c, t, g, unknown, or other
  misc_feature (352)..(352): n is a, c, t, g, unknown, or other
  misc_feature (377)..(377): n is a, c, t, g, unknown, or other
  misc_feature (412)..(412): n is a, c, t, g, unknown, or other
ggagctcaccgcggtggcggccgctctagaactagtggatcccccgggctgcaggaattcgtctcacccctagaaaaaaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccacccntccgcgtcggccagggtggccngccgntcgccctccgcccaaagggaacccnttccggcgttcccgtccaactcaacaaggagcccnccccccctcaaggccacgacgagtggatcttgactggattgccccgggggggaatttacggggttcccccgggttcgggggacctccaacccccaaccaagaagggccccgctcccggggaaggtttttaggattttaacccggaaattttggacccggggaaaaggggaacaccttcccctggaagacaccccccgggggaagattggggggggaaaaaaacacccccccccgggggggttcccggggcccccccttttagaatactccgggggggccctcaaaaaaaggtttgctccaccccgggggggggggccccccccgtgttggggggctcccgggggggggagcaaaaacaacccccccgggggggggggc

SEQ ID NO: 83244 - protein, 123 aa, Zea mays
  misc_feature: Ceres CLONE 1569125
  misc_feature: SWISSPROT Homolog: EC 4.3.1.5 Phenylalanine ammonia-lyase
  misc_feature (49)..(49): Xaa is any aa, unknown, or other
  misc_feature (58)..(58): Xaa is any aa, unknown, or other
  misc_feature (78)..(78): Xaa is any aa, unknown, or other
MAGNGAIVESDPLNWGAAAAELAGSHLDEVKRMVAQARQPVVKIEGSTXPRRPGWPAXRPPPKGNPFRRSRPTQQGAXPPSRPRRVDLDWIAPGGNLRGSPGFGGPPTPNQEGPRSRGRFLGF

SEQ ID NO: 83245 - DNA, 932 bp, Zea mays
  misc_feature: Ceres CLONE 1569127
  misc_feature: Encodes the peptide sequence at SEQ ID NO. 83246
  misc_feature (390)..(390): n is a, c, t, g, unknown, or other
  misc_feature (823)..(823): n is a, c, t, g, unknown, or other
  misc_feature (866)..(866): n is a, c, t, g, unknown, or other
tccccgcggtggcggccgctctagaactagtggatcccccgggctgcaggaattcgtctcacccctagaaaaaagacccttcacattcccagttccctctgcgccccgtaaaccctagccgcgattcatggcccgcaagcgccgcgcgccttcgcctcctccgcctccgcaggaggagtcgtcctctgaggaatctggctccgaagagttggaggagcctcctcgcctccccgagctccgtagtcccccgcaggccgcggccaacaacgccgactcgtcggaggcggacacggactccgacaccgacgctcaagctttccagatgcgccaggtgccccgctccctcactcagcatacggagtgggggggcccagccagaatccgatcccnaagaggaggagggcgagtcatcggagtcggagcatgagaaccctgtgcctgtggttcaaaaaaaggctgcggcggcggccgtgttgtccaaggcagagcaggaaaggaagagacccccctcggatcctgctcctcccgggaaggcaaaaaaaatgaagggtgtgggttccccctccttgccaagggcaaagaagggcaagggccgaacctttaaaaacccgggccccccggggcgcccttccggcacggaaatagcaaaaaaggggcgaagccttagctctacagaagaccaacctttttgatcgcccctcccccagggaagaggcggaataaaggcggagggccctggggggcggcctttccttttaggacccaccccctccgggcaaagggggaaaacacggatgggggaccaactatatagagaatctcnctctcggctaaaaattcctttccagtttgggaggacgccaggngtggtgagaggaccgggtggtccctccgccccgtgggcggaagaaaaaatatccgagttgtcaacg

SEQ ID NO: 83246 - protein, 99 aa, Zea mays
  misc_feature: Ceres CLONE 1569127
  misc_feature (88)..(88): Xaa is any aa, unknown, or other
MARKRRAPSPPPPPQEESSSEESGSEELEEPPRLPELRSPPQAAANNADSSEADTDSDTDAQAFQMRQVPRSLTQHTEWGGPARIRSXRGGGRVIGVGA

SEQ ID NO: 83247 - DNA, 921 bp, Zea mays
  misc_feature: Ceres CLONE 1569128
  misc_feature: Encodes the peptide sequence at SEQ ID NO. 83248
ggagctccccgcggtggcggccgctctagaactagtggatcccccgggctgcaggaattcgtctcacccctagaaaaaacccacgcacactcttctccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggacgccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacggcaagcagtactacgccgtgtccgtgctcacatgaacgtcgacagcgacgaaggcggctagcaccagctcatcgcggccaccgtctccgacggcagctctaatctgcatgcgcaggccgcgacaagaggtggtcagggcgccagtaaggtatctagaagggcgctcctcctcagggtcgcagaggatgaatttattcctccgag

SEQ ID NO: 83248 - protein, 207 aa, Zea mays
  misc_feature: Ceres CLONE 1569128
  misc_feature (57)..(206): Pfam Name: PsbP Pfam Description: PsbP
MASTSCCLLHQSTARLGASPRLAAAPPRSAQLLVCKARKQDAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTSKKTIADYGSPEEFLSQVDYLLGRQAYGGKTDSEGGFETGAVATANVLESSTPVIDGKQYYAVSVLT

SEQ ID NO: 83249 - DNA, 944 bp, Zea mays
  misc_feature: Ceres CLONE 1569129
  misc_feature: Encodes the peptide sequence at SEQ ID NO. 83250
  misc_feature (373)..(373): n is a, c, t, g, unknown, or other
ccccgcggtggcggccgctctagaactagtggatcccccgggctgcaggaattcgtctcacccctagaaaaaaaccgctacccattgcaaacgctttccctccactcgtccgctccggccgcgcgcctccgccccacgccgatgccgcccccgccctcgcccccgccgcctctcggcctccgcctccgtctctccctcctcccgccccaccctatcgcgccttctatccgtcatgccttctgctcaccctccgtcgtgtcctgccatctttcggtgcgccccctcgcccaacgccgcggtgggcgcccgcgccccctctgcgccgcgcggggcgaggcctacgccgagggcttcgcgtggccggatgggtccnaggaggagctgcggcggctcctggagctgctccctagggagctgagtgggcgggtggagacccacccagagctcccggcgcttcgtggaggtggtcatggacctcgggccgggccccgcttcggggctttcccgtccgggggactttcttcctcttccaagcgcccctatcttccttcgaaggaccctccggtgccgcttacctccccaggtttggggggactttttggggcgggaaataatccggggtggggaattcaggccggcaacgcctgggatcgggggatttcggcgccctttttgggggattcttgagggggggggtttattgtgtcggggctctccaaatggcgctgtgtgttggggcgtgtgacgtggccccccgggaggcagcggggaatatgccttccccgggacgttgctgttaaaggggcgggcggggtgtatctggggtgggaaggggagtgccgcgtctggggggggggtgtgagcagtctctgttggtgagggggaggatttgggccggctgggtgcggcgtgcggcccgggaggcgagggtgcgatcggatggg

SEQ ID NO: 83250 - protein, 181 aa, Zea mays
  misc_feature: Ceres CLONE 1569129
  misc_feature (78)..(78): Xaa is any aa, unknown, or other
MPPPPSPPPPLGLRLRLSLLPPHPIAPSIRHAFCSPSVVSCHLSVRPLAQRRGGRPRPLCAARGEAYAEGFAWPDGSXEELRRLLELLPRELSGRVETHPELPALRGGGHGPRAGPRFGAFPSGGLSSSSKRPYLPSKDPPVPLTSPGLGGLFGAGNNPGWGIQAGNAWDRGISAPFLGDS

SEQ ID NO: 83251 - DNA, 942 bp, Zea mays
  misc_feature: Ceres CLONE 1569130
  misc_feature: Encodes the peptide sequence at SEQ ID NO. 83252
  misc_feature (739)..(739): n is a, c, t, g, unknown, or other
ctccccgcggtggcggccgctctagaactagtggatcccccgggctgcaggaattcgtctcacccctagaaaaaatccgtttcatttccacctccttttccagtttcgactcgattcgaaacaggataccaaatgcatgatcgatcccacaagccgcagccggcggaggccggcaacggcgggccggctggcgagggcggcggcgggaacgtggatcgggtgctcttcaagaacctcgtcgagatggtgccgctcgtcgagtcgctcatggaccggagggtcaacccggcatactcgcgtcgcgcttcgctggtctacacgccggcgccgcccaagaaggcaagcgatttgaaaagtgtcaaattgccacagagcgtatcagccaaaaagcggagagaccctggtgatatagccaagaagagcaccccagattctaacggcgacaacggttcagttgtgccattatctctgtcaggtgctgaaaatatgcccaaggatgaggttgccgtgctaagcgagcagatcaatgacctacaaaagaagctgcttgagaaggaggaggcactgaggtctgcggagagctctgtgactgagatgaatgcagcatatgcaactatcgatgaactcagacgcctggtggctgacaaagaagctttgatcagatctaccaattctcagttgcatgatgcaaagattatgcttgcagacaagcaagcgtctttagagaaacttgatgggnaggtgagatgtcaaataaaaaggtcgagatcttcaaggagatatgtcgaatatgggattcgagatagctcattgatggtatttttcgaaaaattcagaggaatgttcaggtgactcttatgatgatatataccatcatctatgaattagagacactcaaatcatggatgaaatgacaagattgaggtcgacagctagaaaaga

SEQ ID NO: 83252 - protein, 239 aa, Zea mays
  misc_feature: Ceres CLONE 1569130
  misc_feature (203)..(203): Xaa is any aa, unknown, or other
MHDRSHKPQPAEAGNGGPAGEGGGGNVDRVLFKNLVEMVPLVESLMDRRVNPAYSRRASLVYTPAPPKKASDLKSVKLPQSVSAKKRRDPGDIAKKSTPDSNGDNGSVVPLSLSGAENMPKDEVAVLSEQINDLQKKLLEKEEALRSAESSVTEMNAAYATIDELRRLVADKEALIRSTNSQLHDAKIMLADKQASLEKLDGXVRCQIKRSRSSRRYVEYGIRDSSLMVFFEKFRGMFR

SEQ ID NO: 83253 - DNA, 926 bp, Zea mays
  misc_feature: Ceres CLONE 1569131
  misc_feature: Encodes the peptide sequence at SEQ ID NO. 83254
  misc_feature (838)..(838): n is a, c, t, g, unknown, or other
  misc_feature (844)..(844): n is a, c, t, g, unknown, or other
ctccccgcggtggcggccgctctagaactagtggatcccccgggctgcaggaattcgtctcacccctagaaaaagtcctagacgcaatacacatacaccccctcttgcccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgcgtgtggctcggcacgtacgacacggccgaggaggccgccaaggcgtacgattccgccgcccgcgagttccgaggcgccaaggccaagacgaacttcccgttcccctcccagtgctccgtcgcctccgttgctgccggtagcgctagtagcaacagcaccgtggattcgagcggtggcggtagcggctgtggcatccaggcgcctatgcaggccatgccgcttcctccggctctcgatctcgacctcttccatcgggcggccgccgtgaacgcagtctccaccggcatgcggtttccgttcaagggctatcctgtcgcctgcccgacgccacagcagtactttttctacgagcaggcagcggccgcggctgccgcggcatccggataccggatgctcaaggtcgccccaccggccgtgactgtggccgcggtggcgcaaagcgactccgactcgtcggtctgtggttgatcactccccttcgcctccggcgttgacggaaaacaggntgggcntccaactggatctgacctgggccccccccggcagagaactaggcaagccgaagtttttggctgacgacttagtagcttcttt

SEQ ID NO: 83254 - protein, 212 aa, Zea mays
  misc_feature: Ceres CLONE 1569131
  misc_feature (32)..(83): Pfam Name: AP2 Pfam Description: AP2 domain
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASVAAGSASSNSTVDSSGGGSGCGIQAPMQAMPLPPALDLDLFHRAAAVNAVSTGMRFPFKGYPVACPTPQQYFFYEQAAAAAAAASGYRMLKVAPPAVTVAAVAQSDSDSSVCG

SEQ ID NO: 83255 - DNA, 953 bp, Zea mays
  misc_feature: Ceres CLONE 1569132
  misc_feature: Translation starting site: 119
  misc_feature: SWISSPROT Homolog: EC 5.3.3.2 Isopentenyl-diphosphate Delta-isomerase
  misc_feature (757)..(757): n is a, c, t, g, unknown, or other
  misc_feature (786)..(786): n is a, c, t, g, unknown, or other
  misc_feature (823)..(823): n is a, c, t, g, unknown, or other
  misc_feature (828)..(828): n is a, c, t, g, unknown, or other
  misc_feature (836)..(836): n is a, c, t, g, unknown, or other
tggagctccccgcggtggcggccgctctagaactagtggatcccccgggctgcaggaattcgtctcacccctagaaaaaaccaaatccaggcgtggccgtgcgaccatccctcccctcatggcgtcatcggcggcgcgatccctcgcgctcgtcgcgtctgcctcggcatcgctcggcgtcgggcagcggtcgtgggctcgcttggctgtctcttcctcttcggctgggtcggccctccccaagctccgcgggctccgctcgttcgccgcctccgcagggggcgccgtgatggggaagccaggccccggggtcgttgacgccgacgccgggatggacgccgtccagcggcggctcatgtttgaggacgagtgcattttagtggatgaacaagacaatgtcatcggccacgagtccaagtataactgccatctcatggagaagatagaagctggaaatgccctgcacagagctttcagtgttttccttttcaactccaaatatgagttgctactgcagccatcctctctaccgcgagtcagagttgattgaggaaaattgtgcaggtatgtatacatgttccttgaagagtgaggaatatagttttatatgcaccatccatattgttccttgcactctactcgtgaccagtcgccatctcttatttctgtcagggggtgagaaatgcagcccagcgcaaactatttgatgagctggggaatagtggctgacgaattacctgtcgaccagttcattccngcttgggaagatgcttttacaggctcctncagatggaaaatggggcgaacacgagttggattaccntctgntcatgggntcgtgacgtgaagctcgaccgaatcctgaagaagtggccgatgtcaagtcatgaaccggcatcagctgaagaactgctcaagaagcccaatgccggggaaaatggccgtaagcctcc

SEQ ID NO: 83256 - DNA, 968 bp, Zea mays
  misc_feature: Ceres CLONE 1569134
  misc_feature: Encodes the peptide sequence at SEQ ID NO. 83257
  misc_feature (379)..(379): n is a, c, t, g, unknown, or other
gctctgaactagtggatcccccgggctgcaggaattcgtctcacccctagaaaaaaccaaatccaggcgtgggcgtgcgaccatccctcccctcatggcgtcatcggcggcgcgatccctcgcgctcgtcgcgtctgcctcggcatcgctcggcgtcgggcaggggacgtgggctcgcttggctgtatcttcctcttcggctgggtcggccctccccaagctccgcgggttccgctcgttcgcagcctccacaaggggcgccatgatgaggaagacaggccccggggtcgttgacgccgacgccgggatggacgccgtccagcggcggcttcatgtctgacgacgagtgcgttttagtggatgaacaagacaatgtcancccccaccagtccaagtataactgccatctcatggagaacatagaagctggaaatgccctgcacagagctttcagtgtactccgttttcacccccaagaagagttgctactgaagccagtccgctctaaccgcgagtcagagttggattgaggaaaattagtgcaggtaggtatacctgtcccctggaaagagaggaggaaaagtactttttaaatggcgccattcagtattagttcccttggaagactcttaagtcagggaaccagttcggggaatctcgttacttccggcgtcaggggggggaaaaaattgcaacccctacccgtcaaaactaatgtggaggaaggcgggggaataagtggtctggaactaattaccctggtccggacaacttttcttttccccttgtgggaagaaggccttttacaagggctcctctcagaaggagaaatggtggggaacaccctattttgagattacccctcgtttcaggtgtggggtgaattgaaaatctcaaccgcgataccggatgaagtggccccaatgtccatgctctgtaaaccggcaccagcttaaggaggtggctcg

SEQ ID NO: 83257 - protein, 65 aa, Zea mays
  misc_feature: Ceres CLONE 1569134
  misc_feature: SWISSPROT Homolog: EC 5.3.3.2 Isopentenyl-diphosphate Delta-isomerase
  misc_feature (16)..(16): Xaa is any aa, unknown, or other
MSDDECVLVDEQDNVXPHQSKYNCHLMENIEAGNALHRAFSVLRFHPQEELLLKPVRSNRESELD

SEQ ID NO: 83258 - DNA, 970 bp, Zea mays
  misc_feature: Ceres CLONE 1569136
  misc_feature: Encodes the peptide sequence at SEQ ID NO. 83259
  misc_feature (630)..(630): n is a, c, t, g, unknown, or other
  misc_feature (650)..(650): n is a, c, t, g, unknown, or other
  misc_feature (662)..(662): n is a, c, t, g, unknown, or other
  misc_feature (676)..(676): n is a, c, t, g, unknown, or other
  misc_feature (711)..(711): n is a, c, t, g, unknown, or other
  misc_feature (894)..(894): n is a, c, t, g, unknown, or other
ctggagctccccgcggtggcggccgctctagaactagtggatcccccgggctgcaggaattcgtctcacccctagaaaaaacggccgccctagcttccccacattcagctccttcgccgccgccctagctttcccgcgagcgggacggcagccgccgtatcctccttcctccaataacgagcgggtccaggcaggtagcatcctcgcgcccctgtcgtgtcgcctccgcctctgagttcagctcgccggcagccgccgctcgcaatggaggccctccggaaagcggaggcggagctcacggtgtacgtgcacccctccaacgccaagcgcgtccggcacgccgtctcccgccagctcagcgcgcttctcttcacgtatgtggaccgttttgatggcgtgttgctgatgcatgaagtttcattccttattggcaaagacaaagagggcaaacccatatatgaaaggagtgaccgtaatgatcaaattgctgaacccgtttcttatggcaaaatcatgaatggcttggtgccatatttcagcgtccaagtgcatgccaccctgctgctcttctctccccagccggacatgatcctggaagggatggttgaaatgctcgggaaggagtcaatncatgcccatgtattaggggntttctcagtggncattatgtctgaangatatttaagtcaatttcaatgggaaagtgatggnaggaaaatttgtgagcctcacagataaaaaacacacatgacacaacgacaacaactgtcctcaatccagcagccctcgagtctcgtccccgcacatcagcagagagacgccactacccacaccgcaagcgacgtacggggagatgtttctgcgacggatccttaccggcggaagtggcctggncggccctaaggccggcccccccctgaagaatactaggggatccttcggccttgagggcggccaaacccgcgggagt

SEQ ID NO: 83259 - protein, 157 aa, Zea mays
  misc_feature: Ceres CLONE 1569136
  misc_feature (10)..(102): Pfam Name: RNA_pol_Rpb7_N Pfam Description: RNA polymerase Rpb7-like, N-terminal domain
  misc_feature (122)..(122): Xaa is any aa, unknown, or other
  misc_feature (129)..(129): Xaa is any aa, unknown, or other
  misc_feature (133)..(133): Xaa is any aa, unknown, or other
  misc_feature (138)..(138): Xaa is any aa, unknown, or other
MEALRKAEAELTVYVHPSNAKRVRHAVSRQLSALLFTYVDRFDGVLLMHEVSFLIGKDKEGKPIYERSDRNDQIAEPVSYGKIMNGLVPYFSVQVHATLLLFSPQPDMILEGMVEMLGKESXHAHVLGXFSVXIMSEXYLSQFQWESDGRKICEPHR

SEQ ID NO: 83260 - DNA, 918 bp, Zea mays
  misc_feature: Ceres CLONE 1569137
  misc_feature: Encodes the peptide sequence at SEQ ID NO. 83261
  misc_feature (835)..(835): n is a, c, t, g, unknown, or other
ctccccgcggtggcggccgctctagaactagtggatcccccgggctgcaggaattcgtctcacccctagaaaaaatccccccggccggttcctccctgccgccgcggtcgctgtgcgaagccttgcgaatcaccgttgtccgggctgtggggggctggcatggcgctccggaggctgctgcaggggagtgtcctgccgcgggtaaccggcagggcttcggcaccggccgtggcgccgttttcaacggagtccggagagaccatccgtgccaccctctttccgggcgacggcatcgggccagagatcgccgagtctgtcaagcaggtattcaatgttgcaggggtaccaattgaatgggaagaacactatgttggtacagaagttgatcccagaacagagagttttttgacttgggaaagcctggagtcagtgcgtagaaacaaagttggcttgaaaggtcctatggctacacctattggaaagggtcatcgatctttgaatcttacattaaggaaagaacttgggctctatgccaatgtcaggccttgcaacagcctcccaggctacaagaccagatacgatgatgttaaccttgtgacaattcgtgaaaatactgaaggagaatatagtggtcttgagcatcaggttgtgagaagtgttgtagaaagtttgaaaattattacccgccaagcaagtttgagagtggcagaatatgcttttcattatgccaaggccaatggccggggaagggtctctgcgattccaaggcaatattatgaggaagacgatggtctttcctcagtggtgccgtgaggtggctgagacgtacctgaantcaatacgaagagtcattattgacattgttgttgacgctgtgaagatctgggcttttgatgtatatgatgccacctcttgggg

SEQ ID NO: 83261 - protein, 217 aa, Zea mays
  misc_feature: Ceres CLONE 1569137
  misc_feature (36)..(216): Pfam Name: Iso_dh Pfam Description: Isocitrate/isopropylmalate dehydrogenase
  misc_feature: SWISSPROT Homolog: EC 1.1.1.85 3-isopropylmalate dehydrogenase
MALRRLLQGSVLPRVTGRASAPAVAPFSTESGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRSVVESLKIITRQASLRVAEYAFHYAKANGRGRVSAIPRQYYEEDDGLSSVVP

SEQ ID NO: 83262 - DNA, 1006 bp, Zea mays
  misc_feature: Ceres CLONE 1569139
  misc_feature: Encodes the peptide sequence at SEQ ID NO. 83263
  misc_feature (371)..(371): n is a, c, t, g, unknown, or other
  misc_feature (481)..(481): n is a, c, t, g, unknown, or other
  misc_feature (499)..(499): n is a, c, t, g, unknown, or other
ctccccgcggtggcggccgctctagaactagtggatcccccgggctgcaggaattcgtctcacccctagaaaaaaaggaccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctccgcctcgcgtggcactccgcggggacgttcgacgtgtcgtcgaggaccggcggtcccttcggtactatgaagtgcccggcggaactggctcacggcngcaacgcggggctggacatcgcggtgcggctgctcgagcccatcaaggaggagtttcccaccctctcctatgccgactttctacagcttgccgggaattgtgggccgtcnaagtcacccgttgggccntgagatccccctccaacccaggcaagggaggacaaagctccagccgccacccttgagggccggctttcttgaatgccaccaagggtgtccgaccccctgaaggcaagttttttggaaccaaatggggttttaaatggatacggaaacttcttgccccccttggggggggcccccctttggggaaggggcccccaaaaaaggcaggcgggtttttaagggggcccggaaataaaaaacccttgggggctttaaaaccccttttttcaagggaaatctctgaggggggaaaaagggagggcttttcttcccccccaaagaaaaaaacccctttggagaacccttgtttcccccttttgggggaaaaatatcccacaaaaaaagagttttttttttaaaaaaaagggccccccccccccccccaaggggggggggtggattatagggcccccttggggggggaaaaaaaccccctgggggcccccccagaggaagaaaaaatttttgttt

SEQ ID NO: 83263 - protein, 112 aa, Zea mays
  misc_feature: Ceres CLONE 1569139
  misc_feature: SWISSPROT Homolog: EC 1.11.1.11 L-ascorbate peroxidase
  misc_feature (70)..(70): Xaa is any aa, unknown, or other
MAKNYPTVSAEYSEAVEKARRKLRALIAEKSCAPLMLRLAWHSAGTFDVSSRTGGPFGTMKCPAELAHGXNAGLDIAVRLLEPIKEEFPTLSYADFLQLAGNCGPSKSPVGP

SEQ ID NO: 83264 - DNA, 959 bp, Zea mays
  misc_feature: Ceres CLONE 1569142
  misc_feature: Encodes the peptide sequence at SEQ ID NO. 83265
  misc_feature (743)..(743): n is a, c, t, g, unknown, or other
ctccccgcggtggcggccgctctagaactagtggatcccccgggctgcaggaattcgtctcacccctagaaaaactcttttcatttcccatctctctctgcgccgtcccgtgctccctccgctagttctcccaattccttccccacctcctcggtcgtcgcctcccccagagagcaggagccgcctcgtccctgccggtcccgaccccgacccccatcccgtccgcgtccaacgccatgaatcccgagtacgactacctcttcaagctgctcctcatcggggactccggtgttgggaagtcttgcctgctgctgaggtttgcggatgattcatatctggagagctatatcagtactattggagttgattttaaaatccgcaccgttgagcaagatgggaagacaataaagctacagatttgggatactgctggccaagaacgctttaggaccatcacaagcagctactaccgtggagctcatggcattattgttgtgtatgatgtaactgaccaggagagctttaacaatgtcaagcagtggctgaatgaaattgataggtatgccagtgaaaatgtgaacaagcttttggtggggaacaagtgtgacctggctgagaacagagtagtttcttacgaggctgggcaggcccttgctgatgacatcggaataccattccttgagactagtgccaaggatgcaacaaatgtggagaaggcattcatgaccatggcaggggagatnaagacaggatggcaagtcaaccagctgcaagtggtgctagtaagcctgcaactgtgcaaatgcggggtcagcctgtttctcaacaaagcagctgctgctcttgatcgtctgtctagatcacagtagtgtggattgtgcagcaagcgaaactaaattgggtgctccggggacataaggcctttactgtccccaagactccatgtttccattcggatt

SEQ ID NO: 83265 - protein, 210 aa, Zea mays
  misc_feature: Ceres CLONE 1569142
  misc_feature (10)..(171): Pfam Name: Ras Pfam Description: Ras family
  misc_feature (10)..(124): Pfam Name: Miro Pfam Description: Miro-like protein
  misc_feature: SWISSPROT Homolog: EC 2.7.11.1 Non-specific serine/threonine protein kinase
  misc_feature (169)..(169): Xaa is any aa, unknown, or other
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAENRVVSYEAGQALADDIGIPFLETSAKDATNVEKAFMTMAGEXKTGWQVNQLQVVLVSLQLCKCGVSLFLNKAAAALDRLSRSQ

SEQ ID NO: 83266 - DNA, 915 bp, Zea mays
  misc_feature: Ceres CLONE 1569144
  misc_feature: Encodes the peptide sequence at SEQ ID NO. 83267
ctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggtagaaggccgggtcgcagatcttcagcgagggtgggctggactacctcggcaacccgagcctgatccacgcgcagagcatcctcgccatctgggcctgccaggtcgtgctcatgggcgccatcggagggtaccgcgtcgccggcggcccgctcggagaaggcgtcgaccccctctaccccggcggcagcttcgacccgctcggcctcgccgacgaacctgaagccttcgcggagctcagggggaggagctcagaaccgccgcctcgccatgttctcatgttcgggttcttcgtccaggccatcgtccccggcaagggcccgctcgagaacctggccgacacctcgccgaccccggtaaaaaaacgaaggggcctatgcaccaacttggg

SEQ ID NO: 83267 - protein, 130 aa, Zea mays
  misc_feature: Ceres CLONE 1569144
  misc_feature (64)..(128): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVW

SEQ ID NO: 83268 - DNA, 840 bp, Zea mays
  misc_feature: Ceres CLONE 1569145
  misc_feature: Encodes the peptide sequence at SEQ ID NO. 83269
  misc_feature (599)..(599): n is a, c, t, g, unknown, or other
tggagctccccgcggtggcggccgctctagaactagtggatcccccgggctgcaggaattcgtctcacccctagaaaaaactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccctcggaaatccctcgaagggactggttcccctctgacttcatctttggtgccgccacttcagcgtaccaaattgaaggtgcatggaacgaagatggaaagggggaaagcaattgggatcacttctgccacaattttccggaaaggataatggacgggagcaatgcagacattggagcgaattcgtaccatatgtacaaaacggatgtcagattgctgaaggaaatgggcatggacgcatataggttctctatctcttggcctagatactgcctaaggnaacggtcgaaggaggtattaacaggatggcatcgattactacaaaggctcatcaacttgttgctagagaatgcatagaggcatatgtaacaattttccactgggatggccttccagcactagaagaaaagtacgggcgattcttagatagactcctaaagaggattgttaatgattaccaaaccttccctaaggggggctccaacacttttggggacaagggaaaaaatgggtggacttta

SEQ ID NO: 83269 - protein, 175 aa, Zea mays
  misc_feature: Ceres CLONE 1569145
  misc_feature (63)..(176): Pfam Name: Glyco_hydro_1 Pfam Description: Glycosyl hydrolase family 1
  misc_feature: SWISSPROT Homolog: EC 3.2.1.21 Beta-glucosidase
  misc_feature (151)..(151): Xaa is any aa, unknown, or other
MNHAAHPVLRSHLGPNNESFSRHHLSSSPQSSKRRFNLSFTPRSARVGNQNGVQLLSPSEIPRRDWFPSDFIFGAATSAYQIEGAWNEDGKGESNWDHFCHNFPERIMDGSNADIGANSYHMYKTDVRLLKEMGMDAYRFSISWPRYCLRXRSKEVLTGWHRLLQRLINLLLENA

SEQ ID NO: 83270 - DNA, 1292 bp, Zea mays
  misc_feature: Ceres CLONE 1569146
  misc_feature: Encodes the peptide sequence at SEQ ID NO. 83271
  misc_feature (52)..(52): n is a, c, t, g, unknown, or other
  misc_feature (53)..(53): n is a, c, t, g, unknown, or other
  misc_feature (58)..(58): n is a, c, t, g, unknown, or other
  misc_feature (59)..(59): n is a, c, t, g, unknown, or other
  misc_feature (319)..(319): n is a, c, t, g, unknown, or other
cctgttccccgctgcgggctcatcttactttcccccctcccttacatataanncgcannttttaaaactggagctccccgcggtggcggccgctctagactagtggatcccccgggctgtcttgaattcgtctcacccctagaaaaaccacgagcaggacccaccaacccacttctgtctgcacagtgtgccgcgccgggatcaccgaacggtcgaccacacaaaacgacaatggccgcggcggcgctgcaccagaccaccagctgcctcgggcaggctctagtcgcccgcgccgccggcgtctgatgtcggaggacgnatcaccatgcgacgcaccgtaaagagcgttccccagagcatatggtactggcctgaccgccgcaagtaccttgggacgtcctccgaggagacgacgtcgtacctgaccggtgagttcaacggtgattatgggcgggacaccgcaacccccccaggagacccagagaccttcgcgcgcgaccaggagctacaggtgaacccctcccggcgggcaaagcctcagggccccttggccccctgttgccgggaaaatcccgacctaataatcggccgccaagccacggcgaaggcttatgagcgcccaaaggcccagcctaccaggatccttccctggttaggggcccggcttggttcctaccctgtgtggaaacacccaaacgcgtggtgggaacacaccccaaaagccaatgcatagggcccatgtgtgggaccgagggcacaagggtgagtggcgctcaaagcgggggtgattcccctcctaagaggggcggtaccggcgacgatctcgcggggtatagtgcccaccccacaccccgagggttgaaaaagacgccctccgcacaagagaagagtggtttaaaccccgggaggggagagagtcccccgttgtaagagatcccccgcccggggtgtcacgcccgggtcgcgacacgttagccccgtggatataaccaccccccacccagaggttccccactgggacacgaagtggaacctcgcgcgaaataacgaggcccgccactagggcacaggagcctcacttggtgttgtgaaatttctgcttccaccgacaacgtgataatattgcccacctggtggaggagtggcccccagtgtgggagaacttctgttgggaaccgcctctgtcgtatcacccccagcccattagtaacaccccgggcccatcccacgcatcagatctctttctctcctccggaggactaggtgatataagagtccgccggtaaatggtt

SEQ ID NO: 83271 - protein, 135 aa, Zea mays
  misc_feature: Ceres CLONE 1569146
MRRTVKSVPQSIWYWPDRRKYLGTSSEETTSYLTGEFNGDYGRDTATPPGDPETFARDQELQVNPSRRAKPQGPLAPCCRENPDLIIGRQATAKAYERPKAQPTRILPWLGARLGSYPVWKHPNAWWEHTPKANA

SEQ ID NO: 83272 - DNA, 775 bp, Zea mays
  misc_feature: Ceres CLONE 1569153
  misc_feature: Encodes the peptide sequence at SEQ ID NO. 83273
  misc_feature (484)..(484): n is a, c, t, g, unknown, or other
ctccccgcggtggcggccgctctagaactagtggatcccccgggctgcaggaattcgtctcacccctagaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctgggccatgcttgccgtccccgggatcctggtgccggaagctctgggcctgggcaactgggtgaaggcgcangagtgggcggccgtccccggcgggcagggcacgtaccctgggcgccccggtgccgtggggcacgctgccgaccattcctgggtgatcgaggttcgtggccatcgcccttcccggaggacccagcgcccccatgggagaaggaacccccaagaaaaaaaaaaatacccccgggggggggcccttttaaaaccccgtttggggtttttttcccaaggggacccccccccccaaaatttttttgagggggaaaaccaaaggtttctctgggggggggattttccagggaacggc

SEQ ID NO: 83273 - protein, 214 aa, Zea mays
  misc_feature: Ceres CLONE 1569153
  misc_feature (54)..(190): Pfam Name: Chloroa_b-bind Pfam Description: Chlorophyll A-B binding protein
  misc_feature (117)..(117): Xaa is any aa, unknown, or other
MVMASSSGLRSCSAVGVPSLLAPSSRSGRLAPFCANATTSGRVTMSAEWMPGQPRPAHLDGSSPGDFGFDPLGLATVPENFERFKESEVYHCRWAMLAVPGILVPEALGLGNWVKAXEWAAVPGGQGTYPGRPGAVGHAADHSWVIEVRGHRPSRRTQRPHGRRNPQEKKKYPRGGALLKPRLGFFSQGDPPPQNFFEGENQRFLWGGDFPGNG

SEQ ID NO: 83274 - DNA, 1151 bp, Zea mays
  misc_feature: Ceres CLONE 1569158
  misc_feature: Encodes the peptide sequence at SEQ ID NO. 83275
tttattccttattgcccccctatcatctataataaatttattgtggtttttatttaatatttattaaatttttggtactccccgcggtggcggccgctctagaactagtggatcccccgggctgctaggaattcgtctcacccctagaaaaactccgctaccccctcatcctgccatccaccagcagcagtgcaagcagcatatggcgcgccgtgccagcctgctcctcgccgcggcgctgctcgtctccgtcgctgccgcggcggtgccgccgacgtgcgagcgcatcgagtgcccggcgtacgaggtggtggacagcgccaacgggttcgagatcccgcggtacacgggacgccatgtggatcaccacggcgcccatcgaggacatctccttcatcgccgcgacgcccaccggcttcctccagctgttcgactacttccagggcaagaacgcgtacaacgagacgatagacaccacggcgccggtgctgacgcgggtgtcgcccagagaacggggcccttctgcgcctcccgctttcgccgggaagcttccacgtggccgggccaaaaaaaccaggcagttcccggccgccagcccgaatgggcctggggccgtggaaccgatggggccggggccaagagttacgccggcccttgccgccccctttggggggagcttcccgggggcggaacccccaaaacactacgtggggaaccagggcaggtgcgcgccccttcagatggccgagcccttccaagggttcacccccgaggtaggggcccgccccaccgtgggccatacgacaaaaaccgaagtccaagaggggcccgagaacccgtgaccttcgaccacctataaccggtaggaggccaataataaaaattgcgcccctcttgaaaggtgtcacacggggagagggtccaaaacaaaaatttaggggagtggccctaggctatagcccaacaaaaacaacggccaggacagattccttgagatggcaagtccaagagcattgtctctcggggggcacccacccggagagtgttaacaaagggcgccccaaggccaactggagctggcacaatagaatttcaaaaatataggggcgaatgtatcatttcacttgaggaaatataatggccgccgggca

SEQ ID NO: 83275 - protein, 161 aa, Zea mays
  misc_feature: Ceres CLONE 1569158
MWITTAPIEDISFIAATPTGFLQLFDYFQGKNAYNETIDTTAPVLTRVSPRERGPSAPPAFAGKLPRGRAKKTRQFPAASPNGPGAVEPMGPGPRVTPALAAPFGGSFPGAEPPKHYVGNQGRCAPLQMAEPFQGFTPEVGARPTVGHTTKTEVQEGPENP

SEQ ID NO: 83276 - DNA, 893 bp, Zea mays
  misc_feature: Ceres CLONE 1569160
  misc_feature: Encodes the peptide sequence at SEQ ID NO. 83277
  misc_feature (647)..(647): n is a, c, t, g, unknown, or other
  misc_feature (795)..(795): n is a, c, t, g, unknown, or other
agctccccgcggtggcggccgctctagaactagtggatcccccgggctgcaggaattcgtctcacccctagaaaaacttctctcgcctgcctctcccccgccgcgccgccacttcccctctcccgtcaactccggcttccgcgcgaggtcgagctagcgtttggagttctcgagacctgctgtgatggcgacagagcaagcggcggagaactacacggtggaggacctcgtggccctgaacccctacaaccccgacatcctcaacgacctcgagaagttcgtcaatgagcaggtctcatctcagacatataacttggatgcaaatctcagccttcttcgcttgtaccagtttgagccagaaaggatgagcatacagattgtggcccacatactgattaaggctctcatggcaatgccagcccctgacttcagtttgtgcttattcttaatccctgaacatgtgcaaatggaggagcaattcaaggtattgatagttctttctcactacctagagactgctaggttcagtcaattttgggatgaagcagcaaagaaccgccacatatcggaagcagtgccaggtttcgaacaagcaatccaatcctatgcgattcatgtactttccttgacataccagaaagttccanggcctattcttgtagagggcatcacatcgaaggtctcgcgttggacaaagttcttgagtacatgcccgcgactcagggtgggtgattgagaggggtggcagtctcaggtgatggttctccgcgtaatgagttcatcacccagagctcnagaagacacagccgatatccttccgttgacacgtacacgcatattcctgtccttggctgatcaggcctgctgaagatcttacaaactcgcgagtgagc

SEQ ID NO: 83277 - protein, 183 aa, Zea mays
  misc_feature: Ceres CLONE 1569160
  misc_feature (19)..(164): Pfam Name: SAC3_GANP Pfam Description: SAC3/GANP/Nin1/mts3/eIF-3 p25 family
  misc_feature (155)..(155): Xaa is any aa, unknown, or other
MATEQAAENYTVEDLVALNPYNPDILNDLEKFVNEQVSSQTYNLDANLSLLRLYQFEPERMSIQIVAHILIKALMAMPAPDFSLCLFLIPEHVQMEEQFKVLIVLSHYLETARFSQFWDEAAKNRHISEAVPGFEQAIQSYAIHVLSLTYQKVPXPILVEGITSKVSRWTKFLSTCPRLRVGD

SEQ ID NO: 83278 - DNA, 849 bp, Zea mays
  misc_feature: Ceres CLONE 1569163
  misc_feature (403)..(403): n is a, c, t, g, unknown, or other
gagctcaccgcggtggcggccgctctagaactagtggatcccccgggctgcaggaattcgtctcacccctagaaaaacgcgtcattctcctcccctccttccacccggcaaaaaccccgcgtcggccactctccggaggcgactagggtttcagcccctgggacacgccgccggtcgtggcacctccgccaccggatcccggtacccgagctacgccatcgccgccccgcccccggtcaccgccggtgcgcttccgccgacaccagacgcagctcgtccgccccgtcacgtgcacctctgcgtgggcgcgggattggatagggtttggggtttcggcggctggcgccaaatcccaccgctgctgctcgcgcaggaggtctcgagccctcggggttcccctacntcgctccggctggagttctcgatgaaacttgttctacagtgttcttctgttgcatgactcagttgttttgagttatacttcataataacaatgcaaacacaaaaaaagggtgctgcaaaaaatgcagtggggtatcatgccaatccctaggacagtaggccatccaggaagggcactcaatctacagttgctgaaaagaaagtatctgatctcatcacgtcttcttccaagagcagagacctgttgggtgtcacttccaagagcattcttaagggaggaaggaagctgctagtttcatgtgatacaactgatgctggaaatgatgcacctcaggtaccccctagcgtcttccctgatctggagggcccgcatttctgatggggttgcagatgatcgtcccaacaattccttttcttctccaacttccattcttccagggaaggggg

SEQ ID NO: 83279 - DNA, 1048 bp, Zea mays
  misc_feature: Ceres CLONE 1569164
  misc_feature: Encodes the peptide sequence at SEQ ID NO. 83280
  misc_feature (167)..(167): n is a, c, t, g, unknown, or other
  misc_feature (168)..(168): n is a, c, t, g, unknown, or other
  misc_feature (229)..(229): n is a, c, t, g, unknown, or other
  misc_feature (483)..(483): n is a, c, t, g, unknown, or other
  misc_feature (522)..(522): n is a, c, t, g, unknown, or other
  misc_feature (541)..(541): n is a, c, t, g, unknown, or other
  misc_feature (542)..(542): n is a, c, t, g, unknown, or other
  misc_feature (716)..(716): n is a, c, t, g, unknown, or other
  misc_feature (717)..(717): n is a, c, t, g, unknown, or other
  misc_feature (747)..(747): n is a, c, t, g, unknown, or other
  misc_feature (854)..(854): n is a, c, t, g, unknown, or other
  misc_feature (875)..(875): n is a, c, t, g, unknown, or other
  misc_feature (878)..(878): n is a, c, t, g, unknown, or other
  misc_feature (898)..(898): n is a, c, t, g, unknown, or other
  misc_feature (918)..(918): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (940)..(940): n is a, c, t, g, unknown, or other
  misc_feature (946)..(946): n is a, c, t, g, unknown, or other
  misc_feature (950)..(950): n is a, c, t, g, unknown, or other
  misc_feature (952)..(952): n is a, c, t, g, unknown, or other
  misc_feature (958)..(958): n is a, c, t, g, unknown, or other
  misc_feature (960)..(960): n is a, c, t, g, unknown, or other
  misc_feature (963)..(963): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (972)..(972): n is a, c, t, g, unknown, or other
  misc_feature (973)..(973): n is a, c, t, g, unknown, or other
  misc_feature (974)..(974): n is a, c, t, g, unknown, or other
  misc_feature (975)..(975): n is a, c, t, g, unknown, or other
  misc_feature (976)..(976): n is a, c, t, g, unknown, or other
  misc_feature (978)..(978): n is a, c, t, g, unknown, or other
  misc_feature (979)..(979): n is a, c, t, g, unknown, or other
  misc_feature (980)..(980): n is a, c, t, g, unknown, or other
  misc_feature (981)..(981): n is a, c, t, g, unknown, or other
  misc_feature (982)..(982): n is a, c, t, g, unknown, or other
  misc_feature (984)..(984): n is a, c, t, g, unknown, or other
  misc_feature (985)..(985): n is a, c, t, g, unknown, or other
  misc_feature (987)..(987): n is a, c, t, g, unknown, or other
  misc_feature (988)..(988): n is a, c, t, g, unknown, or other
  misc_feature (1013)..(1013): n is a, c, t, g, unknown, or other
  misc_feature (1015)..(1015): n is a, c, t, g, unknown, or other
  misc_feature (1019)..(1019): n is a, c, t, g, unknown, or other
  misc_feature (1020)..(1020): n is a, c, t, g, unknown, or other
  misc_feature (1024)..(1024): n is a, c, t, g, unknown, or other
  misc_feature (1027)..(1027): n is a, c, t, g, unknown, or other
  misc_feature (1029)..(1029): n is a, c, t, g, unknown, or other
agctccccgcggtggcggccgctctagaactagtggatcccccgggctgcaggaattcgtctcacccctagaaaaaagagcatagagctagcaatacatcgctagctcacttgatatacatattgcatcggcataaaaactgaatttaccatggcccacttgatctnnctctgcatcgcaggcgcgggcaacttggtcgctgatggaatcagtgttgtcacctgcgtancgtccaagttgtaaaaggggtaaaggaactttagggcgtttcctaaaaaccttccacaaggggtcaaagttaagaccccccggtatttcccaaaaatccgggttttaagggaaataaggtcttcccgggggcccaaaaataaaagcccccccccccccttttttctcaaaaaaatggggacccccggtgtggtttcctcccccccccccccgtgggaccccgaggggggggggtctttaaaaaacccctctccntttggtggggggggggcccccctttggggggtggcggcnaaaaaaaaacccccccccnncccccccccgtctctgttggagaaaaaaaaaaaaaaggaggggggggggggggggccccacaaaaaaaaaaaaaaacctcctctttttttttttaaaaaaaacagagggggagatcgggcgccccccccccccccccccggggggggggggggggggggggagagaaacaaaannccccctgcccctccctcatataaaataaancacccccgcgggggggggggggagaaaaaaaaaaaacaccccccgcgcgggggggggggggggggggcgcccgccccccccccccccccccccccccccccgggggnaaaaaaataataaaataagancgnggggggggggggggggttgntttttttttttttttttttnttnnnnnntcccccccccccgngcgcgngcgngnaaaggnanaanannnnnnnnnnnncnnnnncnncnnccccccccccccccccccccccccncncccnntaanttntntatgttgataagagttggc

SEQ ID NO: 83280 - protein, 30 aa, Zea mays
  misc_feature: Ceres CLONE 1569164
  misc_feature (6)..(6): Xaa is any aa, unknown, or other
  misc_feature (27)..(27): Xaa is any aa, unknown, or other
MAHLIXLCIAGAGNLVADGISVVTCVXSKL

SEQ ID NO: 83281 - DNA, 983 bp, Zea mays
  misc_feature: Ceres CLONE 1569167
  misc_feature: Translation starting site: 370
  misc_feature (515)..(515): n is a, c, t, g, unknown, or other
  misc_feature (543)..(543): n is a, c, t, g, unknown, or other
  misc_feature (669)..(669): n is a, c, t, g, unknown, or other
ctccccgcggtggcggccgctctagaactagtggatcccccgggctgcaggaattcgtctcacccctagaaaaacccacccacaaagagataggcggatagcgtctatccccaatcctcccgccgcggcgacgccttcccctccctccttcctccgtcccatgctccgccgctgacacgttcgcccgacttaaccttacgatggccgccgccgcctccgccatcaccgccgtctccggcgttgtgcttccccaaaccttcctatcccaccgattgccgccgccgcaggtcctagccgtggcctcctcattccgccggctctccttgtgcgcttctcctcaccggatcactcacataatcccccgcgctgatgcaagtgccgaagctggagaaccggagcctgccactgcttcagctgaatccgaagaggagggtggccgatggatctgtcgctgtggcggatgcggatgaaccgacgccgccgagcaagccgtaaggtaagttcggcgaaataantggggatctgaataagcagttcattganggaggctgagaaagggaagacctgtaccgggatctgaggcctgggcgatatcattggagcttatgatgcaacggcccaacaaaaagagattggtcgctccttaaagggcatatcatcgcaaagcancaaagctggtggtcacaaccacaatcccgtgtcagaaggatcattgcctggtgtaaggagttgagattaccctccccgtgtactccacccaggatcaaggaaatccacggtatcaggcacaggaaagggaggggaagcaaaggtggtactacctgaaagacaagcttccccgcttttcaacttcaaggggaatccgatatgccggacagaacaacttttccaccaacatctcgagtcccctttaaacctttttttcacctccctatcgataccaccataattcaccggaacccccggggtacagattgtaaatt

SEQ ID NO: 83282 - DNA, 933 bp, Zea mays
  misc_feature: Ceres CLONE 1569168
  misc_feature: Encodes the peptide sequence at SEQ ID NO. 83283
ctccccgcggtggcggccgctctagaactagtggatcccccgggctgcaggaattcgtctcacccctagaaaaagtgggaggggaaggtggcgtcggcggtggccgaggcgacggcggacgaggcgtgggcgctgctgtcggacttcctggcgttccaccggtggcacccgcgcgtggccgcgtgccgcctcgcgtccggcaccccgcgcgcgccgggctgcgtgcgctactgcgagggcaccgccgccgccgacggcgagccggcgcccgactgggcgcacgagacgctgctggagcacgacgcggagcgccgcttcttccgctacgagatgaacgacaacaacatgggcttcggcctcttcttcgccacgttccgcgtcgtcccggccgccgccgccggcgggtgcgagctgcgctgggagttcgagtgcgagcccgtgcgcggcacgcccagggacgcgctcgtggcgcgcctgcaggccgggctcgacggcatggcggcgcgcgtgcgtgaccacgtcctcgccgctcgcgccgcccctgccgtggtgcccgccggtgcaagtgagctcgtcgtcgtcaagctcgacagctccatcgccgccgtctgatcactggctggcgcggcgtctacggcgattcaacacgtaccaactaagagaccgccggtcgctggtgctctctcctctgtctgctcacgcgcgccacgctgtcgctgcccatcgtgttttcgtttcctatctcttcgccggcggggttttaacctccttggctggggccgggtgctgctgtctcgtctccatatttacccgcccctgcatagattattgcatgcatggagtataaccggggtccggtttttaccccctcaccccctggggatttattaaattaccctggagcctgtccgggaacaaaaatggcgttcctgg

SEQ ID NO: 83283 - protein, 93 aa, Zea mays
  misc_feature: Ceres CLONE 1569168
MNDNNMGFGLFFATFRVVPAAAAGGCELRWEFECEPVRGTPRDALVARLQAGLDGMAARVRDHVLAARAAPAVVPAGASELVVVKLDSSIAAV

SEQ ID NO: 83284 - DNA, 800 bp, Zea mays
  misc_feature: Ceres CLONE 1569169
  misc_feature: Encodes the peptide sequence at SEQ ID NO. 83285
  misc_feature (1)..(1): n is a, c, t, g, unknown, or other
naaagctggagctccccgcggtggcggccgctctagaactagtggatcccccgggctgcaggaattcgtctcacccctagaaaaagtcaaaccttgcaaagagagttcggtcgacggcgccagccggcgatggcagcgccgcgccaccgccagggccacattgcgcagtgccttggcaggatcctcgcctgccgcggcagcgccaccgccgccgtcgctgccggcccaggcggccgacggctcaccggcgcggagttcgtcgacggcgtgcggagcctggccgctggcctcgccgaccgcggggtgcgccctggccacgtcgtcgccgccgtcgccctcaacagcgtcgagtacgtgcagctgttcctcgccgtcacctacgccggagccatcatcggcccctctcaactaccgctggggtgcgtgcgtgctccctcacttcatctcccttttctcggttcttacagcacacagcactcactccggcaaagagtgcaagtaagtttcgtcgtcgtctccccctgttctggagcaaaacttccaggaggcgggcccaggggggggaagctcgtggcggcccaaaggggtttcgccctttcaaaggggcgttttaagctccctgggggcctttcggccttaagggaagggcggaaaaagggtttccccatatcaaagggggcccttttaaacctcccttccccggggggggaaaactcctttttcaaggaaaacccgggcccccccctttttttttttaaagggggtttgtgtggctccttttcacccccctctttataccc

SEQ ID NO: 83285 - protein, 223 aa, Zea mays
  misc_feature: Ceres CLONE 1569169
  misc_feature: SWISSPROT Homolog: EC 6.2.1.12 4-coumarate--CoA ligase
MAAPRHRQGHIAQCLGRILACRGSATAAVAAGPGGRRLTGAEFVDGVRSLAAGLADRGVRPGHVVAAVALNSVEYVQLFLAVTYAGAIIGPSQLPLGCVRAPSLHLPFLGSYSTQHSLRQRVQVSFVVVSPCSGAKLPGGGPRGGKLVAAQRGFALSKGRFKLPGGLSALREGRKKGFPISKGALLNLPSPGGENSFFKENPGPPLFFFKGGLCGSFSPPSLY

SEQ ID NO: 83286 - DNA, 940 bp, Zea mays
  misc_feature: Ceres CLONE 1569172
  misc_feature: Encodes the peptide sequence at SEQ ID NO. 83287
  misc_feature (897)..(897): n is a, c, t, g, unknown, or other
ctccccgcggtggcggccgctctagaactagtggatcccccgggctgcaggaattcgtctcacccctagaaaaaagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggcccccgtgaggatgccacccgtattggttccgctggtgttgtgagaaggcaggccgtggatatctcacccctgaggagggtgaaccaggccatctacctcctcaccactggtgccagggagagtgctttccggaacatcaaaaccattgccgagtgccttgcagatgagctgatcaacgctgccaagggctcatccaacagttacgccatcaagaaagatgagcgtggtgccaaggccaaccgttgaacggagcttgtatcctggtgcactctgcgctgggaaactttatgttgctggcagtcgtatcggttcctggtttaccaatgtttagagtttttgaagactatatgcgggtttgggtttcagtgcacatttaaattactgagtatgtangtgatggggaacagaaaggcctggtttaccgactcatttctcc

SEQ ID NO: 83287 - protein, 196 aa, Zea mays
  misc_feature: Ceres CLONE 1569172
  misc_feature (44)..(196): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRRQAVDISPLRRVNQAIYLLTTGARESAFRNIKTIAECLADELINAAKGSSNSYAIKKDERGAKANR

SEQ ID NO: 83288 - DNA, 944 bp, Zea mays
  misc_feature: Ceres CLONE 1569174
  misc_feature: Encodes the peptide sequence at SEQ ID NO. 83289
  misc_feature (673)..(673): n is a, c, t, g, unknown, or other
  misc_feature (792)..(792): n is a, c, t, g, unknown, or other
  misc_feature (793)..(793): n is a, c, t, g, unknown, or other
  misc_feature (841)..(841): n is a, c, t, g, unknown, or other
ggagctccccgcggtggcggccgctctagaactagtggatcccccgggctgcaggaattcgtctcacccctagaaaaaaagtccggagcaacagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgtcctctccgtcgtctcattcccgcacctgtccctccccgcctcgtcccatccgctcccgcaggaagctgctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgtccccgcggagctccgcggacgcggtgagcctcgcgttcggggacgcgtaccgcaacgaggtgtacgcggcgacggtgacgccgcggcgcgggttcgagcgctgcgccacggacacgttccgcgtcgccgggccctgcggctacggcgtctgctacctctacatgcgccggtcgggccgcgccgccgggtggacgcccgagtgggtcaaggtgtacgangcggcgtccggcgcgccctccaccttctactacggcgacccgctccccgacggcgtctggtacggcttcgaccgctgcgtcaagggcgggggcggcgcctctgccgagcatggtgccgnnggcgcgaccctgtgacggacgggacgcgaccccgccggtctctgggcnacaggcgaggtacaaaacgcacctcgtgcgcgcggtctgctgccgggtcaacgatgatgcctgggcacggctctctttctgggaagtggaggaattctttcgg

SEQ ID NO: 83289 - protein, 200 aa, Zea mays
  misc_feature: Ceres CLONE 1569174
  misc_feature (53)..(182): Pfam Name: ATS3 Pfam Description: Embryo-specific protein 3, (ATS3)
  misc_feature (156)..(156): Xaa is any aa, unknown, or other
  misc_feature (196)..(196): Xaa is any aa, unknown, or other
MASGAVPPQRVALLALAVLSVVSFPHLSLPASSHPLPQEAAAAAAAGAAAGGEASEPHGTAADGAAVARRACTYTVQIKTSCASPRSSADAVSLAFGDAYRNEVYAATVTPRRGFERCATDTFRVAGPCGYGVCYLYMRRSGRAAGWTPEWVKVYXAASGAPSTFYYGDPLPDGVWYGFDRCVKGGGGASAEHGAXGATL

SEQ ID NO: 83290 - DNA, 926 bp, Zea mays
  misc_feature: Ceres CLONE 1569175
  misc_feature: Encodes the peptide sequence at SEQ ID NO. 83291
  misc_feature (377)..(377): n is a, c, t, g, unknown, or other
  misc_feature (677)..(677): n is a, c, t, g, unknown, or other
  misc_feature (853)..(853): n is a, c, t, g, unknown, or other
  misc_feature (897)..(897): n is a, c, t, g, unknown, or other
ccccgcggtggcggccgctctagaactagtggatcccccgggctgcaggaattcgtctcacccctagaaaaagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatccccccccgccttaaagaggggggggggatgcncgggcgcaacaacggcaaaaaagtcatggctgtccgcatcatccagcataccccgggagatcattcacctgccccccgatgccaaccccatccaggttgtgcgtcgacccaataataaaaaggggcccccgcgagggatgccccccccattggttcccccgggggttgtggaaaaaggaagcgcccgtaaatatcctcccccggaggagggggaaaaagggcatttttccccccccccacgggggggcgggaaaaagagctttccgaggcagtacgagcggggggcgggggtgggtgggnggggagtgtgtgggggggggcccgggggtttggccggcgtgtgcggtcgcgctggaaatgtgtgttgggcgctgcccgccctggccgcgataagttcgcaggtgttggttgtcgtgccatgccctgttgtggcttgcatgccggtgatccctggggggggcctacggtagtcgtgnatttctggcgctgtgtataacagcggtgcgttgatgtgcgggcngtccgaggttgtgtttcgcgcggagtacc

SEQ ID NO: 83291 - protein, 111 aa, Zea mays
  misc_feature: Ceres CLONE 1569175
  misc_feature (74)..(74): Xaa is any aa, unknown, or other
MAEVEQQQDTPKLFNRWTFDDVQVNDISLNDYLAVNATKHAMYLPHTAGRYSKKRFRKAQCPIPPRLKEGGGMXGRNNGKKVMAVRIIQHTPGDHSPAPRCQPHPGCASTQ

SEQ ID NO: 83292 - DNA, 978 bp, Zea mays
  misc_feature: Ceres CLONE 1569176
  misc_feature: Encodes the peptide sequence at SEQ ID NO. 83293
  misc_feature (742)..(742): n is a, c, t, g, unknown, or other
  misc_feature (809)..(809): n is a, c, t, g, unknown, or other
  misc_feature (856)..(856): n is a, c, t, g, unknown, or other
  misc_feature (865)..(865): n is a, c, t, g, unknown, or other
  misc_feature (915)..(915): n is a, c, t, g, unknown, or other
  misc_feature (916)..(916): n is a, c, t, g, unknown, or other
  misc_feature (921)..(921): n is a, c, t, g, unknown, or other
  misc_feature (936)..(936): n is a, c, t, g, unknown, or other
  misc_feature (938)..(938): n is a, c, t, g, unknown, or other
  misc_feature (946)..(946): n is a, c, t, g, unknown, or other
ctccccgcggtggcggccgctctagaactagtggatcccccgggctgcaggaattcgtctcacccctagaaaaaagagagaaaggaagagaagggggcggagaagcacgtacgtcgtacatcgcccaccgccctttgcctcgcctcgcctcgcctcgcctgcatatctaacagccggagccggagccggagccggagccgacgccggcgccgacaatcgttccaactgatatggctacgacgccaccaggattcacgggcaacctgaagaaagcacttgcaggtctgagaagaatcagtttagatgggttgcgatggcgcgtatttgatgctaagggtcaggtgctcgggcgattggcttcccaaatagctgttgtgcttcaaggcaaggataaaccgacctatgcaccacatgtagaaaatggagacatgtgcattgtacttaatgcaaaggatatcagtgttacaggaaggaaaatgacagataagatttactattggcatacagggtatgttggccatttgaaggaaaggaggctcaaggaccagatggagaaagacccaactgaagtgattcgcatagctgtgttgcgcatgcttccccgcaacaaactgcgtgatgatagggatcgcaagctgaggatattttctggaaacgaacatccattccatgaccgccctctggtatcttttgtgatgccgccacggcaagtacgcgagatgcgcccccgtgcaaggcgtgncatggataggggctcagataaacagctggctaacagagcccaagaggaggaatgatgctagatgccngcagcgaggcactgcataggctcctgatgtgggattgcatgctgccnattttttgnctggtagcatttcgaggggaatagcacctaaagctgggaatgtgcacctnncgtcngaattaatttggatncnattacaanttgtaacgggaaccctgcctgccaactgctta

SEQ ID NO: 83293 - protein, 188 aa, Zea mays
  misc_feature: Ceres CLONE 1569176
  misc_feature (29)..(156): Pfam Name: Ribosomal_L13 Pfam Description: Ribosomal protein L13
  misc_feature (171)..(171): Xaa is any aa, unknown, or other
MATTPPGFTGNLKKALAGLRRISLDGLRWRVFDAKGQVLGRLASQIAVVLQGKDKPTYAPHVENGDMCIVLNAKDISVTGRKMTDKIYYWHTGYVGHLKERRLKDQMEKDPTEVIRIAVLRMLPRNKLRDDRDRKLRIFSGNEHPFHDRPLVSFVMPPRQVREMRPRARRXMDRGSDKQLANRAQEEE

SEQ ID NO: 83294 - DNA, 864 bp, Zea mays
  misc_feature: Ceres CLONE 1569177
  misc_feature: Translation starting site: 569
tccccgcggtggcggccgctctagaactagtggatcccccgggctgcaggaattcgtctcacccctagaaaaaaccacaccagccaatgggtgaacctaaacccccacgccccactcagtccagccgaccagccaccctcaccatgcctcgccgcgcaggagccgcctggccatgcttcctcctgctccacattatcgcccacctacacctcgccgtcaacgccgccgacgccgacgctctgctcaccttcaagtcctccctcgaccgctccgaccgcctcccgtggcgccccgacacggcgcccgctttcagcgcctcctggcccggcgtgcgccagtgcgcccccgccggccgcgtcaccaagctcgtcctcgagggcctcaacctgacgggctccctcaccggcgcgctcctcgccccggtggccgagctgcgggtcctcagcctcaagtccaacgccctcacaggccccatcccggaggccctcccgcgcgcgctcccaaatctcaagctgctgtacctcaccgacaagcgggctccagggccgcggtccccgccaccctcgccatgcttcaacggggccaccggcataatgcttctccgggaaccgactcacgggggcagaatccgcccttcccttggcggcctgccaagccttgacctccctgggtcgttgacgcaaacatgttaccgggggccgggccccccacttggcccacctaacccctcaggggccttaaaggttccggccataccgcctgtaggggggaaatcctcggctttgtttgacggaaggggtccaaccccctctgggtttcctccccaaaggccgggcttttttcggggtttccttaaaaccatca

SEQ ID NO: 83295 - DNA, 922 bp, Zea mays
  misc_feature: Ceres CLONE 1569178
  misc_feature: Encodes the peptide sequence at SEQ ID NO. 83296
  misc_feature (768)..(768): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (884)..(884): n is a, c, t, g, unknown, or other
ctccccgcggtggcggccgctctagaactagtggatcccccgggctgcaggaattcgtctcacccctagaaaaaacccacgcacactcttctccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggacgccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgaaggcggggtcgagaccggcgccgtggccaccgcctacgtcctggagagctcacccccgtgatcgacggcagcagtactacgccgtgtccgtgctcaccaggacggctgacggcgacgatgtcngcaagctacagctcatcgcggccaacgtctccgacgcaagctctacatctcaaggcgcaggcgggcgacagaagtggtcaggcccccagtatggagtcaaaatgcnnnctcctccntcagggggcaagaagaggtattttattcttcgaaggaa

SEQ ID NO: 83296 - protein, 193 aa, Zea mays
  misc_feature: Ceres CLONE 1569178
  misc_feature (57)..(191): Pfam Name: PsbP Pfam Description: PsbP
MASTSCCLLHQSTARLGASPRLAAAPPRSAQLLVCKARKQDAAADQSDVSRRAALALLAGVTAAAGAKVGPAAAAYGEAANVFGKPKASTEYIAYSGDGFKLLIPSKWNPSKEREFPGQVLRYEDNFDANSNVSVIIQPTSKKTIADYGSPEEFLSQVDYLLGRQAYGGKTDSEGGVETGAVATAYVLESSPP

SEQ ID NO: 83297 - DNA, 834 bp, Zea mays
  misc_feature: Ceres CLONE 1569179
  misc_feature: Encodes the peptide sequence at SEQ ID NO. 83298
tccccgcggtggcggccgctctagaatagtggatcccccgggctgcaggaattcgtctcacccctagaaaaaaaactgtgctgcctgcgtgtgtgccttctttcttgcctctcccttcttcaacctttgctagcttgccagggagggagagtccatgaattccagcagaagcctcctctcttcgcccctctttgctagctcgtctccaaacttcaggagcagtgcttccgtctcctcctccccatccccatcccgcaccacagcagttccaatgatacatgacaccagcagcagcagagcatccacggcgtgccactactcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcattgaagaggatgatgatgatgattctgtttcggagagctcttcagcatcattggccaaaccagctggaactttggatcttggcaagctgacagaggaaccacagcctcaccgcagtgtggatcaaaaccattcgtatgatcaagtgtttattagatccactcggttactggagaggagatcaaagaaacgcaacggcggccacagggctttggataatggtgtggcgtgcagtggtgtgaactcaaagagaaagacaagtttggcagaagtcttgatcagacgagccttttaggtgggttt

SEQ ID NO: 83298 - protein, 184 aa, Zea mays
  misc_feature: Ceres CLONE 1569179
MIHDTSSSRASTACHYSPSLVAEEQLHGSKDTLTLKGEKALLELLLGMALDQHVDGRKLITQQEAEDSDFESYLREATSRVLYQPTFIEEDDDDDSVSESSSASLAKPAGTLDLGKLTEEPQPHRSVDQNHSYDQVFIRSTRLLERRSKKRNGGHRALDNGVACSGVNSKRKTSLAEVLIRRAF

SEQ ID NO: 83299 - DNA, 893 bp, Zea mays
  misc_feature: Ceres CLONE 1569180
  misc_feature: Encodes the peptide sequence at SEQ ID NO. 83300
cctcggtggcggccgctctagaactagtggatcccccgggctgcaggaattcgtctcacccctagaaaaagcacatcctcctcctgttgccgctcgctcgccgtgccgcaatggctacggccgtcgcctcccatacgttgctctcctccgccttcgccccgcgccactaccaccgccgcctgacccggaccgcgtccgtggggccgcgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgagaacacatggtatgttgttgatgcaacagacaagatcctaggcaggctagcatccaccattgcagtacatatcagggggaaagaatgaacccacttacacccctagtgtagacatgggagccttttggtattgtgggtcaatgcaaaataaggttgcctgtttctgggaaaaaagcggtcacaaaacctttttaggaggcacctcccgaaagggccggaagggattaaaaaaaaaaacttttggaccaaccttcagaaaaaaaattccccaaaagaatcccttgaaacttgcgggtttccggggcctgcccccccaagggaaggggctggaaaaaaaatttttttctccccccccccggggttttacaagggggacagaaaacccgcccccgaagggccaaaaaaactgggcccaccctcccggattgggggttataaaaaatccaaaaaccgggggaaaagaaatttctcccccccgaaaaaaggaatcccggggcgaattccc

SEQ ID NO: 83300 - protein, 121 aa, Zea mays
  misc_feature: Ceres CLONE 1569180
MATAVASHTLLSSAFAPRHYHRRLTRTASVGPRRAAPVGLAVRCEKSDKQKRQPLAALVPREQRFMFEGDELCGPDIWNTTWYPKAADHVTTENTWYVVDATDKILGRLASTIAVHIRGKE

SEQ ID NO: 83301 - DNA, 936 bp, Zea mays
  misc_feature: Ceres CLONE 1569182
  misc_feature: Encodes the peptide sequence at SEQ ID NO. 83302
  misc_feature (622)..(622): n is a, c, t, g, unknown, or other
ctccccgcggtggcggccgctctagaactagtggatcccccgggctgcaggaattcgtctcacccctagaaaaaattgcgattgcgagtcctccaaaccatggcgctcgccctggcctctccaatggcgtctctctccttccactccgggaggatctcggcggcgtctatcggaggcgtcggccgcactcgcagggcggccccggtgggcgtatccgcctcgccgttcctccggagctccttcgtctcgtcctcctccacgtcgtccgcctccgcctccgcctcccccgcttcgctcgcggcggctgtctcggcgtctctggcatttacgtcctcctccgcgtttgcgggttcatctttgggaatcgagttcagctacagtataatgacaacacggagatcccgtggtatgcagattagggctggaaaggctgccctctgcatgaccaagaggtcaaggtctaggaagtcacttgcccgtacacatggtttccgcaggcggatgcggactactcctggaagggaggtactgaagcgcaggcgcgccaaaggcaggaaggttctttgcacaaggacaaactcaaacagtgggaaagaaaagaatgttctaattacactgccantttgatgtgctccccaactggtaggtgtatggtctacttgcaaatcttctaaagccgccatctatggtgtacaatcatgtagcatcctatttctggtttaatgggttaaaaatatctggatcacccttcgggctcaaaaaaaaaaaaaaaaaaccagacccccgaagggtcccaatttcgccctttgggggaggcgtattagcccgcctcccgggcgcgggttttttcaacgccgggacgtgggaaaaccctggggtttacccaattttattcaccttgggaaaaatccccctttcccccgtgtgggatataag

SEQ ID NO: 83302 - protein, 174 aa, Zea mays
  misc_feature: Ceres CLONE 1569182
  misc_feature (116)..(157): Pfam Name: Ribosomal_L34 Pfam Description: Ribosomal protein L34
MALALASPMASLSFHSGRISAASIGGVGRTRRAAPVGVSASPFLRSSFVSSSSTSSASASASPASLAAAVSASLAFTSSSAFAGSSLGIEFSYSIMTTRRSRGMQIRAGKAALCMTKRSRSRKSLARTHGFRRRMRTTPGREVLKRRRAKGRKVLCTRTNSNSGKEKNVLITLP

SEQ ID NO: 83303 - DNA, 872 bp, Zea mays
  misc_feature: Ceres CLONE 1569183
  misc_feature: Encodes the peptide sequence at SEQ ID NO. 83304
  misc_feature (457)..(457): n is a, c, t, g, unknown, or other
  misc_feature (484)..(484): n is a, c, t, g, unknown, or other
  misc_feature (486)..(486): n is a, c, t, g, unknown, or other
ggagctccccgcggtggcggccgctctagaactagtggatcccccgggctgcaggaattcgtctcacccctagaaaaactcgtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcctctccccaccacgtcgctctacgtgggcgacctggagggggccgtctcggactcgcagctgtacgaactcttcagccaggcgggggagggtggtgntcggtgcgcgtctcgcagggatgtcancntcgcggccgctcgctcgggatacgccctacgtcaactacaggcatcccccttggatgctgcgagagcatttggaaagtgcttgacctttgctgctcttaacaacaagcctaatcccgggggaggttttttcaaaccgggatccagccagccccagggagtggaacttgcctaaattttttcttaaaaaaactctggcaggccatttgacaataaaaacccttcatgagacccttttttttcatttgggagcccttctccccctctaaaaggaggcccccggataaaacaggccatccccaaggggtttttggttttttttttcacccggcacaaaaaaaaaaagttcgccccgaaaccctttaaaaaaggtttatcgggggggggg

SEQ ID NO: 83304 - protein, 128 aa, Zea mays
  misc_feature: Ceres CLONE 1569183
  misc_feature (62)..(62): Xaa is any aa, unknown, or other
  misc_feature (71)..(71): Xaa is any aa, unknown, or other
  misc_feature (72)..(72): Xaa is any aa, unknown, or other
MSAQVAVVPNGGPGAVPAVVSPGAVGVAQPLPTTSLYVGDLEGAVSDSQLYELFSQAGEGGXRCASRRDVXXAAARSGYALRQLQASPLDAARAFGKCLTFAALNNKPNPGGGFFKPGSSQPQGVELA

SEQ ID NO: 83305 - DNA, 828 bp, Zea mays
  misc_feature: Ceres CLONE 1569185
  misc_feature: Encodes the peptide sequence at SEQ ID NO. 83306
  misc_feature (715)..(715): n is a, c, t, g, unknown, or other
tggagctccccgcggtggcggccgctctagaactagtggatcccccgggctgcaggaattcgtctcacccctagaaaaagcctcgtgccctcctcctcctcctcctcccagatctcgtgaccattgccattccctccctccgctacacgccgagcgcccccgtccggaccaggcgtctccgcggctcctagtcctcgctccctccctctcccgtggaggactgccgcggggcggcgagggagaggagatccgtcggtgctggctgctggttggtcggctggtcaatccctttccatcgtttgctggtgcgtgagctcagggtttggacagtttggccccgtctgttgcggattggacccggactggattgggttcgtgtggctgccgcgtcggcgggtgctgattccagcttgtcccctcccccctagattgcgcgagacggtgcttcaggactgccccctggcgcggaggccgcacaggctcggcggcgccggcggcgagatgaagggcgcgaccatcccttcggtcgcgatcatgccctcgccgctcttcctctggcggtttaaggttgtgttgtttcttctatggggcttatgttgttgcaagataagttgggactcggttatgagaatgagtgttgatctcagagacttatttctttatgaggctttcttgtactataatccctctcttcttgtggccttgatgatttggntgtggggagtaaatctatgggtttttgcacatcatctgtgaattattgcaaaagtgtttgatcttccacaacacatttatctcacgaaaaggatatggaggtgtgctacttgt

SEQ ID NO: 83306 - protein, 84 aa, Zea mays
  misc_feature: Ceres CLONE 1569185
  misc_feature (72)..(72): Xaa is any aa, unknown, or other
MKGATIPSVAIMPSPLFLWRFKVVLFLLWGLCCCKISWDSVMRMSVDLRDLFLYEAFLYYNPSLLVALMIWXWGVNLWVFAHHL

SEQ ID NO: 83307 - DNA, 926 bp, Zea mays
  misc_feature: Ceres CLONE 1569186
  misc_feature: Translation starting site: 141
ctcaccgcggtggcggccgctctagaactagtggatcccccgggctgcaggaattcgtctcacccctagaaaaaccttcacgatacgcacccaccagaggaaaagggcaaaagccaaaaggcatcaccgccgcgacgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcggaaccagtgcccgaccatcgacggcgggcgggaagtcgttcccggttcaagggcggcaagtacccaaatgaaaaaacctgggcctgggaggccaacctcccttccccgtcaaaggggggaggggcttcgcccaaaaaacgcccccgccccgagttcccagaagaaacaaaacttcttgaccccgcctcccccttacaccccgggaacaaaaatccaagggcgccgcctccgaggtggggtccccaacggcccccttcaaatttattaaggaaaaagaaagggtttcaattttccccccgctgcacccggggagatctccgggggggggaaggtcttcccctttctcctccccgggaagaagagtgtggtcgcccccggaaaaccccaaatatttttgggggccttcttctgggtgcagaataagggggggctctccttctcgggacgccagagggggggggg

SEQ ID NO: 83308 - DNA, 846 bp, Zea mays
  misc_feature: Ceres CLONE 1569187
  misc_feature: Translation starting site: 370
  misc_feature (655)..(655): n is a, c, t, g, unknown, or other
ctccccgcggtggcggccgctctagaactagtggatcccccgggctgcaggaattcgtctcacccctagaaaaaaggggccttggcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagagccaatctgcccgtgactgccagtgagttgctcgggtgtggtggttagttgaggtcacgatgatgggaggcgggctgatgatggatcagagcgtggtgttccctggcgtccacaacttcgtggatctcctgcagcagaacggcgacaagaacctgggcttcgcctcactcatgccgcagacgtcctccggcgaccagtgcgtgatgggggagggtgatctcgtggacccaccgccagacagcttcccggacgccgtggaggacgacagcgatgacgacgttgaggacatcgaggagctggagcgccgcatgtggcgcgaccgcatgaagctgaagcggctcaggnagctgcagcagagccgcggcaaggatcccatggctagcggtggggggctggccgacggctcatcaagccaaggcagtcgcaggagcaggccctgcgcaagaagatgtcgcgcgcgcaggacggcatccttcagtacatgctcagaatgatggaagtgtgccgcgcccagggggttgtgtacgggatcattc

SEQ ID NO: 83309 - DNA, 998 bp, Zea mays
  misc_feature: Ceres CLONE 1569191
  misc_feature: Encodes the peptide sequence at SEQ ID NO. 83310
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
nnnnnnnnnnnnnnnnnnnnnnnnnnnnnnaaaaaannnnnnnnnnnnannnnnnnnannnnnnnnnnnnnnnnnnnnnnnnnnnnnnngcttnnnnnttaatgctgggactccccgcggtggcggccgctctagaactagtggatcccccgggctgcaggaattcgtctcacccctagaaaaagtagcgggacgaactcgtcactggtgtgggccgtggctgtacgccgcagagtgaagcgagacgagacgacgatgcgcaagtgggcgctctcctccgcgctcctcctcctcttcctcctcaccaccctccccgacccagctaagaagctacaggtgaatgcggaagagagcagcgatgacttagctaacccacccaaggtagaggagaagcttggtgctgtccctcatggcctgtccaccgactctgaggttgcccagaggggagctgagtctatctctaggaagactcttaggagctccgccgaagaagtttgagttcccaggctgaagtgtcccagactcagggacttcatcatcaaatcactcctacagcaaacaagggattttccttccctggagggaacctccatatcccaatggcccccctgaaaggctttggaaaaaaaaaaccggggtttccctttcccccctttacgggaaaaaaggaaaaattccccgggggggaaaaaaggggaaaccccggcccaaaaaacccttgggaaaattcccaaaaaatttaaagttggggggcccaaggggggaaaaaaaaaaaaccccccctccccactttcccgggaaaaagggggggtttatttgggtttttgggcccccaaagagggggaaatcttttttttttaaaaaaaacccctggggggaaaaacattttggaaaaaaaaaggggggggcacctctctccccccctttttgtggggggaaaaaaaaaaaccccccccccgggggggggggggcgcacccccccatttttttttttgggg

SEQ ID NO: 83310 - protein, 80 aa, Zea mays
  misc_feature: Ceres CLONE 1569191
MRKWALSSALLLLFLLTTLPDPAKKLQVNAEESSDDLANPPKVEEKLGAVPHGLSTDSEVAQRGAESISRKTLRSSAEEV

SEQ ID NO: 83311 - DNA, 873 bp, Zea mays
  misc_feature: Ceres CLONE 1569192
  misc_feature: Encodes the peptide sequence at SEQ ID NO. 83312
  misc_feature (432)..(432): n is a, c, t, g, unknown, or other
ggagctcaccgcggtggcggccgctctagaactagtggatcccccgggctgcaggaattcgtctcacccctagaaaaattggtcagatttatgggtctcagaattaccagtacccgtcgacatacaccaagcaacagaactctactgccaagctgtcatccaatggtataagtgagaaattgactccagcgccgcaaacggatgtatctactattggtgtggatgaggtgaaaggtttgaaaaattcaaattcggtgctgaagacagaccggaacatgccaggttccaatggttcatatggccggtctagtgtgcgttctggcagctatcagaaccagactagttggtcacactatccatattatagtagtgagatgttctctgacaagcagcaaaagttcaccggcaaccacaattcgacttccaaccctnaaaacaaggggcagtcgaggaatcaaaacacgaagcagtatcctcatctcatggggttgcaacaccaacttcatcagtgtactcagctaaatgaatttatgggtatgatgggagctatggaccggccttttgtatggatcgcacatgtataattctggaataatgggggatgggattcactgtttgatggaaaagtccgacccggagaaagagtaacaatggggtattaaggtttatggaaagggaaacaaaaatggcttttaatggacctaaaaaaaggcccaaaaaattggatttaacaaaaaaccagctggggggttgtaagctctcttccccaggcccccgcaaaagaaggggggatctttttgttttccaaaaggggccccacccccgccccgaaaagagaacaaaaaaatataggggggtaaatttttggggaaa

SEQ ID NO: 83312 - protein, 102 aa, Zea mays
  misc_feature: Ceres CLONE 1569192
  misc_feature (53)..(53): Xaa is any aa, unknown, or other
MPGSNGSYGRSSVRSGSYQNQTSWSHYPYYSSEMFSDKQQKFTGNHNSTSNPXNKGQSRNQNTKQYPHLMGLQHQLHQCTQLNEFMGMMGAMDRPFVWIAHV

SEQ ID NO: 83313 - DNA, 952 bp, Zea mays
  misc_feature: Ceres CLONE 1569193
  misc_feature: Encodes the peptide sequence at SEQ ID NO. 83314
  misc_feature (660)..(660): n is a, c, t, g, unknown, or other
  misc_feature (760)..(760): n is a, c, t, g, unknown, or other
  misc_feature (771)..(771): n is a, c, t, g, unknown, or other
  misc_feature (784)..(784): n is a, c, t, g, unknown, or other
  misc_feature (827)..(827): n is a, c, t, g, unknown, or other
  misc_feature (844)..(844): n is a, c, t, g, unknown, or other
  misc_feature (865)..(865): n is a, c, t, g, unknown, or other
  misc_feature (952)..(952): n is a, c, t, g, unknown, or other
ctccccgcggtggcggccgctctagaactagtggatcccccgggctgcaggaattcgtctcacccctagaaaaaaccgtccacgttccatatggcttcctgcaggatggcactcctccttggcttgctgctgctagtagtagcttcgcccgcgatcgctgatgacgactccggtatctactaccagctggctcttatgtggccagaagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgancagtacatgctgttccagctctactcctgcgcggcggggtacggcacgttcatcgactgccccgcgccgcagcagtacacctggctccaggagatcctcntcacccccttncagaagtggatgnctcagcagcagctcaaccaggacgacgaccctttcaagctgcntggcgtcggcatggacnactgatacaccgtaccgtcgntctctgtttgcgtttctgtcagggtgcatggaataatactgtaactgtgtttcctgccgggcaatgcactgtgattgatggcaaccn

SEQ ID NO: 83314 - protein, 251 aa, Zea mays
  misc_feature: Ceres CLONE 1569193
  misc_feature (30)..(215): Pfam Name: Ribonuclease_T2 Pfam Description: Ribonuclease T2 family
  misc_feature: SWISSPROT Homolog: EC 3.1.27.1 Ribonuclease T(2)
  misc_feature (190)..(190): Xaa is any aa, unknown, or other
  misc_feature (224)..(224): Xaa is any aa, unknown, or other
  misc_feature (227)..(227): Xaa is any aa, unknown, or other
  misc_feature (232)..(232): Xaa is any aa, unknown, or other
  misc_feature (246)..(246): Xaa is any aa, unknown, or other
MASCRMALLLGLLLLVVASPAIADDDSGIYYQLALMWPEAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSKGPFXQYMLFQLYSCAAGYGTFIDCPAPQQYTWLQEILXTPXQKWMXQQQLNQDDDPFKLXGVGMD

SEQ ID NO: 83315 - DNA, 889 bp, Zea mays
  misc_feature: Ceres CLONE 1569194
  misc_feature: Translation starting site: 164
  misc_feature: SWISSPROT Homolog: EC 1.4.1.2 Glutamate dehydrogenase
  misc_feature (772)..(772): n is a, c, t, g, unknown, or other
tggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaaggggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctgggggtgattgctggccataaatgtgctgcgtatcatcaacgagcccacagctgcagctatcggctatgggtcttgacaggaaagctaccagtgtcggtgaggagcatgtccntcatctttgatcctgggagtggtaccctttgatgtctcccctctccccattgaggagggaatctttgaggtcaagggcacaggtggtggacccccttcttggtggtgaggcacttta

SEQ ID NO: 83316 - DNA, 905 bp, Zea mays
  misc_feature: Ceres CLONE 1569196
  misc_feature: Encodes the peptide sequence at SEQ ID NO. 83317
  misc_feature (387)..(387): n is a, c, t, g, unknown, or other
  misc_feature (399)..(399): n is a, c, t, g, unknown, or other
  misc_feature (475)..(475): n is a, c, t, g, unknown, or other
  misc_feature (499)..(499): n is a, c, t, g, unknown, or other
  misc_feature (513)..(513): n is a, c, t, g, unknown, or other
  misc_feature (519)..(519): n is a, c, t, g, unknown, or other
  misc_feature (593)..(593): n is a, c, t, g, unknown, or other
ctccccgcggtggcggccgctctagaactagtggatcccccgggctgcaggaattcgtctcacccctagaaaaaatcgggcaaaacaagcaaagtgaagaaagctgccggcctgccgctgcctgctcgcagttgccagcccccgccgccgcggaggacggaaggaagcgaatcaaccgcgactgtctccgacgggaataaagcaggcgaggccagccggtcgcggaacccccaattctcagctgcggccggcgatcgagtcggttccgtcccgcgccgatgcggatcccgcggcggaagggcggggccgggccgctcgctgtcggggtgcccagcaggcgggcgcaggtcgccgcggtcttcgcgctcgccgcactgctgggggtcntcgtgctctacnacaacgcccacatcgccgcctcgctgcggaggcacggcggccccgaggacgtacgccaagctctcctccttcgaanggcgcaccgctgtccccagcatcnccaaggaaaaggcngccgcngcggtggcccgggcaacggagtcggtgccggtgcacggcccggatcgggccaactcccccccccacaagcggcngggggaaatccaggagcccccatccaaaccctggaaccaacgccggggagctccctggaggaaccccccccttaatcaagaaggggggtcacaggaggaaacggaagcccccaagggggaaaggggggccccaagggccaggaaaacaccccccggccccggggaacttggaacctttaaaaggggcccctgggtggttacaaaaaacccccgcgccccccttttaaaagaggggtccaaagtggggttttcctgaggggaggggggtcccttttttgccccccgcgcccccccccacccaacttaataaaa

SEQ ID NO: 83317 - protein, 129 aa, Zea mays
  misc_feature: Ceres CLONE 1569196
  misc_feature (37)..(37): Xaa is any aa, unknown, or other
  misc_feature (41)..(41): Xaa is any aa, unknown, or other
  misc_feature (66)..(66): Xaa is any aa, unknown, or other
  misc_feature (74)..(74): Xaa is any aa, unknown, or other
  misc_feature (79)..(79): Xaa is any aa, unknown, or other
  misc_feature (81)..(81): Xaa is any aa, unknown, or other
MRIPRRKGGAGPLAVGVPSRRAQVAAVFALAALLGVXVLYXNAHIAASLRRHGGPEDVRQALLLRXAHRCPQHXQGKGXRXGGPGNGVGAGARPGSGQLPPPQAAGGNPGAPIQTLEPTPGSSLEEPPP

SEQ ID NO: 83318 - DNA, 881 bp, Zea mays
  misc_feature: Ceres CLONE 1569197
  misc_feature: Translation starting site: 216
ctccccgcggtggcggccgctctagaactagtggatcccccgggctgcaggaattcgtctcacccctagaaaaactcctcattcactttccaagttgtccgaaaagaccagactaccctgttcccccgaagtcagagggggagaggaggctagggatagagcagcgtcatcgcaccgctcgccggcgagccagatcatcagtgaggaaggcagcgatggcggtggtggagctgtgggagacgctgaagcaggcgatcgttgcgtacacgggcctgtctccggcggccttcttcacggctgtggcggtggcggccgctctgtaccacgttgtgtcggggctcttcgcggccccgcccccgccgccgccgcgcccacgggaggagcccgagacagagccgctccctcctcccgtgcagatgggggaggtctccgaggaggacctccgccagtacgacggctccgaccctaagaagccgctcctcatggccatcaagggccagatctacgacgtcacccagagcagaatgttctatggacctggcggaccttacgcccctgttcgccggcaaagatgccagcagagctctagcgaagatgtcgttcgagccacaggacctcaccggcgacatctcgggccctagtcccgttgagctcgacgccctgcaggactgggagtacaagttcatgagcaagtacgtgaaagtccgcacgtcaagaagagcgtcccctggtggaaggcggcagcaccgcgagcaccactgaggctgataaggcaccgacaaccgaaaataactaaaccaggcggtggtttgagaaaaaggaacccccggctaaatgaagtgcccagaaaaactaaaagctttctgtggctgcggcattaa

SEQ ID NO: 83319 - DNA, 854 bp, Zea mays
  misc_feature: Ceres CLONE 1569200
  misc_feature: Encodes the peptide sequence at SEQ ID NO. 83320
  misc_feature (775)..(775): n is a, c, t, g, unknown, or other
ctccccgcggtggcggccgctctagaactagtggatcccccgggctgcaggaattcgtctcacccctagaaaaagaaccctactcaccaacccacccgcaggagaacggaaaaaaaaaatcgtgtcgaggcgactttcgccgccatggcaggcgatcccccgacggctgcggagaaggagaccctggtctcctccttcatcgagatcaccgccggccagaccctcgagactgccacccagttcctccagatgacgagctggcacctggaggaggcgctgcagctgttctacatcgacggcgaggccgcccacaccgccgcgcattcggtggacccgtcgcctgcggcggcggccccgtcggcactagcggcggcggccggggtggaagaggcgatgaggttcgctccacccccggcggctgcactgggcgatgcaatgtcgcatgggtttggggtcagggaggacgacgacgttcgcgcgcccctgccggtgaagagggagactctctacggcgagggaatcgtgtccgtcatgcgacctaatgcatcagctgcatttcgtaactttgaacaagaagcaagacaatctgctgtttgggactctgagcagaatgttgcatctagttctggtgataatcttgcttctttataccgtccacccttttccttgatgttcaatggatcctttgacaaggcaaagttagaggcttcttccctggacaaatggctattaatcaatttgcagtcgacagaggaatttagctctcacatgcttnaaccgagaacttgggggaaatggaagcggtggctcagtttaattaggtcaaaccctagaaaaaatttaattttcttggg

SEQ ID NO: 83320 - protein, 236 aa, Zea mays
  misc_feature: Ceres CLONE 1569200
  misc_feature (211)..(211): Xaa is any aa, unknown, or other
MAGDPPTAAEKETLVSSFIEITAGQTLETATQFLQMTSWHLEEALQLFYIDGEAAHTAAHSVDPSPAAAAPSALAAAAGVEEAMRFAPPPAAALGDAMSHGFGVREDDDVRAPLPVKRETLYGEGIVSVMRPNASAAFRNFEQEARQSAVWDSEQNVASSSGDNLASLYRPPFSLMFNGSFDKAKLEASSLDKWLLINLQSTEEFSSHMLXPRTWGKWKRWLSLIRSNPRKNLIFL

SEQ ID NO: 83321 - DNA, 961 bp, Zea mays
  misc_feature: Ceres CLONE 1569201
  misc_feature: Encodes the peptide sequence at SEQ ID NO. 83322
  misc_feature (881)..(881): n is a, c, t, g, unknown, or other
  misc_feature (882)..(882): n is a, c, t, g, unknown, or other
  misc_feature (884)..(884): n is a, c, t, g, unknown, or other
ccgcggtggcggccgctctagaactagtggatcccccgggctgcaggaattcgtctcacccctagaaaaaaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagcgtgtcgctcgcatcctccgtgaagacgttctcggccgcgctggctctgtcgtcggtgcttctctcctcggccgccatcctcccctccccccgcgggccgccgaacatcgcgggggctgacccccgtggcaaggagtccaaagggcgttcgcccaaggcgcgaaaaaaaaaccccgatcaaagaaactcccccccgcccctccaaaaagtaacgcgccccaaaaagggccccggggcccccccccattttaaggccccccttttggaaaaaaaacaaagggggggggttccgaaaaacccacgggaaaagttctcgggccggggcttttgggggggggcccaaaaggggggttgccccccccccctttttttttgggggggggggaaaaaaacgggggcccgggggggggagaatttttttacaccccccggggggggttgtttttttttctttaatatatttccgcgggggggaaatcagggggggggggcccccccaaagaaaaacccctctcttcccccccccctctgtggggggggaaaaaaaaaaaacaccccccccgcggggggggaggaaaaatacctctcccccggccggcgggtgtgggggnnanggggggtgtttttcctctaaagagggggggggtgattttttgggggcgcggcgcggcggggaactaatataacaaag

SEQ ID NO: 83322 - protein, 250 aa, Zea mays
  misc_feature: Ceres CLONE 1569201
  misc_feature (244)..(244): Xaa is any aa, unknown, or other
  misc_feature (245)..(245): Xaa is any aa, unknown, or other
MAALAASSTAAFAAKPRLPRARLTVACSATGGDGNGSSSSVSLASSVKTFSAALALSSVLLSSAAILPSPRGPPNIAGADPRGKESKGRSPKARKKNPDQRNSPPPLQKVTRPKKGPGAPPHFKAPLLEKKQRGGVPKNPREKFSGRGFWGGAQKGGCPPPLFFWGGGKKTGARGGENFFTPPGGGCFFFFNIFPRGGNQGGGAPPKKNPSLPPPLCGGGKKKNTPPAGGEEKYLSPGRRVWGXXGVFFL

SEQ ID NO: 83323 - DNA, 912 bp, Zea mays
  misc_feature: Ceres CLONE 1569202
  misc_feature: Encodes the peptide sequence at SEQ ID NO. 83324
  misc_feature (332)..(332): n is a, c, t, g, unknown, or other
  misc_feature (439)..(439): n is a, c, t, g, unknown, or other
  misc_feature (450)..(450): n is a, c, t, g, unknown, or other
  misc_feature (451)..(451): n is a, c, t, g, unknown, or other
  misc_feature (801)..(801): n is a, c, t, g, unknown, or other
tccccgcggtggcggccgctctagaatagtggatcccccgggctgaggaattcgtctcacccctagaaaaattcctcccgagtcgcctccccctcaagttccacaaacgcaagccccaatctcgccgtcaccacctcaatccagcaaacgcaaaccccatctcgccgccgccgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaggtgaccntctagctcctccagaactcgcgctccgccgagaagatgtacaagatcgactcccacctggcgtgcgccgtggcggggatcatgtccgaacgcatacatctcataatnaccgcccgccnntcacgccaaagctacgcgctctcctaccagtacccatccccgtcgagcagctcgtccaggtcctcggcgaaacaagcagggggtcacccagttcgggaggcctcggccccttcggggtccccctcccattccctgggggggaaaaggaccacggggttcaagctttaaaggaaggaacccctccggaaatacgggggggggaaaggcccccccctttttggggcaaaaaaccagggcgggcaaatccatgggcaaagaggggaataaagggacgggtttgtcccccgaagagggccccccccccccccgcgctttggaggcccccacaaaaacacgggggctccccccgnccctttttggccaaaaaaaaggggagcggcgcccaaagtgttttttcccaacccggggccccccgggggagagaaaaaacaacaggggtggggtcccccccaaaaaagggg

SEQ ID NO: 83324 - protein, 52 aa, Zea mays
  misc_feature: Ceres CLONE 1569202
  misc_feature: SWISSPROT Homolog: EC 3.4.25.1 Proteasome endopeptidase complex
MSRRYDSRTTIFSPEGRLYQVEYAMEAIGNAGSALGILAADGVVLVGEKKVT

SEQ ID NO: 83325 - DNA, 1333 bp, Zea mays
  misc_feature: Ceres CLONE 1569203
  misc_feature: Encodes the peptide sequence at SEQ ID NO. 83326
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (324)..(324): n is a, c, t, g, unknown, or other
  misc_feature (1252)..(1252): n is a, c, t, g, unknown, or other
cgttttgtcttttcccttttaatccgcaattttttttatttttttgcggggagaacaacccacccccnnntgaggcgcacctcggtggcggccgctctcaactagtggatcccccgggctgcatgaattcgtctcaccccacgaaaaattcctcccgagtcgcctccccctcaagttccacaaacgcaagccccaatctcaccgtctccacctcaatccagcaaacgcaaaccccatctcgtcgccgccgcgatgtctcgccgctatgacagccacacgacgatcttctcgccggaggggcgtctctaccaggtggagtacgcnatggaggcgatcggcaacgccgggtaagccctcgggatcctagccgccgacggcgtggtcctcgtcggcgaaaagaagggtgactcctagctcctccacacctcgcgcttcgtcgagaagttgtacaagatctacttccaccccccccgtggtgtggggcgggatcatggccgacgcccacatcctcataaaaaccgacccgcctccacgcctcatgagcttggggcttctactacccaggaaaccccttccaccgggggagcaagcttcgtcccagtccccaacctgccgaaacccaaagcgagggggttacccaccccgttttaaggtagggccctctccgctcccctttgggggggttttcctttcccctattgcccgcttggggttgggggaaaaaggccacccaagaggggtttcccgagctttttgtgcttgggcaaccgaagcccgtgttctccggagaatctttaactgctcaggtgcttggaaaagaggcgcaaccctaaccgtggattgggaggggacccataccctatgcccaggggcgtctgactgcagaatgtctcctgttgcttcgcttgagcctgtgtggaactaatcgtaggagatcccgtcggctttgactactcccttcgctaattgaatgcggcaggatattaccactcttcgccaggctagtataaagttctccttcagccggagagaggataaattggtgatactccccgcgcctggatctcttgtatctggtcccagtgaaaatacttggtgtaacccttgtcgcgctaaaatgttttttgtctcttttagatgccccggggtcttacgtgggagtagagagtgtcacctccgctcactggtgtggcgtcccgaaatcccggaatacgctgcctggatgcacatatctccgcgcttgcctaagtanctgtgggcctggtgtcagaagtgctaaacatcccactgagagcgcgtcactgtgtccccgtgtttttctgcgcgcggcacc

SEQ ID NO: 83326 - protein, 32 aa, Zea mays
  misc_feature: Ceres CLONE 1569203
  misc_feature: SWISSPROT Homolog: EC 3.4.25.1 Proteasome endopeptidase complex
MSRRYDSHTTIFSPEGRLYQVEYAMEAIGNAG

SEQ ID NO: 83327 - DNA, 856 bp, Zea mays
  misc_feature: Ceres CLONE 1569206
  misc_feature: Translation starting site: 186
  misc_feature (502)..(502): n is a, c, t, g, unknown, or other
  misc_feature (618)..(618): n is a, c, t, g, unknown, or other
ctccccgcggtggcggccgctctagaactagtggatcccccgggctgcaggaattcgtctcacccctagaaaaaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctggtcaggccttttctggctttcttgccagaggtgcagagcgcggataggaagataccgttcagagaaaaagttatatacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatgggtatgcaactttcttgttggatcgaagatcattgaagttgacnacagtgtgagagaagatcgtgctctgctgaatggtgcacaaaagttgcttggtatcctggatgctattggggaagctgtggcatatgtcctgtcttgaatgtatggcagtgtaagncaacttggaaccagggaatgctatccttcataatacttcagcctttcttttgctggcatcttggccatccggtctggaggaactttccccgaaaaggttttgggcttgggatctgggaatttccctggtcttggccaccaatatcttggcaaaaattcatttgggaagggttttttccccccccaccctttaaacgggggcccggggggctaaaattttaaaggggcgtgtttttgcc

SEQ ID NO: 83328 - DNA, 889 bp, Zea mays
  misc_feature: Ceres CLONE 1569207
  misc_feature: Translation starting site: 162
  misc_feature (885)..(885): n is a, c, t, g, unknown, or other
ctggagctcaccgcggtggcggccgctctagaactagtggatcccccgggctgcaggaattcgtctcacccctagaaaaaaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagcgtgtcgctcgcatcctccgtgaagacgttctcggccgcgctggctctgtcgtcggtgcttctctcctcggccgccacctcccctccccccgcggccgccgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgacggcctgccgcacctcatcgtcagcggcgaccagcggcactggggcgagttcgtcaccccgggcctgctcttcctctacatcgccggggtggatcgggtgggtcgggcagagctacctcatcgccgtcagcggcgagaagaaagcccgcatgagggagatcatcatcgacgtcgaagctcgcaccccgctcctccccaggaggttcatctgggccgtcgcggcctaccgcgagctcatcaatggagacctcgtcgtcgacgacaagacatcggctactactagctggctgcactgtgcttgcacatgnctgc

SEQ ID NO: 83329 - DNA, 902 bp, Zea mays
  misc_feature: Ceres CLONE 1569208
  misc_feature: Encodes the peptide sequence at SEQ ID NO. 83330
  misc_feature (448)..(448): n is a, c, t, g, unknown, or other
agctccccgcggtggcggccgctctagaactagtggatcccccgggctgcaggaattcgtctcacccctagaaaaagtcggaatatcatacgaaaaccctcgcggcgaggagcgctctccgtcccacacacgcgcgccgcagcctccgcagtccgcacctgcctccacgacctgtcgtgctcgtgcgctactctcctcgagcgcggcgcggagcacggggacatcaaatggcggcagcggcggagatcggtggtttcgcggcggcgagagtggcggtggcaacgctcaggccggctgcgcacccagccccggcggcggcggcggcaccgcagcctaggagggcggtggcggcgcagtcgctgcagacgaccgccaccgaggcgctgacggcggatctcgccggcacgaccaacggcgctgtgcatgctcggatgaatagtaaggctancagtgaaatcacttcacaggcagttactgcaaattctaggagaaagacaaagatagtctgcacccataggtccctcaaccaacactcgtgagatgatttgggagctttgcaaaaactggaaatgaattgtacccgccttaaatatgcccatgggggaccaccgtcccccccagagggtttttgattgggctcaaggagttcaaggcccagaaacccggatggcaaagttattgcccttttgctggaaccaaaggggcctgaaattaaaaaaggggggatttttcaaacccattcttgtctaggggaggggcagaattttcttttccaaaaaaaaaagggggggacccctaaaaaaccttcccggggaaaatgagagcctccaaaaaaggtgtgaagcgggccaccctttttttggggggggagaaaaatttccccttttgggaaaaacaaaaaa

SEQ ID NO: 83330 - protein, 103 aa, Zea mays
  misc_feature: Ceres CLONE 1569208
  misc_feature (74)..(74): Xaa is any aa, unknown, or other
MAAAAEIGGFAAARVAVATLRPAAHPAPAAAAAPQPRRAVAAQSLQTTATEALTADLAGTTNGAVHARMNSKAXSEITSQAVTANSRRKTKIVCTHRSLNQHS

SEQ ID NO: 83331 - DNA, 928 bp, Zea mays
  misc_feature: Ceres CLONE 1569214
  misc_feature: Encodes the peptide sequence at SEQ ID NO. 83332
  misc_feature (362)..(362): n is a, c, t, g, unknown, or other
  misc_feature (384)..(384): n is a, c, t, g, unknown, or other
  misc_feature (385)..(385): n is a, c, t, g, unknown, or other
  misc_feature (442)..(442): n is a, c, t, g, unknown, or other
  misc_feature (461)..(461): n is a, c, t, g, unknown, or other
ggagctccccgcggtggcggccgctctagaactagtggatcccccgggctgcaggaattcgtctcacccctagaaaaaaccctcgcatcggcctgtacctagccgccgtcgccacagagccctcatctcgtccgtcctcggcggcctccgcggagcagccgtcgctggagaccaaagatccggccagatctgatgtcaggagggactggctcatccgggcgcgcggccccgcggtacgccccggatgacccgacgctgcccaagccgtggcgcggcctcgtcgacggcaccaccggctacctctactactggaacccggagacgaacgtcacgcagtacgagcggcctgtgccccccgagangcagctcctcccgcctccgccnntcgttgcacccccgccctcacggagccgcgaccgccgcgacaggtccagatcccgantccgcacccccgccccggngcgaccacagggaccgcgaccgtgaccgtgacaggcgccacgacgagcacgcgtcctccaagacggcgtcttcccaccaccatcgggctcgggtagccgtcgccgacgatcttccaccgaggcatacggccgccgccatgaaatccacgtcccgggggataatgtgcccactcccataaccttcatttgagggtggggggctttccctcccgaaattcttaaaggaaaaaccaaccgggtcgggatttcccaagcccaaaccccttttccaagcccagttttggggccaattgtctttccaaataccaagaggtgttaccctttttgcaaaaaactgttttctggggaaaaactttttgggggattcccacctccccgggggttttgagaatataaaagcgccccctggaaaaaaaacccttttgggagggggcccccccctggtgttttttttttttggccccccc

SEQ ID NO: 83332 - protein, 97 aa, Zea mays
  misc_feature: Ceres CLONE 1569214
  misc_feature (22)..(52): Pfam Name: WW Pfam Description: WW domain
  misc_feature (57)..(57): Xaa is any aa, unknown, or other
  misc_feature (65)..(65): Xaa is any aa, unknown, or other
  misc_feature (84)..(84): Xaa is any aa, unknown, or other
  misc_feature (90)..(90): Xaa is any aa, unknown, or other
MSGGTGSSGRAAPRYAPDDPTLPKPWRGLVDGTTGYLYYWNPETNVTQYERPVPPEXQLLPPPPXVAPPPSRSRDRRDRSRSRXRTPAPXRPQGPRP

SEQ ID NO: 83333 - DNA, 846 bp, Zea mays
  misc_feature: Ceres CLONE 1569216
  misc_feature: Translation starting site: 88
  misc_feature: SWISSPROT Homolog: EC 3.4.21.25 Cucumisin
  misc_feature (632)..(632): n is a, c, t, g, unknown, or other
ccccgcggtggcggccgctctagaactagtggatcccccgggctgcaggaattcgtctcacccctagaaaaagcattgcattgcctcatgaggacccaaagaaacctccttcccctcctcctgctgctgtccgccgcgctgctcgccgtcgccgacgcgcaggagcgcaagaactacgtggttcatctcgagccgagggacgacgacggcggcggcgggtcggtggaggagtggcaccggtctttcttgccggaggccacgctggactcggcggcggatgacgggcccaggatcatccactcgtacagccacgtgctgacggggttcgccgccagcctcactgacgcggaggcgcagacgctgaggcgcaaggaggggtgcttgcggctgtacccggaggagttcctgccgctggctaccacccactcgccgggcttcctcggcctccacatgggcaagcacggcttctggggccgatccgggttcggccgcggcgtcgtgattgggctcctcgacaccggcatcctgcccacccacccgtccttcggcgacgcggggatgccaccgccgcccaaagaagtggaagggcgcctgccagttcaggtccgtcgcccgcggcgggtgcagcaacnaggtcatcggcgcgcgcgcgttcgggagcgcggccatcaacgacacggcgccgcccgtcgacgacgcgggccacggcacgcacacggccaggcacgcggcggggcacttcttgcagaacgccggcgtgcggggcacgcgcacggcagggcgtccgggatgggcgcgcacgcgcacctggccatctacaggtgtgcacgcgaagccggggctcct

SEQ ID NO: 83334 - DNA, 2233 bp, Zea mays
  misc_feature: Ceres CLONE 1569217
  misc_feature: Encodes the peptide sequence at SEQ ID NO. 83335
agtttctggcaatccccatccccaaatctcccatggcttcttcccctccccagccactcacccgcaccgtcctcgccgctaccctgctcctcctcctgcacaatgccgccgccagagccgacggcgcgtcgccggcggtgaacccattcacggcgaaggcggcattcatccgatactggaaccgcaaggtgcccaacaaccgcccgcacccggccttcttcgtcgccaaactctccccgctcccggccgctgactccgcctccttcccatccgcgctgcccgacatccgcgccagcctacccgcgctctgctccaaagccgcgctcctctgccccgggccggctaccaccgatgcggcgtcgctggtggcatcgggccgcaggggcggggggcccttcaaaggctacaacaacgccaacttctccaactacggcaccggcggcgtagcggggaccgactcgttccagaagtactccccggacctcaacatcgccgccgacagcttccgccgctacggccgggactcgtcgggacgcgccgacagcttcacctcttacgaggacgacggcaacgtcgtgaccgccaacttcacctcctacgccggcggcgccacgggtggttcgggctccttcgccgcctacgccgccgagaccaacgtcccggactccaccttcaccaactacgacgccgccgccaacggccgcggccggagcttcgcgtcctactcccaggaggcgaaccatggggagtacggcttctccggctacggcaagaacggcaacggcgtgcgcgagacgttcaagtcctacggcaatgagtccaacgtgctggcctccggcttcgccaactacgggcagtccgccaacggcgccacggacaccttcacgggatacggcgtggaggggaacgtccccgagaacaggttccggagctacggcgccggcggcaacgctggagtcgacaccttcaagaattaccgcgacgacggcaacgtcggcgacgacaggttcacctcctacgccaagggcgccaacggcggcgcggcggagttccagagctacggcaactcggccaacccgggcagcaccatcttcaagggctacggcgagggcaccaaccccaaccaccacattgggttcaaggagtacgccggcgagaacaacaccttcaagggctatgccaagagcggtgtggacttcaaggggtaccacaacaccaccgtctccagctccaccgccgcggcgctgacggtgtcggcggaggcagcggcatcgatgcatcacgagcacctgaagtggtcgccggagcccgggaagttcttcagggagcgggagctcgtggccgggaaccgaatgccgatgccggacatcagggacaagatgccgcccagggcgttcctgcccagggccatcgccgcgaggataccgttcgagcccaacgccgtgtcggaggccttcgggctgcccctcgacacggcgctggggaaggccgtggcgtccacggtggcggagtgcgagcgcgcgccgagcaagggtgagacgaagcggtgcgcgacgtcggccgaggacgtggtggacttcgcggtggaggtgctgggcgacgacatcgtggtgcgcagcacggcgtccacggcgggcggcggcgggcgcgtccagctgggcgccgtggccggcatggacggcggcagggtgacgcggtccgtgtcgtgccaccagagcctgttcccgtacctggtgtactactgccactccgtgcccaaggtgcgggtgtacgaggccgacatcctggccgccgatggctccggcgagaagatcaaccgcggggtggccatctgccacctggacacgtccgactggagcccggcgcacggcgcgttcgtggcgctcggcggcaagcccggcgaggtggaggtgtgccactggatcttcgagggcgacatgacgtggacagtcgcggactgatggagtgagtgacgttcctctctgcctgcttgcaagagcacacgactaagaagaactactaagaagaattattttctccctctctctctctctcccgcaaattattatttttgtccactcctttctcgatctaccttatatgacgaaggtggtaagaattggtccaggagaaaaaaaggtttggcgaacgatgacaatgttgtaaactgtaaatcttgggtaggggaatagctggcgatgtgattgccttggatcaaaaaaaaaaaaaaaaa

SEQ ID NO: 83335 - protein, 642 aa, Zea mays
  misc_feature: Ceres CLONE 1569217
  misc_feature (427)..(641): Pfam Name: BURP Pfam Description: BURP domain
MASSPPQPLTRTVLAATLLLLLHNAAARADGASPAVNPFTAKAAFIRYWNRKVPNNRPHPAFFVAKLSPLPAADSASFPSALPDIRASLPALCSKAALLCPGPATTDAASLVASGRRGGGPFKGYNNANFSNYGTGGVAGTDSFQKYSPDLNIAADSFRRYGRDSSGRADSFTSYEDDGNVVTANFTSYAGGATGGSGSFAAYAAETNVPDSTFTNYDAAANGRGRSFASYSQEANHGEYGFSGYGKNGNGVRETFKSYGNESNVLASGFANYGQSANGATDTFTGYGVEGNVPENRFRSYGAGGNAGVDTFKNYRDDGNVGDDRFTSYAKGANGGAAEFQSYGNSANPGSTIFKGYGEGTNPNHHIGFKEYAGENNTFKGYAKSGVDFKGYHNTTVSSSTAAALTVSAEAAASMHHEHLKWSPEPGKFFRERELVAGNRMPMPDIRDKMPPRAFLPRAIAARIPFEPNAVSEAFGLPLDTALGKAVASTVAECERAPSKGETKRCATSAEDVVDFAVEVLGDDIVVRSTASTAGGGGRVQLGAVAGMDGGRVTRSVSCHQSLFPYLVYYCHSVPKVRVYEADILAADGSGEKINRGVAICHLDTSDWSPAHGAFVALGGKPGEVEVCHWIFEGDMTWTVAD

SEQ ID NO: 83336 - DNA, 931 bp, Zea mays
  misc_feature: Ceres CLONE 1569218
  misc_feature: Encodes the peptide sequence at SEQ ID NO. 83337
  misc_feature (286)..(286): n is a, c, t, g, unknown, or other
  misc_feature (310)..(310): n is a, c, t, g, unknown, or other
  misc_feature (342)..(342): n is a, c, t, g, unknown, or other
  misc_feature (365)..(365): n is a, c, t, g, unknown, or other
ccccgcggtggcggccgctctagaactagtggatcccccgggctgcaggaattcgtctcacccctagaaaaaagtcgcagcgcagtcaagcaaggcacgtcggtccaagagcacgacgagcagacgacgctgccggcccggccgtgctgctcctctgagtccgagatctgaaggcgcggcaggaaggaaacgggcgggcgagaggatccagcagcccttccccacgcgcgcgcgacggttagcgcgtcccagatctcggtgcggcgccctccgcccggccctgccngcgagagcgcggcctgatgaggcngcggccgttcctggagcagccgcgggcttcgnttcagcgccggtggcagcagcgncccgtggtggtgccgcctcgcgcttttcccttcctctcggccttcgcaatgggttcttcctccttcggccgtccttccttgggttcccccgaaccccgggggccttgcccgttccaccttccggcccgggttcttcccgaattttggaaccaaccctcttttaacttttttctccggttgagaaaaaatttttccctcgggggggggaaatcccggggaggcggcctcccccaatgggcttggacacaaatatgttgtggggcgcccccccctctctttttttctggggggggcctccctggggggaccccaaatttttctttctcccccaaaaacaaatttttctgcccctcgttcccccccgggggggccccccaaacccccccccgcttttttgtggtggggaggacttttattttccccaccaataaggggggggggggggcaaaaaaagaactccttttggcgggggggggggggcccccattttgtggggggcccgccccgtttgtgggcccccccccaacaaccacaaaaaaggcggctccttgttgtgattttttttc

SEQ ID NO: 83337 - protein, 56 aa, Zea mays
  misc_feature: Ceres CLONE 1569218
PRGGGRSRTSGSPGLQEFVSPLEKSRSAVKQGTSVQEHDEQTTLPARPCCSSESEI

SEQ ID NO: 83338 - DNA, 905 bp, Zea mays
  misc_feature: Ceres CLONE 1569220
  misc_feature: Encodes the peptide sequence at SEQ ID NO. 83339
  misc_feature (422)..(422): n is a, c, t, g, unknown, or other
  misc_feature (443)..(443): n is a, c, t, g, unknown, or other
  misc_feature (455)..(455): n is a, c, t, g, unknown, or other
ctccccgcggtggcggccgctctagaactagtggatcccccgggctgcaggaattcgtctcacccctagaaaaattccccatcagagatctctccccatcaccaagccgaaccgagaccgagagagcttccccacacccacagcggggtgcagcggatcgcgccaaattcgaccgaacaatcgcgcgccactcggccccgccactatgagcttctcgtccatgagcaaacagcaggtgctggacgccggtgacggggagggggaagaggtcgtggagcttatcccgggcctgccggaagaggtggccgagaagtgcctcctccacctgcccttcctctaccaccgtctcttccgcaccgtctcctccacctggaaccgcttcctcaccgactcccctgccaagccgctgctgttcactcccncggagggggcgggggctggcncgggaagcgcanccatgggctcgttgtccttatcgctgcccttccctctcgccttcgcgtttgaccctgtgtcgcgacgcctccagtgcaggcgctcgaacttttctcgaggaggtggctcctgctcccgccgggtgccgggcggcccgcgcccgggtcgtttgcggtggtggggttcccccgccgcggcgagaactacgtgattgggggcgtccaggaggggcaccacaaagcggggacgaacttggccctttaaaaccccccccggaaagaatgggaggaagggggggggaatcggaaccccccccggaacattggccctgggaaagggagggccccctttgggggtttccccccctcaaaaaaaaacccaacccccaatttttttcccaccaaaacccgcgggggggggccccccctgttgcccccccagcgggggaaacaatttggttgtgtaaaaaa

SEQ ID NO: 83339 - protein, 146 aa, Zea mays
  misc_feature: Ceres CLONE 1569220
  misc_feature (24)..(71): Pfam Name: F-box Pfam Description: F-box domain
  misc_feature (73)..(73): Xaa is any aa, unknown, or other
  misc_feature (80)..(80): Xaa is any aa, unknown, or other
  misc_feature (84)..(84): Xaa is any aa, unknown, or other
MSFSSMSKQQVLDAGDGEGEEVVELIPGLPEEVAEKCLLHLPFLYHRLFRTVSSTWNRFLTDSPAKPLLFTPXEGAGAGXGSAXMGSLSLSLPFPLAFAFDPVSRRLQCRRSNFSRGGGSCSRRVPGGPRPGRLRWWGSPAAARTT

SEQ ID NO: 83340 - DNA, 867 bp, Zea mays
  misc_feature: Ceres CLONE 1569221
  misc_feature: Encodes the peptide sequence at SEQ ID NO. 83341
  misc_feature (581)..(581): n is a, c, t, g, unknown, or other
ggagctcaccgcggtggcggccgctctagaactagtggatcccccgggctgcaggaattcgtctcacccctagaaaaaaaaccgcgcccatgggccatggcgtgctcttcccctgtgctcgccggcgctcctccctcgcccatgccgcagcgatccagctcgcatccactccctgctctcgtgctccagctcggttctcctccctgccgcgcgagcttgcccctgctcggagttccctcggctcggttccagctccgtgtgcacgcacctatctcccatggtcgtgtgccgtggtgctccggcgtcatttcctcagtccctgcgctcggattccccttcttccatggcgctcgcccagccgtcgagctcccttgcgcgcgcgtgctccttccctgctcgcgccgccgcgcagctccctgtgttcatccatggctgaacgcttctccttggtcggcgtccgattccctgctgctgggccaaaattcctcatccccttcacataggtcgtccttgtttagccatggtcacacggtggtgggcacaggaacatcttggtctgtccatggctgctctcttcgtcngtggtgctcggcgaaacaccccctgcgtcgcgctcggtcctgcccatctcaccgtgcgcggatctcgtctgtgtcgcccccgtccagttcccttcccaaagtcagcccctgttgccggggcctggggtcctcccccgggggcaatttcccccgccttttcctgttccaaggcacgtgggcggggtttttttaagggaaaatggcaaacccctgtggggggtcccaggggaaatttccaacccaaagaaggggggagaatatctccccaagaataaaacaaaattgg

SEQ ID NO: 83341 - protein, 225 aa, Zea mays
  misc_feature: Ceres CLONE 1569221
  misc_feature (162)..(162): Xaa is any aa, unknown, or other
MACSSPVLAGAPPSPMPQRSSSHPLPALVLQLGSPPCRASLPLLGVPSARFQLRVHAPISHGRVPWCSGVISSVPALGFPFFHGARPAVELPCARVLLPCSRRRAAPCVHPWLNASPWSASDSLLLGQNSSSPSHRSSLFSHGHTVVGTGTSWSVHGCSLRXWCSAKHPLRRARSCPSHRARISSVSPPSSSLPKVSPCCRGLGSSPGGNFPRLFLFQGTWAGFF

SEQ ID NO: 83342 - DNA, 861 bp, Zea mays
  misc_feature: Ceres CLONE 1569222
  misc_feature: Translation starting site: 165
ctccccgcggtggcggccgctctagaactagtggatcccccgggctgcaggaattcgtctcacccctagaaaaaaccgcaaggatccaccacaacagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatggacgacttggcggtggcggcgccaggtcgtgcggtgcgccgtggctggaacgcgaaggaggacgaggaggcgctgcacctgagggtggacatgccgggcctgggaaggagcacgtcaaggtgtgggcggagcagaacagcctggtgatcaagggcgagggcgagaaggaggatagcgaggacgaggccgccccgccctcgagatacagcggtcgcatcgagctcgcgccagaggtttacaggatggacaagatcaaggcggagatgaaagaacgcgtgcttcaggtggtcgtgcccaaggttgaggagcagccagcgcgggacgtgtttcaaggtcaacgtcgagtagtccttcagtcgaaagggaatctccctccgcattcactgct

SEQ ID NO: 83343 - DNA, 843 bp, Zea mays
  misc_feature: Ceres CLONE 1569223
  misc_feature: Encodes the peptide sequence at SEQ ID NO. 83344
  misc_feature (345)..(345): n is a, c, t, g, unknown, or other
  misc_feature (415)..(415): n is a, c, t, g, unknown, or other
ctccccgcggtggcggccgctctagaactagtggatcccccgggctgcaggaattcgtctcacccctagaaaaaacctcacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagccgccaaatgcgccggcgagcagccttaccgcctcgcgggcttcctggccgtctgcgccgtggccttcgtcgtgacatgcctcctccactggtgcttcccgggaggcccggcgtgggggaggtggtggntggacgcggcggctcggtgcccggtgccggtggcggcgccacggcggtgggcggcggcccctgccggggnccgagggggcctgccccgtgggtcggggagcaatgtgggctcatggacggggccctggccgcacccgcaaagcctcccccggcgggcgggcggggggaaccttcccggcgcccaggggggcctggaaagggcctttccccccttccgggggccaccaaagggggggggggggggggcccctcccccccccggaacattggcccccccccaaaaaattccttcaaaaaaaacccccgggggttttttcggcgggagaccgggccccccaattaaagaggagagatcccgcggcttaaacgggggggcccctcctggtttttcaccccgggggggcaaaaatatagggttgtttttctcccccgcccccccttaagaggggggggcccctttttattgtgggggggggcggcggccccctctttttttcc

SEQ ID NO: 83344 - protein, 206 aa, Zea mays
  misc_feature: Ceres CLONE 1569223
  misc_feature (60)..(60): Xaa is any aa, unknown, or other
  misc_feature (83)..(83): Xaa is any aa, unknown, or other
MATPDDRGSWLLYLSLAAKCAGEQPYRLAGFLAVCAVAFVVTCLLHWCFPGGPAWGRWWXDAAARCPVPVAAPRRWAAAPAGXRGGLPRGSGSNVGSWTGPWPHPQSLPRRAGGGNLPGAQGGLERAFPPFRGPPKGGGGGAPPPPGTLAPPQKIPSKKTPGGFFGGRPGPPIKEERSRGLNGGAPPGFSPRGGKNIGLFFSPAPP

SEQ ID NO: 83345 - DNA, 815 bp, Zea mays
  misc_feature: Ceres CLONE 1569225
  misc_feature: Encodes the peptide sequence at SEQ ID NO. 83346
ctccccgcggtggcggccgctctagaactagtggatcccccgggctgcaggaattcgtctcacccctagaaaaaacttctgcccaaccccaaccccaacccccctccatccatccaaacagctttgcctagcttattccttaccgacaaacaaaactgacacggatccgcacaggccacagctagcgcaacgaactcgcccagtccggctgctgctgcacaacggactcgatctcacgggcccgccggctcgcagccatgcagacacagtcccgcctggccatgagcggcggcggcagcagcagcagcagctcggcctcggaggacgagcacgaggcggtgatccgcgagctgacgcgggggcacgagctgacggcgcagctgcgggccgaggccctgcgcgcgctgcgcgggcagggccaggccgaggccaccgcggcattcatcctgcaggaggtgtcccgcgccttcaccgtctgcctctccatcatgagctcgcccgcccgcgccccgccgccgacgatggaaatggccgcgcctgccctggccccgcgacggggccgggacgacagcatcccaagagagcaacggaggacgtcctcgccgcacagcgacgggtaccagtggaggaagtacggccagaagaggatcactaagtcgcccgttccgaggtgctactaccagtgcagcttccaccgcgagcgcagctgccgggcccacaagcaggtgcagcagtgcagcgacggcgacggccacccgccccagtacgtcgtcatgtacttcaacgagcaccgtgcgacacgcgcgggggaaact

SEQ ID NO: 83346 - protein, 186 aa, Zea mays
  misc_feature: Ceres CLONE 1569225
  misc_feature (117)..(182): Pfam Name: WRKY Pfam Description: WRKY DNA -binding domain
MQTQSRLAMSGGGSSSSSSASEDEHEAVIRELTRGHELTAQLRAEALRALRGQGQAEATAAFILQEVSRAFTVCLSIMSSPARAPPPTMEMAAPALAPRRGRDDSIPREQRRTSSPHSDGYQWRKYGQKRITKSPVPRCYYQCSFHRERSCRAHKQVQQCSDGDGHPPQYVVMYFNEHRATRAGET

SEQ ID NO: 83347 - DNA, 968 bp, Zea mays
  misc_feature: Ceres CLONE 1569228
  misc_feature: SWISSPROT Homolog: EC 3.2.1.21 Beta-glucosidase
ccccgcggtggcggccgctctagaactagtggatcccccgggctgcaggaattcgtctcacccctagaaaaaacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcaacgtaccaaattgaaggtgcttggaatgaagatggaaagggggaaagcaactgggatcacttctgccacaatcatccggaaaggatactggacggggagcaattcaaacattgggagcgaattcgtaccatatgtacaaaaccggaccgtccgaattgctcaaaggaaatggggcatgggacgccattatggggttctcctattctctttgggccccagaattacctgcccggaaagggaaacccacaagaaaaggaggttattataacccccggaatggggcattccaagtaactaccaggaaaaacctccattcaactttggtttgcgtaaaaaaaacgggggttaggaaccccttttgttaaagcattttttccccctgtgggaaggtaaccttcaagcgccttataaagacaaaattacggggcggggtttccctagaaaaaaagaattcattaagaacccattgtatgaaaggtttacccccgtctctttgtgcacaaaggggtggccttttggataactcttccggcgaaaaaggttggaaaaaatttgggttggaccttttaaagg

SEQ ID NO: 83348 - DNA, 923 bp, Zea mays
  misc_feature: Ceres CLONE 1569231
  misc_feature: Translation starting site: 166
  misc_feature: SWISSPROT Homolog: EC 1.4.1.2 Glutamate dehydrogenase
aaagctggagctcaccgcggtggcggccgctctagaatagtggatcccccgggctgcaggaattcgtctcacccctagaaaaactcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcgtcccccacccccagtgatgcgtctgtccggagtgatatcaagttgtggccctttcaggtcatttccggggcctgggggagaagccaatgattgttgtccacccacaaggggggaggagaaagcagttttgcagctgaaaaaaatctccccctatgggttctttatccaagatgcggtgagaaattgcttgaagctttacccttgggggagcccggaaacaaagaaaggccggggggttcccaatcccctggcccaacttttaaatgaaccccccggaggccggggcccccaaaaagaaggcctgggggggggattgtccggcccctttaaaggggcggcggggtggtacaccaaaaggagcccaacaggtctggggaggttattcccccttaaggggctctggcaaagaaagaggcctaccccgtggttcggttgagaagaagaaacagcccccccctctcttggactcatgggagggggggtggccccctcttgatgtgcccgccccccccgcacccacgtggat

SEQ ID NO: 83349 - DNA, 818 bp, Zea mays
  misc_feature: Ceres CLONE 1569233
  misc_feature: Encodes the peptide sequence at SEQ ID NO. 83350
ggagctccccgcggtggcggccgctctagaactagtggatcccccgggctgcaggaattcgtctcacccctagaaaaattttttgcgccagagggcagggcaggggccttggcgctacccccgttcttatccccaccccacctcgtgcctcccctcctccccccttcccctctctcgcccctcctccctccgtctcgtctcccaggtcatggcaaaagctggagcaccgggaaaaatagcaagtgggagataaacaggaagagctaggtgaatacttggagaaaaaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgtggtgttccctggcgtccacaacttcgtggatctcctgcagcagaacggcgacaagaaactgggccttcgcctcactcatggcgaagacgtccctccggcgacaagtgcgtgatgggggaagggtgatcttgtggaaccaccccagaaagcttcccgggacgcctggaggacaacaccaatgacaactttgagacatccaggaactggaacccccccattgggcccaaccccataaacttaaacggttcaagggaatttaaacaaaacccgggaaaagaatccaagggttacgggggggggggctaacccaaagggtttttcaaaccaaagggggttcccagaaaacagcccccgggcaaaaaaaaaatatctccccgccccc

SEQ ID NO: 83350 - protein, 48 aa, Zea mays
  misc_feature: Ceres CLONE 1569233
MMGGGLMMDQSVVFPGVHNFVDLLQQNGDKKLGLRLTHGEDVPPATSA

SEQ ID NO: 83351 - DNA, 856 bp, Zea mays
  misc_feature: Ceres CLONE 1569235
  misc_feature: Translation starting site: 255
  misc_feature: SWISSPROT Homolog: EC 3.2.1.4 Cellulase
aaagctggagctccccgcggtggcggccgctctagaactagtggatcccccgggctgcaggaattcgtctcacccctagaaaaaagccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccgggggccgccacatcaagccgctgccggtgccggggccgccgggggccatcgactccaagtacggcgacgcgctcggggtcgcgctccagttcttccaggtccagaaggcggggaagctggagaacaaccagatcccgtggcgtggggactcggcgttgaccgacgggaaggaagcggggctggatctttccagggaatgtatgatgctggggatcacatgaagttcaccttcccgatggcattcacggcgacggtgctctcgtggtcggtgctggagtacggggatcagatgagcgcggcaagcaactggaccctgccctcgatgcactgaagtggattacagaattcccttattgctgcacatccttctgaccatgtgctgtatatccagggtcggggatccctgatctggacccacattggtggggaaagggcccgaaacaatgaccgaaaaaagacttcctccccccgattcacaggaagactccccgggatc

SEQ ID NO: 83352 - DNA, 889 bp, Zea mays
  misc_feature: Ceres CLONE 1569236
ctccccgcggtggcggccgctctagaactagtggatcccccgggctgcaggaattcgtctcacccctagaaaaaaaaaagactccagaaacaaaccccgccgcccctccgcttctctcccgagtcccgactcccgagtcccgtcttctgccccgccccctcctcgcaaaaaccctaacccctcgacctctcaagatggcgtcgccgccgccgccttccgccgcagccgcagccccagcctgcgcggcgttcgggaccgccgccgctggcgcaagtggtggggcacgccttcgtgcatcagtactaccacatcctggaccaggtcgccggaactcgtctaccgcttttaccaggaagtcaggcgcctctggggttccttccggaaccggggacaaccggtttggaaaccggcccctccctggggacccattaacaaacaaaatcgggttcctggggaatcaacccggccggagaattcaagggggggggacacccccggaattcctcttttgggggggggttcacccgggttcttttttgggggcccccttttcggggggggaaaacccttctccccccccaaagtttttggaggggtcttttttttctttttgccccccagggaaaaaggggcttttttttttttttttaaaccaacaattttgcccctccttttttttaaagaaagggggggggggggcaaacaggggggggggaaaaaacaccccccccccaaaaaggggggcccccccccataaagggggcccccccccccaaaagggagaggagcgcccccccccccttttttttttattttttttgaaaaaaaaatatttttttggggggggggagaaaaaaaggtgtttttctcccccgagaggagttttcct

SEQ ID NO: 83353 - DNA, 875 bp, Zea mays
  misc_feature: Ceres CLONE 1569237
  misc_feature: Encodes the peptide sequence at SEQ ID NO. 83354
  misc_feature (797)..(797): n is a, c, t, g, unknown, or other
ctccccgcggtggcggccgctctagaactagtggatcccccgggctgcaggaattcgtctcacccctagaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctccctgccggggctccgggttggccggtggtggggaacctgttccaggtgatcctgcagcgacggcccttcatgtacgtggtgcgcgacctcccggagaagtacgggcccatcttcaccatgcggatggggcagcgcaccctcatcgtggtcacctcggcggagctcatccacgaggcccctggtgaagcagggcccccatgtccccgagcccggcccaagaaaagccccacccggcttcttttttaggggtgggaaagtggcaccgtaaaattgggcccctaagggcccccttgggggggggttttgggcccaaattttttttcccaaaaattgtgtccccccccccgggaaaagggttttctcccggaaacccggaagggggcctgggaaacccaatttttgccccccctttttcccaaaaattttgggggaagaggggcccctgggggaaaaaggaaaaaaatcccccccctaccctttgggagaactccctcctttngatttgttttgggcgccaaaataccccccaaaaaatttctttgggaaaaaaaaaggaggggccttccacaagactttt

SEQ ID NO: 83354 - protein, 113 aa, Zea mays
  misc_feature: Ceres CLONE 1569237
  misc_feature: SWISSPROT Homolog: EC 1.14.13.78 Ent-kaurene oxidase
MDVNDVLLVVLAAALAAMWWRRCSKTGGVDGLPAGAPGWPVVGNLFQVILQRRPFMYVVRDLPEKYGPIFTMRMGQRTLIVVTSAELIHEAPGEAGPPCPRARPKKSPTRLLF

SEQ ID NO: 83355 - DNA, 877 bp, Zea mays
  misc_feature: Ceres CLONE 1569238
  misc_feature (205)..(205): n is a, c, t, g, unknown, or other
  misc_feature (473)..(473): n is a, c, t, g, unknown, or other
  misc_feature (570)..(570): n is a, c, t, g, unknown, or other
ctccccgcggtggcggccgctctagaactagtggatcccccgggctgcaggaattcgtctcacccctagaaaaaattgcatagcatgggcagcacttccacaccacaccacaccacacctcggctgggcctgggatgggggttgggcagggagccccctccttcctttttttcccctccctcaaaaaagcacacccacacactcnttcttcgttccttgaccgagtaaatcctctctcctcctcccgactctcaattgcttcaagcttcatgctttgtcggccccggcccgcccccctatggctcagctcagctcagccaactgctggagtggtagtggttgcttcctctctcttctcacgtcaccatgatcgataagactagctagaatataggtggctggcagtggcagtggcagcgctatcctatatagtgccccccgggcggtgtgctcgcctcgggagctagccttgnaagaagaagcagagagcagagacaccgttgcgtagagggaggaagagtgcttctttcgttcgtcgttgcccaaagcagcagcagtcacttggaattnggacagagcgcgcccagcgctgccggcccggccgccgaccctctgtttgtagcggcggcagcaccagctctcaactgctcaagcaaactaataaagcagccagcagtctgtacacacacaggccgaaccgaacccggcaatgtattctttcgtcgccggccctgggagaaacccctgaacaaccaagagcaggagccactcttttttcattgcagctgccggcaggaagtttcacgggcgggcgttcatctgcaggacgcccccactgatggggacgggcggtctcttgtccctactccttgtctcg

SEQ ID NO: 83356 - DNA, 879 bp, Zea mays
  misc_feature: Ceres CLONE 1569239
  misc_feature: SWISSPROT Homolog: EC 3.2.2.22 rRNA N-glycosylase
  misc_feature (1)..(1): n is a, c, t, g, unknown, or other
naaagctggagctcccgtcgatgggatggattctttctattgaggatctatctggcaggatttattcgtatcaccgctagaaaagattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcggcgatctgttactacggtggcccgtgggggaacaagtttgggctcctgtcgtcacgcgaccgcggtccactcgcaaggggcagtggaacggtgctgctgcccggccaacggcgaaagggcaagtgacctggggggtcgccggcaatggccaagccaagaaaaattttcaacgaagggcccatctccgtcccgcggttccccgggtttcccccaactggggaaacacgcttcccccaaaaaagagaaatcttaagggcgcggggggcgtctca

SEQ ID NO: 83357 - DNA, 1006 bp, Zea mays
  misc_feature: Ceres CLONE 1569240
  misc_feature: Encodes the peptide sequence at SEQ ID NO. 83358
  misc_feature (11)..(11): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (83)..(83): n is a, c, t, g, unknown, or other
gtcgtgggggnccccccagccacccagcccccacagacccctcnacaatttnnnnnnttttggggggttnnnntcaaagcggnactccgctcggtggctgccgcatccgaagagtggatcccccgggctgctgcaatcggcgcacccctagaaaaacccctagaaaaagaaaaccctagcagttcggtagtccctctcctctcgaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgctcctgcagctgaggcaaagaaagaagaggaggaggagggagaagaagagcaagcgctccatggattcaggatcctatcatggatggaatgaagcaaacttgagtgcagcagcaggatcatggcaggaaggcaggggctcccaccaaccgccggacggggccgaagggcaacatcgaaacttctatccgaaaaagaacggggaaaaaggccaggggaccgcttcaaggcgaccatgggacgggagggaaagccttccggggaagggtttcctagaaaaaccgcgggcgaaagggggtccacgaaagccgaaacagacccagaagaccccaacggggtgagaactcggggaggggaggctaggggaaagaacccaccacaggggaaacgggggggagggcgccctgggagacctacgaaaagcgccagcagaaaaagggccccgcccggaggcgcagagaatggccccgcaacggggcccctcgggggggaaaattgagagaggaaaaaagggggg

SEQ ID NO: 83358 - protein, 114 aa, Zea mays
  misc_feature: Ceres CLONE 1569240
  misc_feature (17)..(107): Pfam Name: Ribosomal_60s Pfam Description: 60s Acidic ribosomal protein
MKFVAAYLLAVLAGNASPSADDLTAILESVGCEVDNEKMELLLSQLSGKDITELIAAGREKFASVPCGGGGVAVAAAAPAAGGAAPAAEAKKEEEEEGEEEQALHGFRILSWME

SEQ ID NO: 83359 - DNA, 750 bp, Zea mays
  misc_feature: Ceres CLONE 1569243
  misc_feature: Encodes the peptide sequence at SEQ ID NO. 83360
  misc_feature (524)..(524): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (606)..(606): n is a, c, t, g, unknown, or other
  misc_feature (612)..(612): n is a, c, t, g, unknown, or other
  misc_feature (614)..(614): n is a, c, t, g, unknown, or other
  misc_feature (625)..(625): n is a, c, t, g, unknown, or other
  misc_feature (671)..(671): n is a, c, t, g, unknown, or other
  misc_feature (719)..(719): n is a, c, t, g, unknown, or other
  misc_feature (725)..(725): n is a, c, t, g, unknown, or other
ggagctccccgcggtggcggccgctctagaactagtggatcccccgggctgcaggaattcgtctcacccctagaaaaagtctccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcttgcatttttggagaaataccaattttactcgntcaaggatgcaagtatatttcttgtttaacgggccaataactttaaaattttagggccgggggttttcatcttnnngnnnanaaaaananaaaaaaaaaangggggggggccccccccccccttgtaaaaaaaaaaaaaagtccctngggggggggagaaaaaccaccccccccccccgtgggggggggggggangaaaanaagaaaaaaaataatacttttctcc

SEQ ID NO: 83360 - protein, 69 aa, Zea mays; identical to SEQ ID NO: 8575
  misc_feature: Ceres CLONE 1569243
  misc_feature (2)..(69): Pfam Name: Ribosomal_L38e Pfam Description: Ribosomal L38e protein family

SEQ ID NO: 83361 - DNA, 923 bp, Zea mays
  misc_feature: Ceres CLONE 1569244
ggagctccccgcggtggcggccgctctagaactagtggatcccccgggctgcaggaattcgtctcacccctagaaaaagcctcgtgccctcctcctcctcctcctcccagatctcgtgaccattgccattccctccctccgctacacgccgagcgcccccgtccggaccaggcgtctccgcggctcctagtcctcgctccctccctctcccgtggaggactgccgcggggcggcgagggagaggagatccgtcggtgctggctgctggttggtcggctggtcaatccctttccatcgtttgctggtgcgtgagctcagggtttggacagtttggccccgtctgttgcggattggacccggactggattgggttcgtgtggctgccgcgtcggcgggcgccccaccccagcttgtcccctcccccctagattgcgcgagacggtgcttcaggactgccccctggcgcggaggccgcacaggctcggcggcgccggcggcgagatgaagggcgcgaccatcccttcggtcgcgatcatgccctcgccgctcttcctctggcggttttagggttgtgttggtttcttctatggggcttattgttgttgccaagataagttggggacttcggttatgaagaatgaatgtttgatctcagaagacttattttctttatgagggctttcttgaactataaatcctcttcttccttgggggctttgaataattgggttgtgggggaagtaaatctatgggttttttgcgccattccttctgttgaattatggcaaaagtggttttgattcttcaccaaacaccttttattttctcccgagaagaaattggaggggggtgcctcacctggcgggagaatttaaattggtccccaaccagcaggggacaccccttacctttttagtggtgac

SEQ ID NO: 83362 - DNA, 849 bp, Zea mays
  misc_feature: Ceres CLONE 1569245
  misc_feature: Encodes the peptide sequence at SEQ ID NO. 83363
  misc_feature (682)..(682): n is a, c, t, g, unknown, or other
  misc_feature (751)..(751): n is a, c, t, g, unknown, or other
  misc_feature (814)..(814): n is a, c, t, g, unknown, or other
ctccccgcggtggcggccgctctagaactagtggatcccccgggctgcaggaattcgtctcacccctagaaaaactcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggtgatantacgacaaaccacttcctccctatccatcgtgaagcccctgctttcgttgagcaggccactgagcagcnaattcttgttactggaaatcaggtcgtggatctttctgcaccctaccaaagagtggaaaaatnggtctatttcgtggtgcaggagtgggtaaaactgt

SEQ ID NO: 83363 - protein, 235 aa, Zea mays
  misc_feature: Ceres CLONE 1569245
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (180)..(180): Xaa is any aa, unknown, or other
  misc_feature (203)..(203): Xaa is any aa, unknown, or other
  misc_feature (224)..(224): Xaa is any aa, unknown, or other
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDXTTNHFLPIHREAPAFVEQATEQXILVTGNQVVDLSAPYQRVEKXVYFVVQEWVKL

SEQ ID NO: 83364 - DNA, 976 bp, Zea mays
  misc_feature: Ceres CLONE 1569250
  misc_feature: Encodes the peptide sequence at SEQ ID NO. 83365
acccgcggtggcggccgctctagaactagtggatcccccgggctgcaggaattcgtctcacccctagaaaaagaccggcgtgcgtgccattccacgctctcgcggctcgtgtgccagcggtgaccggcgttcgtgctcgtccagtccaccaggcgctgctgttccggcaagccagccagcagcagcagccgccgccgccgccgtctcggagctcgagctcctagtgccccggggcccaggcggcggcgccatggaccagctccggcccgagccggccgcgggcgcgcacgagatcgagaagacggcggcgccggacgtggagtcggagctcgcggcggcggagccggagccggagcgcgtgccgccgtggcgcgagcaggtcaccgcgcgcgggatggtggcggcgctgctcatcggcttcgtctacacggtgatcgtcattgaagctgagcctcaccacggggggctcaccccccacccatgaaacgtctcccgccgcgctgcttcgccttcctgggcgctcccgcggctgggacgcgcggccctccggccgcctaaggcatttgcctggccgcccccctttcaccccgccagggaagaaacaccgttcggtggagaaacctgcggtccgtccgccctggctacaaccaataaggggtttccggccggtgggggtttcgggggccgttttccctggctggggcccttggaccaagaaaagactgtaccaaacctctttcccggggttgaaccacacccccgggaaaacctgtgccggggaaacctacacagggaagccctgcccaccgggctggaatgaaaccggaattccttccttcgccggtcaagattttgtggggggccccccacccttggtttcccaccgaaaaaaagggggttcgtatattaaataaaaaaactccttttttcacaagggggaacagcccccgcgggtttctcaaaaacggggtctcac

SEQ ID NO: 83365 - protein, 77 aa, Zea mays
  misc_feature: Ceres CLONE 1569250
MDQLRPEPAAGAHEIEKTAAPDVESELAAAEPEPERVPPWREQVTARGMVAALLIGFVYTVIVIEAEPHHGGLTPHP

SEQ ID NO: 83366 - DNA, 858 bp, Zea mays
  misc_feature: Ceres CLONE 1569251
  misc_feature: Encodes the peptide sequence at SEQ ID NO. 83367
  misc_feature (696)..(696): n is a, c, t, g, unknown, or other
  misc_feature (795)..(795): n is a, c, t, g, unknown, or other
  misc_feature (848)..(848): n is a, c, t, g, unknown, or other
ctccccgcggtggcggccgctctagaactagtggatcccccgggctgcaggaattcgtctcacccctagaaaaatctccgccccctccggcgtcgcacgacgccaacgttgacgtgctagatgccggcctcggcggcccgcagcactacgactcggattcgcccgctgctgccgggcctgtcttggccccagcagcagccgcggccaccgtgatcgccgtgtcccacaccaagggctccggttccagcgtggcgcgcaagtgcgtcaagaggaatgatagcatttggggagcgtggttcttcttcacccactacttcaagccactcatgtccaccgacaagggtggcaaggcgaaggcagccaccaccggcgggaacggtaatagtgccagtgccactctggacgctttcctggtgcagcacgacatggagaacatgtacatgtgggtgtttaaggagcggctggagaatgccctggggaagatgcagctgaggagcttcatgaatgggcactcgcgccttggggatccacagttccctttcggcgcagacaaagggtttgtgcgctcacaccggatgcagcgcaagcattatcgtgggctctctaacccgcagtgtattcacgggatcgaaatcgtgagggcgccaaacttggcaggtgtacctgagtctgatttaaagaggtggatggagctcnaccgggagggatgccaatttctcgatcccaaccgaggcaagtgatttcgagtcttggaggaatctgccgagcacggactttgagctcgagaggccaccnaactgtgttcctacaaagagtagctcacatgggcaccacaagaaggttgctgnacgggttctg

SEQ ID NO: 83367 - protein, 245 aa, Zea mays
  misc_feature: Ceres CLONE 1569251
  misc_feature (232)..(232): Xaa is any aa, unknown, or other
PRGGGRSRTSGSPGLQEFVSPLEKSPPPPASHDANVDVLDAGLGGPQHYDSDSPAAAGPVLAPAAAAATVIAVSHTKGSGSSVARKCVKRNDSIWGAWFFFTHYFKPLMSTDKGGKAKAATTGGNGNSASATLDAFLVQHDMENMYMWVFKERLENALGKMQLRSFMNGHSRLGDPQFPFGADKGFVRSHRMQRKHYRGLSNPQCIHGIEIVRAPNLAGVPESDLKRWMELXREGCQFLDPNRGK

SEQ ID NO: 83368 - DNA, 837 bp, Zea mays
  misc_feature: Ceres CLONE 1569253
  misc_feature: Encodes the peptide sequence at SEQ ID NO. 83369
ctccccgcggtggcggccgctctagaactagtggatcccccgggctgcaggaattcgtctcacccctagaaaaaaaaaccagagcgaggccgcactgcccgcgagtcctccactctgaccgcacgatggctgcgctgcgcctcgcctccttcaccctccgccccgccgctgcctcggcctccgcctcctccggcgcgaccccagccgcgtccggctccgtctccgtctccttcgcccgcgcggcgcgggggctgccctccctccgcctggccccgccccgccgccgcggggacctcgccaggccccgcgccgcggccgaggccgcggcggagagctacgcgtccgcgctgtcggaggtggccgtcgagaacggcaccctcgagcagacggtctccgacctggagaagctggagaaggtcttcgcggacgaggccgtcgccgaagtcttcgacaacccctactgtccgcgcgaggaggaggccgagctcatcgacgagatcggcaggtcgtccgagctgcagccgcacgtcgtcaacttcctcaacgtcgtcgtcgacacttccgcgcgggcatcgtgccgcaaatcttcgcccaatccaaaaacgtttacatttggttacggggaccgagggcccccacggcaccctccgtcggggaattccagatcccaggacttggcccaaatcccccaaccccttccgaaaaatacccgggccccaaaaattccccatttaaaaccaattttaacccggaaatttattgccgggtttcccggggaaaaaagggccgcgaggggctcccgttaaaacacaatagagcgcccggaaacaaaattag

SEQ ID NO: 83369 - protein, 226 aa, Zea mays
  misc_feature: Ceres CLONE 1569253
  misc_feature (67)..(225): Pfam Name: OSCP Pfam Description: ATP synthase delta (OSCP) subunit
  misc_feature: SWISSPROT Homolog: EC 3.6.3.14 H(+)-transporting two-sector ATPase
MAALRLASFTLRPAAASASASSGATPAASGSVSVSFARAARGLPSLRLAPPRRRGDLARPRAAAEAAAESYASALSEVAVENGTLEQTVSDLEKLEKVFADEAVAEVFDNPYCPREEEAELIDEIGRSSELQPHVVNFLNVVVDTSARASCRKSSPNPKTFTFGYGDRGPPRHPPSGNSRSQDLAQIPQPLPKNTRAPKIPHLKPILTRKFIAGFPGEKRAARGSR

SEQ ID NO: 83370 - DNA, 828 bp, Zea mays
  misc_feature: Ceres CLONE 1569254
  misc_feature: Encodes the peptide sequence at SEQ ID NO. 83371
gagctccccgcggtggcggccgctctagaactagtggatcccccgggctgcaggaattcgtctcacccctagaaaaactcttcgtcgatcggtgtccctagcctccccctgcccggctgtccttctcctcgatttcgcaagctcctggttacggcggcatctatcgttccgccgcatcgtctctctcgcgacgctgccccagaccgccgagataatggctggccaccgaaacagtcatggaaagcgccagtctgattttactgaaaatggaggcggtaagagaagaaatcctggcgatgatacatatgcacctggtcctgatgacactgtgtatcgctacctctgtgcctctagaaaaattgggagtatcattggcaggggtggagaaattgcaaagcagttgaggactgagacccaagctaagatcaggattggcgagagtgtccctggatgtgatgagcgagttattaccatatttagcacaagcaggaaaactaataccatcgatggtgctgaagatgaggtttgccctgctcaggatgccctctttagagttcatgagaaggctgccagtgatgaggggctttgggaacgaagacagcgaagaaatttcacctcagttactgttcgcttgcttgtgccatcagaccagattggatgcatattggaaaaagggggcagatcattccaggaatccccagggggactggtgcccaaaacgggggcccttgaaaaggaaaatatccccccccgggggggccttagggggaaaaaaaatttccccaaatttgggggggggcaccggaatttttcaaaaaaaagggtttc

SEQ ID NO: 83371 - protein, 204 aa, Zea mays
  misc_feature: Ceres CLONE 1569254
  misc_feature (39)..(104): Pfam Name: KH_1 Pfam Description: KH domain
MAGHRNSHGKRQSDFTENGGGKRRNPGDDTYAPGPDDTVYRYLCASRKIGSIIGRGGEIAKQLRTETQAKIRIGESVPGCDERVITIFSTSRKTNTIDGAEDEVCPAQDALFRVHEKAASDEGLWERRQRRNFTSVTVRLLVPSDQIGCILEKGGRSFQESPGGLVPKTGALEKENIPPRGGLRGKKNFPKFGGGHRNFSKKRV

SEQ ID NO: 83372 - DNA, 1022 bp, Zea mays
  misc_feature: Ceres CLONE 1569256
  misc_feature: Encodes the peptide sequence at SEQ ID NO. 83373
  misc_feature (1012)..(1012): n is a, c, t, g, unknown, or other
cgctctagaactagtggatcccccgggctgcaggaattcgtctcacccctagaaaaattcccccgtaataataaccgaatccccagaccaaatcgccgtcgccgtcgcatcgcagcagcgggagtcccagggtcccggaccgaatccatttccagacacccaaggccaagatccatcgctcgttccaacctgcctcctccttcttctgcttggtcgtctgatctcgttttccattcgtgtccaatccgatccagccaaccgctgtgaatgatggcgctcaacctgtcccaccagaccggcgcggccgtggcggcggcaccggcggcgccacgagcggccgtcgtcgcggcggcggccacggcgccacgctcggtcgtccacccccccgcgggcaccgtggagccgccgcccgcgtcggcgcccgcccccgcttcgggggctccagctgcagaacaatgacgggtggaccccggccccccgcgcagggcgccccaacgcggtgaaagcgggaccctccccattggcgtgcccaggctcttggtgggaggcccgccgccccaaaggcggaaaaaacgcccaaacattccgcctccaaaactttcctgaaagcaagggcccgggggggccaccgctccttccggtaatggtaaggcccgactcgcaaaaccccttttgcccccaagagggacgaggcgaaacttccgctttaatcctaggtgtcctaaggggccgtttgggagagcccaaattgctgtggtggggccgccttaaaaaaaacgcccgagggtggggagaggggacttcatgtggttggggaacctctggggggggggggaaataccccaaaggtcgctaaccgggctcttcggggcgtataataagatctctaaccggggtgtaagggtgcggcttcatcgtggagatttggctcgcgaagagaccgcggggcctccgagggcgccgtaggtcggcttaagtttgtctatatcaacagacttggggcgtggaaaantcatatcgat

SEQ ID NO: 83373 - protein, 63 aa, Zea mays
  misc_feature: Ceres CLONE 1569256
MMALNLSHQTGAAVAAAPAAPRAAVVAAAATAPRSVVHPPAGTVEPPPASAPAPASGAPAAEQ

SEQ ID NO: 83374 - DNA, 858 bp, Zea mays
  misc_feature: Ceres CLONE 1569258
  misc_feature: Encodes the peptide sequence at SEQ ID NO. 83375
  misc_feature (672)..(672): n is a, c, t, g, unknown, or other
  misc_feature (682)..(682): n is a, c, t, g, unknown, or other
ggagctccccgcggtggcggccgctctagaactagtggatcccccgggctgcaggaattcgtctcacccctagaaaaagggcctggcttttcgttggagtccaacaatgctttgtctcccacagtaatcacagaaaaggtgttgccttcatctgctagtcctattaactcccttctggctggagagaagattcaatttggggcagtaacgtcaccaaccatgctacccccagtcagccgaactgtttcaagtggtcttggagctccaggttcatctaggcctgatatgaagatcgatcgaggcttgcctagcgataacagtggtcctgataaggcaaattccaaggaattatgtccgagtaccgaggatgcggaagcagaggctgaagcagctgcttctgctgtggctgtggcagctattagcactgatgagggatctccagctgatgcaactactgcatcggctccagacaagagctttacaagcaaggatctcagtgggttaacatcaggaggtatgatctttgcattgtcaactactttaattaagacattgctatatgattatgtagctatatttattgtgttatggacaaaactgaagcaggggcaagaacaggtcaagctggtcaatcatccacagaagagccactcgcagttgctcttcctgcangactatcggntgatactccatccccatgtcctgtggcctcctatagccagtccacaagcatcagggccaatgctttctcagtttcagggtgcacagccattcccacttttcctgctttgatatgaactcgatgttaggagggcaattttttgcatttggcccaagtgacgaatctggctggtctta

SEQ ID NO: 83375 - protein, 263 aa, Zea mays
  misc_feature: Ceres CLONE 1569258
  misc_feature (224)..(224): Xaa is any aa, unknown, or other
  misc_feature (228)..(228): Xaa is any aa, unknown, or other
GAPRGGGRSRTSGSPGLQEFVSPLEKGPGFSLESNNALSPTVITEKVLPSSASPINSLLAGEKIQFGAVTSPTMLPPVSRTVSSGLGAPGSSRPDMKIDRGLPSDNSGPDKANSKELCPSTEDAEAEAEAAASAVAVAAISTDEGSPADATTASAPDKSFTSKDLSGLTSGGMIFALSTTLIKTLLYDYVAIFIVLWTKLKQGQEQVKLVNHPQKSHSQLLFLXDYRXILHPHVLWPPIASPQASGPMLSQFQGAQPFPLFLL

SEQ ID NO: 83376 - DNA, 943 bp, Zea mays
  misc_feature: Ceres CLONE 1569259
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (355)..(355): n is a, c, t, g, unknown, or other
  misc_feature (356)..(356): n is a, c, t, g, unknown, or other
  misc_feature (455)..(455): n is a, c, t, g, unknown, or other
  misc_feature (456)..(456): n is a, c, t, g, unknown, or other
  misc_feature (836)..(836): n is a, c, t, g, unknown, or other
  misc_feature (837)..(837): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctgggactccccgcggtggcggccgctctagaactagtggatcccccgggctgcaggaattcgtctcacccctagaaaaaagcgggacgaactcgtcactggtgtgggccgtggctgtacgccgcagagtgaagcgagacgagacgacgatgcgcaagtgggcgctctcctccgcgctcctcctcctcttccnntctcacaccctcccgacctagctaagaagctacaggtgaatgcggaagagagcagcgatgacttagctaacccacccaaggtagaaggagaggcctggnntgctgtcccctcatggcctggtccacccgactccttggaaggtttccccaaaaggggaaaacttaaaatcttattcttcttttgggaaaaaaactttttttaggggagacccccccccccccaaaaaaaattttttgaatttttcccccggcccctaaagggggttcccccaaaactctcctttggggaagaaatttttttttttttttaaaaaattttctctctttttttttaggggggaaaaccagggggggggggtttttttttttctccctctcggggggggggggggggccttcctttattttcccaaagggggcgccccccccttaaaaaagagcatttttgtgggaaaaaaaaaaaaaaaaaaaggggggggnnccccttttttcccccccccttnnnnnnnaaaaaataaaagagaaaaaaaatccttttcttcggggggggaaaaagaggggtacccccccccccctcttacaaaaaa

SEQ ID NO: 83377 - DNA, 853 bp, Zea mays
  misc_feature: Ceres CLONE 1569261
  misc_feature: Translation starting site: 237
ggagctccccgcggtggcggccgctctagaactagtggatcccccgggctgcaggaattcgtctcacccctagaaaaagcgcacaacgatccgagcgcgcccgtccctggcccagaagatcccaacgccgggcgcgcgtccccatccgtccgccgcgccggggtatctatcgcggcgtcgtggggtcggagctccgggtccggggccgggcaggcgggaagcagggcgcaagcgcaatggtggagatagggagccgggtgcgggggttcctgcggaaccggtggctggtgttcgtggcgtcgatgtggatgcagtcctgcgccggggtcggctacctattcggcagcctctcgccggtgatcaaggcctcgctcgggtacaaccagcgccaggtggcccggctcggcgtcgccaaggacctgggcgacagcgtcggcttcctcgccggcacgctctgctccgtgctcccgctctgggccgcgctcttcgtcggcgccgcgcagaacctcgtcggatacggatgggtctggctcgccgtcacgcggggtgtccccgtgcccccgctctggggggatgtgcattctaatcttcatcgggaacaagggtgagacatacttcaacactgctgcaccttgtctcatgtggttcagaacttcccccaagagcctggacccattttttggtatcctccaaaggattcccttggaataaaggggggccaattctaaccccgaatttttgccaattgggcactccccccgggaagagaccggcgctcgaaccttccaggggtggcgatttggccccaaaaaagagatgtttaaaacctttaatgggttcttttgtaaaacat

SEQ ID NO: 83378 - DNA, 910 bp, Zea mays
  misc_feature: Ceres CLONE 1569262
  misc_feature: Encodes the peptide sequence at SEQ ID NO. 83379
  misc_feature (638)..(638): n is a, c, t, g, unknown, or other
  misc_feature (658)..(658): n is a, c, t, g, unknown, or other
ctggagctcaccgcggtggcggccgctctagaactagtggatcccccgggctgcaggaattcgtctcacccctagaaaaagcctcggccgtaaacagagtgattgttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgccgccgccgccgctgccggacgccgccccgaagctggggatttctaacaagttcatcccacccctctgcggtgacccgcagaccgagcagctggccttcgagggctacaggaggggcgctgctgcagcccgagttccggctggagaagagacggccaacgcgctgaccctgcagctgatcagggagaagcagtggggctcccctggagctgctggtccaggacttcagggcccacggcgtgctcccgggagaagcggacgtgccgcgcggcttcgtcccctgctgcatcagggnggggggaggttcgggctccnccgacgcgggggctcgggggtcttcaaggcaaaggaagggagcccccccctgccatgggctttcaggggcggccattgaagcggttcaacagggctgcccatgttccggaaaaacggggccttttgttccggcaggcgaaggggggcccccccttgcccttaacccccgaacccctaccgtggcctaatatggggggttgcgggcccctctgggcaaacccgaaaatgggggcttttcctttttaaaccgtg

SEQ ID NO: 83379 - protein, 195 aa, Zea mays
  misc_feature: Ceres CLONE 1569262
  misc_feature (170)..(170): Xaa is any aa, unknown, or other
MAKCYSDWPPIPPFHPSRRTPPQSHASPITIRRQLASFVLHCSRSCAPLLEPKNLPDEFEAVPATPPPPLPDAAPKLGISNKFIPPLCGDPQTEQLAFEGYRRGAAAARVPAGEETANALTLQLIREKQWGSPGAAGPGLQGPRRAPGRSGRAARLRPLLHQGGGRFGLXRRGGSGVFKAKEGSPPLPWAFRGGH

SEQ ID NO: 83380 - DNA, 848 bp, Zea mays
  misc_feature: Ceres CLONE 1569265
  misc_feature: Encodes the peptide sequence at SEQ ID NO. 83381
ctccccgcggtggcggccgctctagaactagtggatcccccgggctgcaggaattcgtctcacccctagaaaaaaaaaaaaaaagccctcacatcgcctgaccgacgcgcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgccggagacgcagcaggaccagatccgcctgctcaagcgcttcaacgttggcgaggactgccccgtcttcgacggcctctacagcttctgccagacctatgcgggtgcctccgtcggcggggccgtcaagctcaaccacggccacgacatcgcaatcaactggtcggggggcctgcaccacgccaaagagtgcgaggcgtcgggcttctgctacgtcaacgacatcgtgctcgccatactcgagctgctcaagcatcacgagaggagtctgtatgtcgatatcgatatccaccatggcgatggaagtggaagaagctttctacacaacagacaggtttatgactgtctc

SEQ ID NO: 83381 - protein, 210 aa, Zea mays
  misc_feature: Ceres CLONE 1569265
  misc_feature (24)..(210): Pfam Name: Hist_deacetyl Pfam Description: Histone deacetylase domain
MDPSSAGSGGNSLPSVGPDGQKRRVCYFYDPDVGNYYYGQGHPMKPHRIRMTHSLLARYGLLNQMQVYRPNPARDRDLCRFHADDYINFLRSVTPETQQDQIRLLKRFNVGEDCPVFDGLYSFCQTYAGASVGGAVKLNHGHDIAINWSGGLHHAKECEASGFCYVNDIVLAILELLKHHERSLYVDIDIHHGDGSGRSFLHNRQVYDCL

SEQ ID NO: 83382 - DNA, 855 bp, Zea mays
  misc_feature: Ceres CLONE 1569268
  misc_feature: Encodes the peptide sequence at SEQ ID NO. 83383
  misc_feature (548)..(548): n is a, c, t, g, unknown, or other
ctccccgcggtggcggccgctctagaactagtggatcccccgggctgcaggaattcgtctcacccctagaaaaaagcctcctcgcaggcgaccttgcgtacgtacgtcgtagcggatcgtccagctcgctcgccaccgccatggacccgtacaagcatcgcccgtcgagcgccttcaacgccccgtactggaccaccaactccggcgcccccgtgtggaacaacgacagctccctcaccgtcggcgcacgaggtcccatcctgctggaggactaccacctggtggagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgctcggggtgcagacgcccgtcatcgtccgcttctccacggtgatccacgagcgcgggagccccgagacgctgcgcgacccgcgcggggtccgccgtcagttctacacccggggaggcaactggggacctggntgggaaacaacttccccgtctttcttcatccgcggaggggacaaaggttcccggaactggtgcacccccttcaatcccaacccccgggaccccattccaggacaactggggccattcctccaacttttttctcaccaacccggaaaggcccgcccaatggtcttcttccttctttgaaggaaggtgggaattccccccccaatatccgccccattgggaaggggatccgggggggacaaaaaaaaacgctctttaaacccggccgggggacccttcccccaaagttaaaatttcccgggggggcccc

SEQ ID NO: 83383 - protein, 194 aa, Zea mays
  misc_feature: Ceres CLONE 1569268
  misc_feature (18)..(190): Pfam Name: Catalase Pfam Description: Catalase
  misc_feature: SWISSPROT Homolog: EC 1.11.1.6 Catalase
MDPYKHRPSSAFNAPYWTTNSGAPVWNNDSSLTVGARGPILLEDYHLVEKLANFDRERIPERVVHARGASAKGFFEVTHDITHLTCADFLRALGVQTPVIVRFSTVIHERGSPETLRDPRGVRRQFYTRGGNWGPGWETTSPSFFIRGGDKGSRNWCTPFNPNPRDPIPGQLGPFLQLFSHQPGKARPMVFFLL

SEQ ID NO: 83384 - DNA, 903 bp, Zea mays
  misc_feature: Ceres CLONE 1569270
  misc_feature: Encodes the peptide sequence at SEQ ID NO. 83385
  misc_feature (272)..(272): n is a, c, t, g, unknown, or other
  misc_feature (276)..(276): n is a, c, t, g, unknown, or other
  misc_feature (279)..(279): n is a, c, t, g, unknown, or other
  misc_feature (281)..(281): n is a, c, t, g, unknown, or other
  misc_feature (282)..(282): n is a, c, t, g, unknown, or other
gagctccccgcggtggcggccgctctagaactagtggatcccccgggctgcaggaattcgtctcacccctagaaaaaagggcaatattccccccggaccaaactagatcagcgaaacccactccgctctcccgagatcggacacatggcggcggcagcagtgacgtccaacggcggcgcagtggccgcgaacgggccggcgcccggcaggctggcctccgtgtacagcgaggtgcagacgagccggctcctgcacacgctgcccctcccctnccgntcncnntccgctccaacttctcggtcgtcgacggccccgccagctccgccgcgggtaaccccgatgagatcgccaagctcttccccaacctgttcggccagccctcggcgtcgctggtgcctttcggcccgaagccccgcggcgaccagggccgctaaagggtcggtgtcgtgctctcttgtggaacaggcgcccggcgggcaccaatgccatctggcggcatccttggaattacctttcggaaagcgggcaaaagggaccccccttctttggaatcaaagggaaggcccccgcggggttctaaaagggcaaaaattggggaacccccttcacaatttgtggtccccccaaaaaacccgggggggattttaaaattttttccggggggggagggaaaaaaattaaaaccccgggagtttttttgggggggtgaaaaaaacaccccccccccccttttttttgggggagcctttttttctcttgggggggggggaaaaaaaaaaaaaaaatgtgggtctttttctgggaagaaaatttttggggagagggagaaacaaaaaacaatttttttttttgttgcccccccccaaaaaactttggggggggaaataaaaaaagagggggggc

SEQ ID NO: 83385 - protein, 143 aa, Zea mays
  misc_feature: Ceres CLONE 1569270
  misc_feature: SWISSPROT Homolog: EC 2.7.1.90 Diphosphate--fructose-6-phosphate 1-phosphotransferase
  misc_feature (92)..(92): Xaa is any aa, unknown, or other
  misc_feature (93)..(93): Xaa is any aa, unknown, or other
  misc_feature (94)..(94): Xaa is any aa, unknown, or other
APRGGGRSRTSGSPGLQEFVSPLEKRAIFPPDQTRSAKPTPLSRDRTHGGGSSDVQRRRSGRERAGARQAGLRVQRGADEPAPAHAAPPLPXXXRSNFSVVDGPASSAAGNPDEIAKLFPNLFGQPSASLVPFGPKPRGDQGR

SEQ ID NO: 83386 - DNA, 878 bp, Zea mays
  misc_feature: Ceres CLONE 1569276
  misc_feature: Translation starting site: 332
  misc_feature: SWISSPROT Homolog: EC 4.1.1.50 Adenosylmethionine decarboxylase
  misc_feature (661)..(661): n is a, c, t, g, unknown, or other
  misc_feature (878)..(878): n is a, c, t, g, unknown, or other
ctccccgcggtggcggccgctctagaactagtggatcccccgggctgcaggaattcgtctcacccctagaaaaattcagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctcatctccagcattgtgttctgattcacctgctccaatggctngtctttctgctgctgatgcttcccggtctcagctatcgggtttgagggctatgagaagcgccttgagatcacatctctgaggcacctggtcttgtggaccctcatgggtggtggtttgcgtgccctctccaggggcccagatgactctggttctggatctgccacggtgcacaatcgtgttcgagctcttcaacaggaatttccactcctatgtccn

SEQ ID NO: 83387 - DNA, 768 bp, Zea mays
  misc_feature: Ceres CLONE 1569280
  misc_feature: Encodes the peptide sequence at SEQ ID NO. 83388
  misc_feature (366)..(366): n is a, c, t, g, unknown, or other
ctccccgcggtggcggccgctctagaactagtggatcccccgggctgcaggaattcgtctcacccctagaaaaaactcctctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttggcagtctcgtctgggctgtgcggtcccnctgtccggccctcctcgttccagccccctcgtcggccacctctttcgaacgggattgggcccccgccgccttcgcccctttggggggcccgcagggccctttaatcgcccccccgggggccccgcgggggaatttcccccccaaaaacccgggggctcaccccggggggggggtttttttcccccgaaaaaaccctgggggggggaaaatttttttttggggggagaaaaaaaaaaaatttcccccccccggggggggggttaaaaaagaaggcgcccctcttgggggggggcagcaccttaattggtggggggggggtccactccccctcttcctaatgaaagaaaaaaaaaataattttttgtggggggcggggggggtccccgcacccgaaaaaggagg

SEQ ID NO: 83388 - protein, 199 aa, Zea mays
  misc_feature: Ceres CLONE 1569280
  misc_feature (66)..(66): Xaa is any aa, unknown, or other
MPPRTAPAATSTPPRKVPLRKLLRAASVACGVQFGWALQLSLLTPYVQELGIPHAFGSLVWAVRSXCPALLVPAPSSATSFERDWAPAAFAPLGGPQGPLIAPPGAPRGNFPPKNPGAHPGGGVFFPRKNPGGGKIFFWGEKKKKFPPPGGGVKKEGAPLGGGQHLNWWGGGPLPLFLMKEKKNNFLWGAGGVPAPEKG

SEQ ID NO: 83389 - DNA, 852 bp, Zea mays
  misc_feature: Ceres CLONE 1569283
  misc_feature: Encodes the peptide sequence at SEQ ID NO. 83390
  misc_feature (655)..(655): n is a, c, t, g, unknown, or other
ctccccgcggtggcggccgctctagaactagtggatcccccgggctgcaggaattcgtctcacccctagaaaaacccttccctcccgtaccgtatcagtctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggattcagcacgaagagtcaaccttgccactatatcaaggaccagactttgcagcctgcccttgctaatgccatcttcagtactatagcttttgtgcttggtgcagtcacctcactagtttccggctttnctggaatgaagatcgcaacttatgcgaatgcccgggacactttagagcccagaaaggtgtcggaaagcattttatactgcctttcgagctggtgcagtaatgggcttcctgcttgctgccagcgggcttttgggttcttacattgctatcaatttgtttggaaatttatacggggatgactggggaggtctttttgt

SEQ ID NO: 83390 - protein, 217 aa, Zea mays
  misc_feature: Ceres CLONE 1569283
  misc_feature: SWISSPROT Homolog: EC 3.6.1.1 Inorganic diphosphatase
  misc_feature (159)..(159): Xaa is any aa, unknown, or other
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTLQPALANAIFSTIAFVLGAVTSLVSGFXGMKIATYANARDTLEPRKVSESILYCLSSWCSNGLPACCQRAFGFLHCYQFVWKFIRG

SEQ ID NO: 83391 - DNA, 854 bp, Zea mays
  misc_feature: Ceres CLONE 1569285
  misc_feature: Encodes the peptide sequence at SEQ ID NO. 83392
  misc_feature (572)..(572): n is a, c, t, g, unknown, or other
  misc_feature (596)..(596): n is a, c, t, g, unknown, or other
  misc_feature (644)..(644): n is a, c, t, g, unknown, or other
  misc_feature (656)..(656): n is a, c, t, g, unknown, or other
  misc_feature (678)..(678): n is a, c, t, g, unknown, or other
  misc_feature (765)..(765): n is a, c, t, g, unknown, or other
ctccccgcggtggcggccgctctagaactagtggatcccccgggctgcaggaattcgtctcacccctagaaaaagggagagaaagccagacaggactcctcctccttccctcccctaaaagctaaaaacatttggagagagagagagagagagggagatagaggggaaaccgagcaaccaagacgcagacgacgatggagcgagcggacgaggacgcgtgccgggtggcgctgctggacgcggacggcggcggcggcgagggcggcaagaagcagcagcagctcgcggcgcgggtgtgggaggagtcgaggaagctgtgggacatcgtggcgccggccatcttcagccgcgtcgtcacctacagcatgaacgtcatcacgcaggccttcgccggccacctcggcgacctcgagctcgccgccatctccatcgccaacaccgtcgtcgtcggcttcaacttcggcctcatgctgggcatggcgagcgcgctggagacgctgtgcgggcaggcgttcggcgcgaggaagttccacatgatgggcgtgtacatgcagcggtcgtggatcgtgctngtcatgtgcgcggtgctgctgctngccatgtacttcttcgcggaggacgtgctgctgctgacggggcagccnccggagctggcngcaatggcggggaaggtgtgcntgtggttcatcccgctgcacttctccttcgccttcctcttccggctgcagcgcttcctgcagtgccagatgaggaactccgccaagnccgcgcccgcccagcggcgctctgcgtccacctcctcgccagctgggtctcggtctcaggcttcggcttcgggcctggccgcatcgccc

SEQ ID NO: 83392 - protein, 220 aa, Zea mays
  misc_feature: Ceres CLONE 1569285
  misc_feature (47)..(216): Pfam Name: MatE Pfam Description: MatE
  misc_feature (162)..(162): Xaa is any aa, unknown, or other
  misc_feature (191)..(191): Xaa is any aa, unknown, or other
MERADEDACRVALLDADGGGGEGGKKQQQLAARVWEESRKLWDIVAPAIFSRVVTYSMNVITQAFAGHLGDLELAAISIANTVVVGFNFGLMLGMASALETLCGQAFGARKFHMMGVYMQRSWIVLVMCAVLLLAMYFFAEDVLLLTGQPPELAAMAGKVCXWFIPLHFSFAFLFRLQRFLQCQMRNSAKXAPAQRRSASTSSPAGSRSQASASGLAASP

SEQ ID NO: 83393 - DNA, 866 bp, Zea mays
  misc_feature: Ceres CLONE 1569286
  misc_feature: Translation starting site: 143
  misc_feature: Pfam Name: efhand_like Pfam Description: Phosphoinositide-specific phospholipase C, efhand-like
  misc_feature (42)..(42): n is a, c, t, g, unknown, or other
  misc_feature (57)..(57): n is a, c, t, g, unknown, or other
  misc_feature (69)..(69): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
  misc_feature (389)..(389): n is a, c, t, g, unknown, or other
tcacccgcggtggcggccgctctagaactagtggatcccccngggctgcaggaattncgtctcaccccntagnnnanannaaaaaaaaaaaaaaaaaactcggcgcctccacaactggcccgcccgcccgcccgcaaacaccatgggcaccacgtacaagtgctgcttcatcttcaagcgccggttccacacccgcgacgcgccgccgcccgaggacgtccgcgcccttttctccgtccacgccggcgggggaccccacatgggcgccgacgatctgcgacgctacctggtggccacgggccaggaggaggccgaggtggagcggctgctggagcagatcgtccagggccgtgcccgcgtcccgcgcctcgcccgcccgctcctctggntcgacgacttccaccgctacctcttctcgcacgacctcaacccgcccatccgtcaccccgcaggtgcaccacgacatgacgcgcccgctctcccactacttcatctacacgggacaaacttctacctcacggcaaacagcttagcagcgactgcggcgatacccccatcatcatggcactgaagaaaggggtcagggtcatccaacttcgaaatggggcccaaattcaacccatggacaacttcaacttcggggccggggagggaactctgacaaccccccgttttcctccatcaaatggcctgaaaaccctccaagaaaacccccctttggttggacccccccaaatccggggaaaaaaaaaaccttttgaaaaaacccccttcccctttttaaatttcagggaaaaaagtttcccaaaaaaagtgtgtttttaaaaaatttttttggagaaaaatatttgtgtaattcccccccc

SEQ ID NO: 83394 - DNA, 1001 bp, Zea mays
  misc_feature: Ceres CLONE 1569288
  misc_feature: Encodes the peptide sequence at SEQ ID NO. 83395
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
  misc_feature (60)..(60): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (83)..(83): n is a, c, t, g, unknown, or other
  misc_feature (890)..(890): n is a, c, t, g, unknown, or other
gtggggcgcgaccccccagccccaaaggcacaagaataacttacnnccatttngtttttntggggnnnnnnnccaaagctggnactccatggcgtggcggccgcatcagaacagtggatcccccgggctgctccaattcgtcgcacccctagaaaaaaccacaccagccaatgggtgaacctaaacccccacgccccactcagtccagccgaccagccaccctcaccatgcctcgccgcgcaggagccgcctggccatgcttcctcctgctccacattatcgcccacctacacctcgccgtcaacgccgccgacgccgacgctctgctcaccttcaagtcctccctcgaccgctccgaccgcctcccgtggcgccccgacacggcgcccgctttctgcgcctcctggcccggcgtgcgccagtgcgcccccgccggccgcgtcaccaagctcgtcctcgagggcctcaacctgacgggctccctcaccgccgcgctcctcgccccgctggccgagctgcgggtcctcagcctcaagtccaacgccctcacaggccccatcccggaggccctcccgcgcgcgctcccaaatctaaagctgctgtacctcgccgacaaccgcctccaaggacgcgtccccggccaccctcgccatgcttcaaccgggccaccgtcatcgtccccccccgggcaacggactccaggggccagatgccgcccctcccctcggcgacctggccacggcctggaaccccgcgggctcctcgaaccggaaaccggcgctccccgggggcccgggcccgcccgctgggcgcaaacggcaaccctccagggggggctcaaaggtgctcgggccaaacccccttggtttaggggggggagagaatcccgngtcttcacttcggccgcgagaggagtaaaaacgcccctcaggcgggatccctcacccccaaagagacgcggggcacattgtgggggagagcatcccctcatggagcgcgag

SEQ ID NO: 83395 - protein, 258 aa, Zea mays
  misc_feature: Ceres CLONE 1569288
MPRRAGAAWPCFLLLHIIAHLHLAVNAADADALLTFKSSLDRSDRLPWRPDTAPAFCASWPGVRQCAPAGRVTKLVLEGLNLTGSLTAALLAPLAELRVLSLKSNALTGPIPEALPRALPNLKLLYLADNRLQGRVPGHPRHASTGPPSSSPPGQRTPGARCRPSPRRPGHGLEPRGLLEPETGAPRGPGPARWAQTATLQGGLKGARAKPPWFRGGRESRVFTSAARGVKTPLRRDPSPPKRRGAHCGGEHPLMERE

SEQ ID NO: 83396 - DNA, 835 bp, Zea mays
  misc_feature: Ceres CLONE 1569290
  misc_feature: Encodes the peptide sequence at SEQ ID NO. 83397
  misc_feature (589)..(589): n is a, c, t, g, unknown, or other
  misc_feature (646)..(646): n is a, c, t, g, unknown, or other
ccccgcggtggcggccgctctagaactagtggatcccccgggctgcaggaattcgtctcacccctagaaaaaagaaaaactcccacccccaccgacgctgccgccgctggcacgcattcctgcttcctctcctcctcttcttcatcggcgcggcgcggcgcagcgctgggggagaatcactcggatggaaatctgctgctagagtgagaggagctaccggacagtatcctgcgcgccttcgtcggcggcggaggggggaaggaagcgatggaggcgagcgccgggctggtggccggctcccacaaccgcaacgagctcgtcgtcatacgtcgcgacggcgatcccgggccgaagccgccgccgcgggagcagaacgggcaggtgtgccagatttgcggcgacgacgtcggccttgcccccggcggggagcccttcgtggcgtgcaacgagtgcgccttccccgtctgccgggactgctacgagtacgagcgccgggagggcacgcagaactgcccccagtgcaggacccggtacaagcgcctcaagggctgccagcgtgtgaccggtgatgaggaggaggacggcgtcnatgacctggacaacgagttcaactggaacggccatgactcgcggtctgtggccgacntcatgctctacggccgtggaggtgacccctatggcgcgccacaactttttcagctcacccccaaatgttcactcctcaccaacgggcagatggtcgatgacatcccaccggagcagcacgcgctggtgcctttcttcatgggcggtgggggaaaagagatccatcccctcccttatgcggatcctagct

SEQ ID NO: 83397 - protein, 189 aa, Zea mays
  misc_feature: Ceres CLONE 1569290
  misc_feature: SWISSPROT Homolog: EC 2.4.1.12 Cellulose synthase (UDP-forming)
  misc_feature (108)..(108): Xaa is any aa, unknown, or other
  misc_feature (127)..(127): Xaa is any aa, unknown, or other
MEASAGLVAGSHNRNELVVIRRDGDPGPKPPPREQNGQVCQICGDDVGLAPGGEPFVACNECAFPVCRDCYEYERREGTQNCPQCRTRYKRLKGCQRVTGDEEEDGVXDLDNEFNWNGHDSRSVADXMLYGRGGDPYGAPQLFQLTPKCSLLTNGQMVDDIPPEQHALVPFFMGGGGKEIHPLPYADPS

SEQ ID NO: 83398 - DNA, 869 bp, Zea mays
  misc_feature: Ceres CLONE 1569292
  misc_feature: Encodes the peptide sequence at SEQ ID NO. 83399
  misc_feature (397)..(397): n is a, c, t, g, unknown, or other
ctccccgcggtggcggccgctctagaactagtggatcccccgggctgcaggaattcgtctcacccctagaaaaactagttgctttcggctacctttcgcgcccaattggaggcaccccgaaccacaaaaaaaaaaggatgagaatttgatgccacaaacaagctcaaatgcttggtccttttgaaggttcgagaccagccatgtccttggcgccctgctggcctcctcgccgctgctggcgtccgcctgggaccgctgtacgaccgccacagccgcggcgcccgggttcgtgcacggagaggacggcggcaaggtgtacgtggggttctccggggtgcaggccgcgctgtctgcggcaggcgcggcggtggccggtggtggcgccgacgtcttcccnccggtggggctcggcggggacgcggcggggcggatgttcgcgccgctgctcgcggccgagcccgactcgtccgctgctggggagccggttgccgtgcaggcgctggcgctgcagtgcttcttgaaactctgcggtaaccctgattttcagatgcttctgaatgagatcaggggtaaggcagtcatgttcacgggccactccctcggtggcgccattgccaccctcgcggcgctacactacctctgcatctcatcttcaagctcaccatggtcacctgctgctcctgtcctgtgcgtcacctttggaagcccgctacatagcaatgaggcactgtccagggcatcctgcgtgagcgctgggggtggtacttctgccacgtgtctcacagcacgacgtcgtccaaggctcctcttctgcccccgggacgcggtcctggcattattatgtcggaatgaactggatcaatggccgg

SEQ ID NO: 83399 - protein, 146 aa, Zea mays
  misc_feature: Ceres CLONE 1569292
MFAPLLAAEPDSSAAGEPVAVQALALQCFLKLCGNPDFQMLLNEIRGKAVMFTGHSLGGAIATLAALHYLCISSSSSPWSPAAPVLCVTFGSPLHSNEALSRASCVSAGGGTSATCLTARRRPRLLFCPRDAVLALLCRNELDQWP

SEQ ID NO: 83400 - DNA, 840 bp, Zea mays
  misc_feature: Ceres CLONE 1569295
  misc_feature: Encodes the peptide sequence at SEQ ID NO. 83401
  misc_feature (833)..(833): n is a, c, t, g, unknown, or other
acccgcggtggcggccgctctagaactagtggatcccccgggctgcaggaattcgtctcacccctagaaaaattgtttcctctgtcagtacgtagtagcagtgctacaaaagcaattctaccttttcttcctctggcgtggtagccagcagccagcgacgagtcgccgctcgctgctttgctcaaatccatacctcaacatcgatgccggaaccatgtctccgctcgagcatggcgaagtgtttgttttggacgacggcggtgaggtggacttggaccttggaaactacgaacgatttctggacatcaagctgactcgtgacaacaacataaccacggggaagatctaccagtctgttattgacaaggaacgtagaggggattacctaggaaaaactgttcaggttgtgccgcacatcacagatgaaatacaagagtggattgaacgtgtggcaatgaatccagttgatggcacagaagagccagctgatgtttgtgtcatagaacttggtggcactataggggacattgaatcaatgcctttcattgaagcattaggtcaattttcataccgtgtagggcctggaaacttctgcttggtgcatgtcagtcttgtaccagttttaaatgtggttggtgagcagaaaacaagcctacccaacatagtgttcgcggacttagaggacttggactcatgccctgatatttggcatgccgtagtacacagccacttgaagaacatgtgaaagtgaagctcgcacaattttgtcatggtccgatatcaaatatcattaaatctccgtgatgtaacgaacattttgcacatccctttgntgctcaa

SEQ ID NO: 83401 - protein, 176 aa, Zea mays
  misc_feature: Ceres CLONE 1569295
  misc_feature (1)..(177): Pfam Name: CTP_synth_N Pfam Description: CTP synthase N-terminus
  misc_feature: SWISSPROT Homolog: EC 6.3.4.2 CTP synthase
MSPLEHGEVFVLDDGGEVDLDLGNYERFLDIKLTRDNNITTGKIYQSVIDKERRGDYLGKTVQVVPHITDEIQEWIERVAMNPVDGTEEPADVCVIELGGTIGDIESMPFIEALGQFSYRVGPGNFCLVHVSLVPVLNVVGEQKTSLPNIVFADLEDLDSCPDIWHAVVHSHLKNM

SEQ ID NO: 83402 - DNA, 738 bp, Zea mays
  misc_feature: Ceres CLONE 1569296
  misc_feature: Encodes the peptide sequence at SEQ ID NO. 83403
ctccccgcggtggcggccgctctagaactagtggatcccccgggctgcaggaattcgtctcacccctagaaaaagagcgctccgacttgtgtgctctcatgccgtgctgctacagagctgcctcataaaagctccctgagcctgctcctgtttgcagcttgcaaggcgccaaggacggacggaggcgacgactcgcaaggtagctctgctcgggcgaggcagcagcagcacgcagcagtactccgttcagaatcaggagagaagacgttgttctccgggcactcgagtcgaagtcctgacgagatggacggcaatgcgaggtcggcggcaacgaatcagaagaagccgtcgtcgcggacgacgacttcgtggagctgctgtggcacaacgggagcgtcgtcgcgcagccccaggcgcaccagaaggcggcgcccacctacgaacccgaaccgcccgggcacccagcggcctcacccggcaaaaaaacgccgcctggtttcccggaaaccctccacgaacaccctggaaaaggacctgtaaaccccagttttggtaaaggaaccattgcccgaaaccccccccctgaaacaccaagggaaaaccttcccgggggccctaaccctggagaaccttttggcttttttccccccccccctttgggaaaaccaaccgcggccttcaaaaaaacaaaaaatttgggggctttggaaaaaaaattatttgggttttaaacacttt

SEQ ID NO: 83403 - protein, 78 aa, Zea mays
  misc_feature: Ceres CLONE 1569296
MDGNARSAATNQKKPSSRTTTSWSCCGTTGASSRSPRRTRRRRPPTNPNRPGTQRPHPAKKRRLVSRKPSTNTLEKDL

SEQ ID NO: 83404 - DNA, 864 bp, Zea mays
  misc_feature: Ceres CLONE 1569297
  misc_feature: Encodes the peptide sequence at SEQ ID NO. 83405
  misc_feature (717)..(717): n is a, c, t, g, unknown, or other
  misc_feature (718)..(718): n is a, c, t, g, unknown, or other
ggagctccccgcggtggcggccgctctagaactagtggatcccccgggctgcaggaattcgtctcacccctagaaaaaacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacagacacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggggtctgtctataatctagcctccatggatgctccaccttcgccatgtaacaataatcaaggctactcttcattacataattttgatgctatataaatataccccatcccctccctnngggaaagaaacagggggaaagaacccgtatttcgagcgggaattgacgaacaataccggggggcaccaagggcaatcggtttaccggggggattgggaacaccttagtggaggatcctaggcttcgccatgaaaaaacacgccccc

SEQ ID NO: 83405 - protein, 128 aa, Zea mays
  misc_feature: Ceres CLONE 1569297
  misc_feature (32)..(128): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGVYQFVDKYGANVDRHSPIYNEDDWSPTGDVYVGGTTGLLIWAVTLAGILGGGALLVYNTSALSG

SEQ ID NO: 83406 - DNA, 897 bp, Zea mays
  misc_feature: Ceres CLONE 1569298
  misc_feature: Encodes the peptide sequence at SEQ ID NO. 83407
tccccgcggtggcggccgctctagaactagtggatcccccgggctgcaggaattcgtctcacccctagaaaaacccttttagcttttagctcgccccttgcgttcgcggaaaaagctcatcttttcaggtggaaggagcgattcgtctgtgcctgcgcctgcgcctgcgcctcgccgggctcgtgccgctgtaccctccttctccaggagacctgtacggtgaaggggcgctcccgcgccaaacgggaagcaaagctcgctcgcgcccttttttcggatcatataacgccggcgcctagctcaaacaccacagctcgctgcctagatctacgcggcagcggcgtcggcagaggagagggacccggagctgcgccatggggcctaccgccggctccccctaggacaaggctatgttagagctccggaaaaaacatcgtgtggacctggagagactaacaattacatcacgaccgttcaagacattgtcattctttgtgttagccatcgctcagaatttggaaagaacatgttcatctgttctgaaaaaaggttaccagttaaaaaacgcaatgcttttggttgttgctacttgggttctgctcatgttcactgatggcctgaatggaaagcatctgcaggaactactttggtatgtcaggtttgggatggggggggaatatacaagggggcccttcctccattggaataagttctgggtttgcaccctttcctaaaggaatttggctccccctgttgccctggttccctattcaaagcggttcaaggttggaagggtttgatttgaaaagggcctcctataggaaactttttctcctttaaaaggaaaaccttcccttggttagaaaaaaaactgtcttccaatttgggaccccccat

SEQ ID NO: 83407 - protein, 107 aa, Zea mays
  misc_feature: Ceres CLONE 1569298
MLELRKKHRVDLERLTITSRPFKTLSFFVLAIAQNLERTCSSVLKKGYQLKNAMLLVVATWVLLMFTDGLNGKHLQELLWYVRFGMGGEYTRGPFLHWNKFWVCTLS

SEQ ID NO: 83408 - DNA, 897 bp, Zea mays
  misc_feature: Ceres CLONE 1569299
  misc_feature (485)..(485): n is a, c, t, g, unknown, or other
ctccccgcggtggcggccgctctagaactagtggatcccccgggctgcaggaattcgtctcacccctagaaaaaattccagagatgccttcccttcgtttccctcattttcttccctcccctaaccttacctcctttcccacacgaaccctcgcccgcctcctcttcatcctcaaatcccagctcctggaccatgcctcccgcccaccctcgtgctctttccctctgatccatgttgtcctccgtgatgggggttgtggccgatagtgccattcgcatgtaggccctcacgctgacgaacgctgcggcgttcaggatccagcagcttctcaacctcatgtagctgttttgtgcgggctccagaaggatttgtgatgccctttgtgacgattcggcgtggccgcctgctcccccatcccctcctccgtggacaccgccgaggcgcctacgagccgactgcacgctggaacccgcgaggagccggcngtcgaggaaactgtgtcggtgatgcgcaagcagctggggcgcagcaagcttgcttgcggagctgcgcatggggtttcgggcagtgggcagacccggtgtggggacaccattaagttcgaaaccctggaacccttgaaagggccaaaaatggccctcccccaaggggcctccctaaatttaggagggccccaaaaaaaaacgggaacccctccggggggcccaattttttgcaaccctcgggaaagcccccttttttttttcccacggggaccttatagtttttccttgggggtgggggggggcccttataaaggcggggggggggggttccagccccccaaaaaggtgtgcgctgtggaacactttaaaaaaggggggcacactttattaacggggggggggggcacaaccc

SEQ ID NO: 83409 - DNA, 862 bp, Zea mays
  misc_feature: Ceres CLONE 1569300
  misc_feature: Encodes the peptide sequence at SEQ ID NO. 83410
tccccgcggtggcggccgctctagaactagtggatcccccgggctgcaggaattcgtctcacccctagaaaaaaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttcccccgacgtgatccacgcgttcaagcccaacccgcggtcgcacgtgcaggagtactggcgggtgttcgacttcctgtcgcaccttcccgagagcctgcacaccttcttcttcctcttcgacgacgtgggcgtgccgtccgactaccgccacatggaaagggttcggggtgaaccccgtccactttccttgagccccggcggggaaaggccccaatacgttcaagttcccctgggaacccgacgtggcggggtggggggggcatccggac

SEQ ID NO: 83410 - protein, 207 aa, Zea mays
  misc_feature: Ceres CLONE 1569300
  misc_feature (18)..(207): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPRRDPRVQAQPAVARAGVLAGVRLPVAPSREPAHLLLPLRRRGRAVRLPPHGKGSG

SEQ ID NO: 83411 - DNA, 831 bp, Zea mays
  misc_feature: Ceres CLONE 1569302
  misc_feature: Encodes the peptide sequence at SEQ ID NO. 83412
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (765)..(765): n is a, c, t, g, unknown, or other
ctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacagagcggcggcggtggcggccagcgactccgacaagctcttgagcctgctgccgtcgccgcccatgaagctccccatcatcgggcacctgcacctgatgggggacaatccctacgggtccttccgcgccgctccccaccagaacgggccgggacctgatgctgctccgccttggggccgtggcaacccggggggggttctttccccccccgtcccccaaagcccggggtcccgcccctaaaaaacaaattttttttcctcccccccccgccccccccgggggggccgaaaaataatatattaaggggcgccccccaaaatttgggttttcccnnnccctaaagggcagagagtntttcccaaaaagggggggaaaaaatgggttccccctgggaacctctgtttaaaaagccccgagagg

SEQ ID NO: 83412 - protein, 134 aa, Zea mays
  misc_feature: Ceres CLONE 1569302
MAAQLHHALYELLHEAAAAQRALLLAIPFSLLLLPLLLRYLAASASASASATKNDRAAAVAASDSDKLLSLLPSPPMKLPIIGHLHLMGDNPYGSFRAAPHQNGPGPDAAPPWGRGNPGGVLSPPVPQSPGSRP

SEQ ID NO: 83413 - DNA, 858 bp, Zea mays
  misc_feature: Ceres CLONE 1569303
  misc_feature: Encodes the peptide sequence at SEQ ID NO. 83414
  misc_feature (667)..(667): n is a, c, t, g, unknown, or other
  misc_feature (668)..(668): n is a, c, t, g, unknown, or other
  misc_feature (676)..(676): n is a, c, t, g, unknown, or other
  misc_feature (698)..(698): n is a, c, t, g, unknown, or other
ggagctccccgcggtggcggccgctctagaactagtggatcccccgggctgcaggaattcgtctcacccctagaaaaatagtgcgcgcctcgtgctcgtgctcccccgagcagactagaccagcgcgctagcgccagcaaggccaaggcgagggaggggcgatgctcgcccgatctgctacagccgccgccgccgccgggatctgactgtgattaaggatgtcggcgtcgcggagcgggaggatcaggcgggccgggagcgtggcgctcggggactttctgcggcgggaggcgtcggcggagcgggccgcgttgggaggcggcgagcggccctcggtcgcggcggggcaggcctgccgggcgaagaagggcgaggacttcgcgctgctcaagcccgcctgcgagcgacgccccggcgcgccgtccacctccttctccgccttcgccctgttcgatgggcataacgggagcgccgcagcggtgtacgccgaggagcacctcctcggcaacgtgctcggctgcgtcccggccgatctgagcagggacgactggctcgccgcgctcccaagggcgctcgtcgcggggtttcgtcagacccgacaggattttcaaactaaagctcattcctcggggaacaccgtgacacttgccataattgatggctccgnntgtactgntgcgtccgtgggtgattcacgntgtgtccttgatgctgcgggatccatctactatttgtcggctggacaccgctttgacgctaattgaagaggaggttggccttgtaaccgaatggcggaagtggaagtgggaaacctaaatgttgtcggtgggtgctaaaatgggcccccttagatgttgg

SEQ ID NO: 83414 - protein, 181 aa, Zea mays
  misc_feature: Ceres CLONE 1569303
  misc_feature: SWISSPROT Homolog: EC 3.1.3.16 Phosphoprotein phosphatase
  misc_feature (150)..(150): Xaa is any aa, unknown, or other
  misc_feature (153)..(153): Xaa is any aa, unknown, or other
MSASRSGRIRRAGSVALGDFLRREASAERAALGGGERPSVAAGQACRAKKGEDFALLKPACERRPGAPSTSFSAFALFDGHNGSAAAVYAEEHLLGNVLGCVPADLSRDDWLAALPRALVAGFRQTRQDFQTKAHSSGNTVTLAIIDGSXCTXASVGDSRCVLDAAGSIYYLSAGHRFDAN

SEQ ID NO: 83415 - DNA, 876 bp, Zea mays
  misc_feature: Ceres CLONE 1569304
  misc_feature: Encodes the peptide sequence at SEQ ID NO. 83416
  misc_feature (400)..(400): n is a, c, t, g, unknown, or other
  misc_feature (403)..(403): n is a, c, t, g, unknown, or other
  misc_feature (661)..(661): n is a, c, t, g, unknown, or other
  misc_feature (662)..(662): n is a, c, t, g, unknown, or other
  misc_feature (670)..(670): n is a, c, t, g, unknown, or other
  misc_feature (678)..(678): n is a, c, t, g, unknown, or other
  misc_feature (684)..(684): n is a, c, t, g, unknown, or other
  misc_feature (687)..(687): n is a, c, t, g, unknown, or other
  misc_feature (759)..(759): n is a, c, t, g, unknown, or other
  misc_feature (762)..(762): n is a, c, t, g, unknown, or other
  misc_feature (843)..(843): n is a, c, t, g, unknown, or other
tggagctccccgcggtggcggccgctctagaactagtggatcccccgggctgcaggaattcgtctcacccctagaaaaaccccgaggccgcccgcgtcccgaggagtggaggaggtcaccccgagacagtcgcttcaccgccggtctctcctccccacctccacgcggctcgcggccggccatacaccgcagcactaccttggtgggggcttgcgccagagctcgcgaccactgcccgtgacgcctgtctttgactcgttgaccgcggagtgagcgcgcgcgccggagccggccagccatggaagtgcgcggcggagtggggcagggttcggcggcccggcacccgcccgcgccggagccgtcccgggcggcggcgcgggttcaggcgggggacgcgctnccnctgccgatacggcacacgaacctcatcttctcggccctgttcgcggcgtcgctggcgtacctcatgcggcggtggcgcgagaagatccgctcgtccacgccgctccacgccgttgggctcgccgagatgctcgccatattcggcctcgtcgcctcgctcatctacctgctcagcttcttcggcatcgccttcgtccagtccatcgtctcgtccggcgacgacgacgaggaacttcttggtcgggtcggggagctcggnnctcgccgncgcgcccntccggnagnatgcgcaggcgccggccccgtgcgagctgctcggggagcccggcgcggcgcccgagaaaatgccggaagacnacnaggagatcgtcgcctcggtcgttcgcggggaggtttcgttctacgcgctccaggcaggctcggcaacttgccccgccccgncgggatcgggggcgagcccttggggggaataag

SEQ ID NO: 83416 - protein, 192 aa, Zea mays
  misc_feature: Ceres CLONE 1569304
  misc_feature: SWISSPROT Homolog: EC 1.1.1.34 Hydroxymethylglutaryl-CoA reductase (NADPH)
  misc_feature (122)..(122): Xaa is any aa, unknown, or other
  misc_feature (127)..(127): Xaa is any aa, unknown, or other
  misc_feature (129)..(129): Xaa is any aa, unknown, or other
  misc_feature (130)..(130): Xaa is any aa, unknown, or other
  misc_feature (154)..(154): Xaa is any aa, unknown, or other
  misc_feature (155)..(155): Xaa is any aa, unknown, or other
  misc_feature (182)..(182): Xaa is any aa, unknown, or other
MEVRGGVGQGSAARHPPAPEPSRAAARVQAGDALPLPIRHTNLIFSALFAASLAYLMRRWREKIRSSTPLHAVGLAEMLAIFGLVASLIYLLSFFGIAFVQSIVSSGDDDEELLGRVGELGXRRRAXPXXCAGAGPVRAARGARRGARENAGRXXGDRRLGRSRGGFVLRAPGRLGNLPRPXGIGGEPLGGI

SEQ ID NO: 83417 - DNA, 853 bp, Zea mays
  misc_feature: Ceres CLONE 1569306
  misc_feature (689)..(689): n is a, c, t, g, unknown, or other
  misc_feature (748)..(748): n is a, c, t, g, unknown, or other
ctccccgcggtggcggccgctctagaactagtggatcccccgggctgcaggaattcgtctcacccctagaaaaaaaaaaaaagtggcgcccggagaaccgagaggccggagaaagaaaggcggaaagagggagcaaaatctcactttgctgggagttctttcctctgtttccgactcctttgttctcttagtgttcttggttggtggaatggaagctcagcagctccatttgtgttccagagatcttcgtcgttctcgttcccctcgtgtgtagcctttggaggaattcccgttcacatgatccgtgcctggacgtgacggttttgccacgctctgctgcttccctttcggggagaagaggactcgactcaaatcatttggtatcgcagacgtcgcccttcccagttcagttgagagagatttctggcatgtccggcgcaagtaactatggatccctcatcgatgaatggttgccgccccctacacctagcccaagaactctcatgtctagctttctgaatgaagaattcagctctgcgccattctctggtccccatgatcaatctgaaaagagcagagaagttttgaattcgagcgatgaggttccttcacatgctgtcaaaggcctatttcaaaatggtttctcaaatttgttcagtgctaaaatcaaactccatggtggtttggcngagcgcagggctgcaagagcaggtttcagtgtcccgaaaattgatacttctcgagtttnttcatccacaggttattcgatctcctgtgtcaattccacctggtctaagtcaactacacttcttgagtctcctggttttcctttaccataaaatggcacacccgt

SEQ ID NO: 83418 - DNA, 835 bp, Zea mays
  misc_feature: Ceres CLONE 1569307
  misc_feature: Encodes the peptide sequence at SEQ ID NO. 83419
  misc_feature (503)..(503): n is a, c, t, g, unknown, or other
  misc_feature (585)..(585): n is a, c, t, g, unknown, or other
  misc_feature (586)..(586): n is a, c, t, g, unknown, or other
  misc_feature (691)..(691): n is a, c, t, g, unknown, or other
  misc_feature (692)..(692): n is a, c, t, g, unknown, or other
ggagctccccgcggtggcggccgctctagaactagtggatcccccgggctgcaggaattcgtctcacccctagaaaaaacattccagttccactccgcctccgctgccggtcgccgtctccgagactccgacagtccgaccgcaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcangagcctgttgttcctggttcgttcctgcgagcaagagcaatcggccttatgcccatgattgacccaggtgaaaaggatgacnnagatatagcagtctgtgctgatgatcctgaatatcgtcactacaacgacatcagtgagctgtctcctcatcgcctgcaagagatcaagcggtttctttgagattnntagaagatgaggataaggaggttgctgtcgatgcattcttgcctgcgacacagctcgagaggcattcagtactccatggatctgtatgcgcagtatattttgcaaagcttggagcagtagattgggagcaactatttatctgg

SEQ ID NO: 83419 - protein, 171 aa, Zea mays
  misc_feature: Ceres CLONE 1569307
  misc_feature (52)..(172): Pfam Name: Pyrophosphatase Pfam Description: Inorganic pyrophosphatase
  misc_feature: SWISSPROT Homolog: EC 3.6.1.1 Inorganic diphosphatase
  misc_feature (111)..(111): Xaa is any aa, unknown, or other
  misc_feature (139)..(139): Xaa is any aa, unknown, or other
MSEEDKTAASAEQPKRAPKLNERILSSLSRRSVAAHPWHDLEIGPDAPAVFNVVVEITKGSKVKYELDKKTGLIKVDRVLYSSVVYPHNYGFVPRTLCEDNDPMDVLVLMXEPVVPGSFLRARAIGLMPMIDPGEKDDXDIAVCADDPEYRHYNDISELSPHRLQEIKRFL

SEQ ID NO: 83420 - DNA, 851 bp, Zea mays
  misc_feature: Ceres CLONE 1569308
  misc_feature: Encodes the peptide sequence at SEQ ID NO. 83421
ctccccgcggtggcggccgctctagaactagtggatcccccgggctgcaggaattcgtctcacccctagaaaaaacccagagccagaagcgcgtcgccagccaactatcgccgctgataaccaacccaatccaacctaacccaaccctgctctctgccgacgcggattcgaatccgaggacgatcgatgacggtgggcgccggcatcgccgtccaggacggcagcctcctggcgctgggcgccaaggtcctgcgggaggtgcgcggcaacgtgctcgtgacgccggccgccggcgggggcctaaccaacggcgcgttcctcggcgtccggtccgcgcccgccgccagccgcagcatcttccccgtcgggaagctccgggaccagcggttcgtgtgcacgttccggttcaagatgtggtggatgacgcagaggatgggctccgcaggccgcgacatcccctccgagacgcagttcctgctggtggaagggtctggcggcggcaagcagcccgtcgtgtacaccgtcttccctcccgtggctggagggctcgttccgtgccgttcttcaggggaacgctgccgacgagctggagatctggcctggagagcggcgacccgaacgtgggattctttccagggtcccatctgggtcttcgttgggcgcgggatcggaccccgttcgagggtcattcacaggtttcagtcaaagggttgtcaaaagggacttttccaaactttccctccccaggggaaaaaaaaaaaaaaatcccaaaaatttcttaaaatgggttttgggttgggggcccccgtggggaaccccttttttaaaaccaaagggcccccccccccagg

SEQ ID NO: 83421 - protein, 221 aa, Zea mays
  misc_feature: Ceres CLONE 1569308
  misc_feature: SWISSPROT Homolog: EC 2.4.1.67 Galactinol--raffinose galactosyltransferase
MTVGAGIAVQDGSLLALGAKVLREVRGNVLVTPAAGGGLTNGAFLGVRSAPAASRSIFPVGKLRDQRFVCTFRFKMWWMTQRMGSAGRDIPSETQFLLVEGSGGGKQPVVYTVFPPVAGGLVPCRSSGERCRRAGDLAWRAATRTWDSFQGPIWVFVGRGIGPRSRVIHRFQSKGCQKGLFQTFPPQGKKKKKSQKFLKMGFGLGAPVGNPFFKTKGPPPP

SEQ ID NO: 83422 - DNA, 903 bp, Zea mays
  misc_feature: Ceres CLONE 1569311
  misc_feature: Translation starting site: 221
  misc_feature: Pfam Name: GNT-I Pfam Description: GNT-I family
  misc_feature (903)..(903): n is a, c, t, g, unknown, or other
caagctggagctccccgcggtggcggccgctctagaactagtggatcccccgggctgcaggaattcgtctcacccctagaaaaaagtcccagctgccaaggtcttcgtcgcctcgtcgggctcgggtcctttgccggcgacgagcgcgtgcacaccagaagaatacagtggaagtggtatgcggttgtaaaacgatttcgattattccaagcggccggcgatggctcggagcccctgcgacctccgcctcctcctcctcgctgcagctgcagctttcatctacatccaagtgcgcctctttgctactcagtcccattatgcggaccgtcttgcggaagcagaaagatctgaaaatcaatgcaccagtcaattaaagtccttgatcgatcaagtcagcatgcagcaggaccacattgtagcattggaagagataaaggtacggcaagatgaagaacgtgcacatctgaggattttgataaaggatctggaaaaaggagtgtgcagaagctactagacaagaatgtggttcccgttgctgctgttgtcataatgggctgccatcgaccagactatttagagagaacagttgaatctttcctggagtatcagacatcagttggttccgagtttccgcttttttaatctccgggagggaccaattggagcttttgaaaaataaagcttttggaaataaaaacaaataacctacttgccgcccttggggatttttgaacccgggggcaaatggaagggccggggaaatttgccccctttttttccaaattgccttaaactttttaaagggggggccttgggaacaccttttttctttataacataaattttgggccgggataaattttttctaaaaaaatgtacaatgggaaaattgccccccgaatn

SEQ ID NO: 83423 - DNA, 839 bp, Zea mays
  misc_feature: Ceres CLONE 1569319
  misc_feature: Encodes the peptide sequence at SEQ ID NO. 83424
  misc_feature (518)..(518): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (584)..(584): n is a, c, t, g, unknown, or other
  misc_feature (585)..(585): n is a, c, t, g, unknown, or other
  misc_feature (590)..(590): n is a, c, t, g, unknown, or other
  misc_feature (628)..(628): n is a, c, t, g, unknown, or other
  misc_feature (629)..(629): n is a, c, t, g, unknown, or other
  misc_feature (644)..(644): n is a, c, t, g, unknown, or other
  misc_feature (706)..(706): n is a, c, t, g, unknown, or other
  misc_feature (756)..(756): n is a, c, t, g, unknown, or other
  misc_feature (757)..(757): n is a, c, t, g, unknown, or other
  misc_feature (782)..(782): n is a, c, t, g, unknown, or other
  misc_feature (783)..(783): n is a, c, t, g, unknown, or other
  misc_feature (820)..(820): n is a, c, t, g, unknown, or other
ctccccgcggtggcggccgctctagaactagtggatcccccgggctgcaggaattcgtctcacccctagaaaaagactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagaccctgatcaggaagctcaccaggggcggcaagcacgcggagctgtggtcgcagcccaagggcggcggcaaccagggccacaagggcaataatggccagcagcagaaacagcagcagccgcagaaccagaaccagaaccaccagcagaagcagaagcaaggtgccaatctncagcaaggatgggcacaacaagaacagcaacggcggccagaaggacaggggaannnctaggagganngaganggggctggggggcctcatgcaggccccctcaggcgttnncagaaccagcacggncaacagcaccagctccctgagctcagctcggacgacgatgacctgtatgacgacgacgaacnaggaggagtttgacgacgacttaccaggaggagctccgctttctccgggnnacagatgagcccagcttcggttccnncgggcacacccgaacaagaacgggaaacacgctgctngtcacagtaaccacggcac

SEQ ID NO: 83424 - protein, 135 aa, Zea mays
  misc_feature: Ceres CLONE 1569319
  misc_feature (16)..(76): Pfam Name: HMA Pfam Description: Heavy-metal-associated domain
MTKDEEFKLVKIQNHALKVNIHCDGCKHKVKKLLQKIEGVYSVAIDVDNHKVSVTGDVDSETLIRKLTRGGKHAELWSQPKGGGNQGHKGNNGQQQKQQQPQNQNQNHQQKQKQGANLQQGWAQQEQQRRPEGQG

SEQ ID NO: 83425 - DNA, 846 bp, Zea mays
  misc_feature: Ceres CLONE 1569323
  misc_feature: Encodes the peptide sequence at SEQ ID NO. 83426
agctccccgcggtggcggccgctctagaactagtggatcccccgggctgcaggaattcgtctcacccctagaaaaaatcggtgtatcttcgcccccggcgaaggcgctatcctcccgaccacccggcggtgccggtacgccggtaaggcaggttgccagaccccgcgaccccgatcccgatcggtcgctggcgaggcggcgtgacctaccccggctcatcctctcaagccagacggtctggctgctgtgcatccccgttttggcggctaccttacctctggcaaggcaatcccccctcacccctggcaagcacgggagaacatggagagtgcttcagatgtacaaatgcaacatcgtgctgaagattccgagactacaattgagatcaaaatcaagacattggattcccagacatacaatttgcgtgtgaataaatgtgtgccagttcctctgttgaaagagaaaattgctactgtaactggaatattgtctgaacagcaacgcttgatttgtcgtgggagagtcttgaaggatgatgaactcttgtctgcttatcatgtcgaagatgggcatacattacatcttttgtgtagacatccaggccagtcagctacattttgaaatgcagcaaccgaagctaacccatcaaattctggccgtcttcatgggcccccagtggcaagaattgtatacctgaggctgttaatggggattctgggaacagggaactcccgcttttgttgcccgaattccccaaggggcttgggaaaattagggccaattttagggggaccccaacttttttgaacccggaatttttgaatctttcaaaatttccctcccaaa

SEQ ID NO: 83426 - protein, 99 aa, Zea mays
  misc_feature: Ceres CLONE 1569323
  misc_feature (25)..(93): Pfam Name: ubiquitin Pfam Description: Ubiquitin family
MESASDVQMQHRAEDSETTIEIKIKTLDSQTYNLRVNKCVPVPLLKEKIATVTGILSEQQRLICRGRVLKDDELLSAYHVEDGHTLHLLCRHPGQSATF

SEQ ID NO: 83427 - DNA, 839 bp, Zea mays
  misc_feature: Ceres CLONE 1569324
  misc_feature: Encodes the peptide sequence at SEQ ID NO. 83428
ggagctccccgcggtggcggccgctctagaactagtggatcccccgggctgcaggaattcgtctcacccctagaaaagagctctttcttgattctatgggtggtggtgcatggccgttcttagttggtggagcgatttgtctggttaattccgttaacgaacgagacctcagcctgctaactagctatgcggagccatccctcccgtagttagcttcttagagggactatggcccgttaggcccacggagtttgaggcaataacaggtctgtgatgcccttagatgttctgggccgcacgcgcgctacactgatgtatccaacgagtatatagccttggccgacaggcccgggcaatcttgggaaatttcatcgtgatggggatagatcattgcaattgttggtcttccacaagaatgcctagtaagcgcgagtcatccactcgcgttgactacgtccctgccctttgtacacaccggccgtcgctcctaacgattgatggtccggtgaagtgttcgatcccgcaaaaaaggggggggggggggggggtcccccccccccccccccccccaaagcccctttgaccctttttttttgaggggaaggggaaaatctccacacggtttttccccggggaaaaccccgcgaaagagaaaaattggccccgaatttgttccacacaccccgggaattcttgggcccctttttcccccccccaaattttttttggcggcgccccccccctttttccccctcctttttttttctccgggtttgcccccccccccccccccccagaaaaaaatatctctttttgggtctttttttttcgcgggctca

SEQ ID NO: 83428 - protein, 37 aa, Zea mays
  misc_feature: Ceres CLONE 1569324
MGGGAWPFLVGGAICLVNSVNERDLSLLTSYAEPSLP

SEQ ID NO: 83429 - DNA, 837 bp, Zea mays
  misc_feature: Ceres CLONE 1569330
  misc_feature: Encodes the peptide sequence at SEQ ID NO. 83430
  misc_feature (446)..(446): n is a, c, t, g, unknown, or other
  misc_feature (494)..(494): n is a, c, t, g, unknown, or other
  misc_feature (523)..(523): n is a, c, t, g, unknown, or other
  misc_feature (597)..(597): n is a, c, t, g, unknown, or other
  misc_feature (647)..(647): n is a, c, t, g, unknown, or other
ctccccgcggtggcggccgctctagaactagtggatcccccgggctgcaggaattcgtctcacccctagaaaaaattgatgtcgtgacattttttttttttgcattgcacgcaggtccgctgtatcacaagggctggtaccacctcttctaccagtggaacccggactccgcggtatggggcaacatcacctggggccacgccgtctcgcgcgacctcctccactggctgcacctaccgctggccatggtgcccgatcacccgtacgacgccaacggcgtctggtccgggtcggcgacgcgcctgcccgacggccggatcgtcatgctctacacgggctccacggcggagtcgtcggcgcaggtgcagaacctcgcggagccggccgacgcgtccgacccgctgctgcgggagtgggtcaagtcggacgccaaacccggtgctggntgccgccgccgggcatcggggccgacggacttccgcgacccgacgacngcgtggcggacgcccggcacgacacgccngcgtggcggtcgccatcgggtccaggaccgggaccacgcggctttggcgctggtgtacgggacggaggacttcntgcggtacgaccgggcgcccggcgctgatgcacgccgtgccgggcacggncatgtgggagtgcgtggactttctacccggtggccccccggaatcaggcgcctccggcggaaagcggggacggggctggaaacttcccccgccccgggggcccgggggtaaaacacttgctaaagggccagcctgaaagacgaaaagcccgattttcttcggggattgggaacctaaaaacccggggaaa

SEQ ID NO: 83430 - protein, 251 aa, Zea mays
  misc_feature: Ceres CLONE 1569330
  misc_feature (38)..(245): Pfam Name: Glyco_hydro_32N Pfam Description: Glycosyl hydrolases family 32 N terminal
  misc_feature: SWISSPROT Homolog: EC 3.2.1.26 Beta-fructofuranosidase
  misc_feature (174)..(174): Xaa is any aa, unknown, or other
  misc_feature (199)..(199): Xaa is any aa, unknown, or other
PRGGGRSRTSGSPGLQEFVSPLEKIDVVTFFFFALHAGPLYHKGWYHLFYQWNPDSAVWGNITWGHAVSRDLLHWLHLPLAMVPDHPYDANGVWSGSATRLPDGRIVMLYTGSTAESSAQVQNLAEPADASDPLLREWVKSDAKPGAGCRRRASGPTDFRDPTTAWRTPGTTRXRGGRHRVQDRDHAALALVYGTEDFXRYDRAPGADARRAGHGHVGVRGLSTRWPPGIRRLRRKAGTGLETSPAPGARG

SEQ ID NO: 83431 - DNA, 924 bp, Zea mays
  misc_feature: Ceres CLONE 1569335
  misc_feature: Encodes the peptide sequence at SEQ ID NO. 83432
  misc_feature (1)..(1): n is a, c, t, g, unknown, or other
  misc_feature (484)..(484): n is a, c, t, g, unknown, or other
  misc_feature (489)..(489): n is a, c, t, g, unknown, or other
nagaagctggagctcccgtcggtggctgtcgctctagagctagtggatcccccgggctgcaggaattcgtctcacccctagaaaaaaacctccgccatcaccgacgctgactcccacaccggccgccgcgcgagccccggcaccatctccgcacgagcagaaatgggggatgcgtgtttctcaacacagctaattgatggagatggggtcttcaacgtctctggattggagaacttcatgaaggatgtcagattgggtgaatgcgggctctcctatgctgttgtatcaataatgggcccgcaaagtagtgggaaaagtacacttttgaatcatctttttggcaccaattttagggagatggacgccttcagaggaaggtcacagactaccaaaggtatatggttagcgaaggcccacaatattgaaccatgcacccttgtaatggatttggaaggaactgatggagggagagggggagaggatnacccnccattttgagagcaaaaggggatttgttggctttgggccggtttcaaacattggggtgaaataaaaaaggggggggccataacatttgggaaaagaaaaggcggcaaaaaaaaccttttttttaaaaacctgttttcccggggcaagaggaaggggtggttaaattccccctaaaacaaaactttgtgtgttttgttaatttggggcaaaaataaggggaaccccccgagaaaaattttgagaccattttttgggggggagactttccgaaaaatttggggagggtttttgtcaaaaacccccgtgcgccaaaaaaaaaacccccttgggggaaattttttgagttaacaattttggggcgcgtttcccttggttagtaaaagaagaaagaggtttctgacaacgacggtggtgttttttatataagaaaggtgt

SEQ ID NO: 83432 - protein, 111 aa, Zea mays
  misc_feature: Ceres CLONE 1569335
  misc_feature (108)..(108): Xaa is any aa, unknown, or other
MGDACFSTQLIDGDGVFNVSGLENFMKDVRLGECGLSYAVVSIMGPQSSGKSTLLNHLFGTNFREMDAFRGRSQTTKGIWLAKAHNIEPCTLVMDLEGTDGGRGGEDXPPF

SEQ ID NO: 83433 - DNA, 788 bp, Zea mays
  misc_feature: Ceres CLONE 1569340
  misc_feature: Encodes the peptide sequence at SEQ ID NO. 83434
ctccccgcggtggcggccgctctagaactagtggatcccccgggctgcaggaattcgtctcacccctagaaaaagaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaaagaagcgccagaagcagcacgacgagaacgtgcaggaaagtcgtgaagcgggctcaagcagagggaacccgaagaaggacgggtcttgttttgcacggccagggaagccccttggatcgcctgttgggcattgcgcaaactgggaacctccaaagcgtggccagggcattttcggaggcccaacctttttccttcctttccgggaccattcctttggaaattcccaaaaaaaaaggggatgggttgcccaagggtccaaaccccccttgtcaaaaaagggggttcaaaaatacaccggaaggctccccctgcccccaaaagaaaacctttgccccctttggggggggggcgtttcccccaaaaattttttaaaaaaaaacccccccagccgtgtggttgggggggg

SEQ ID NO: 83434 - protein, 71 aa, Zea mays
  misc_feature: Ceres CLONE 1569340
MADVHEPLVRRKRKKVLVDYLVKFRWILVIFVVLPISTLIYFNIFLGDMWSAMKSEKEAPEAARRERAGKS

SEQ ID NO: 83435 - DNA, 852 bp, Zea mays
  misc_feature: Ceres CLONE 1569342
  misc_feature: SWISSPROT Homolog: EC 3.1.1.3 Triacylglycerol lipase
  misc_feature (669)..(669): n is a, c, t, g, unknown, or other
  misc_feature (684)..(684): n is a, c, t, g, unknown, or other
ctccccgcggtggcggccgctctagaactagtggatcccccgggctgcaggaattcgtctcacccctagaaaaaatccaagataccgacgagcaggccagagcgaaggaatggactccatggccagcgacgacagcaaccaaggagcagcagccaagccgaagccgaagccaccaccgctaccgctgtccgtgcgcctccagctggccgggctgacagcggccatcgacgccgtggagcgccgcgacgggacggtgaaccgctgcctgtacggcgtgatcgaccggctcctgagcgcgcgcgccagcccgcgcccggacgcctccggggtgcgctcctacgacgtgaccatggacgcgtcccgcggcatctgggcgcgcgtcttcgcgccggccgcggcggaccgcccgctcccccgtggtggtgtacttccacggcggcggcttcgcgctcttctccccggccatcgggcccttcaacggcgtgtgccgccgcctctgcgccgcgctcggcgccgtcgtggtgtccgtcaactaccgcctggccccggagcaccgctggcccgccgcctacgacggcgtcgacgcgctgcgcttcctcgacgcccgcggcggcgtcccgggcctggacgacggcgtgcccgtcgacctcggcacctgcttcctggccngggagagcgcggccngaaactcgtgcaccacgtcgccaaccgctgggcggcggcgtggcagccgtccgcgcgggcccttcgcgtcgcgggcgtcttccccgtgcagccctacttcgggcgcgtgaagcgcacgccgtcggagctgaaactagagggcgtggcccccgtgtcaactcaaggctc

SEQ ID NO: 83436 - DNA, 899 bp, Zea mays
  misc_feature: Ceres CLONE 1569346
ctccccgcggtggcggccgctctagaactagtggatcccccgggctgcaggaattcgtctcacccccctagaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcagcgctggctgccatgtggtggcgtcggtgctccaagaccggcggtgtcgacggtctcacgccggggcctccgggttggacggtgggtgggaacctgtttcaggtgatcctgcagcgacggcccttcatgtacgtggtggcgcgacctcccgggagaagtacgggccccatcttccaccatggcggattggggaaaccccaaccctccatcggggggttacccctcgggggggaggtttttttcccccaaagggccctttggggaaaaacaaggggcccccccttgtgtttcccccaaaccccgggccccccagaggaaaaaagatcccccaacacccgggcttttttttttttttttaaaggtgttttggggaaaaaaatgtgcccccccccctttaaaaaaattttttttggggggggccccccccccttttggggggccccccccccctgtggggggggggtggggtttatatttgggggccccccaaaaaatttttttttttttctcccaaaaaaaaattattttgttttccccctccacccccccccgtttttaaagaggggggtttttttcctcccctggaaaacacccgggggggagagattctccccctggtggtgaaaaacaccccgcttttctttttggccgccccc

SEQ ID NO: 83437 - DNA, 846 bp, Zea mays
  misc_feature: Ceres CLONE 1569347
  misc_feature: Translation starting site: 183
  misc_feature: SWISSPROT Homolog: EC 4.3.1.5 Phenylalanine ammonia-lyase
  misc_feature (551)..(551): n is a, c, t, g, unknown, or other
  misc_feature (556)..(556): n is a, c, t, g, unknown, or other
ctccccgcggtggcggccgctctagaactagtggatcccccgggctgcaggaattcgtctcacccctagaaaaaagtactactcttgtgtagtagcttttaatttcccccagctagctagctagctagtttctacttccgtccgcgcgcgctcatctgcgcacgcacgtgtccccgtccgcaatggagtccgaggccggcctgcttgtccgctcctccctgaacggcgagggcctgtgcatgccggcgccgcgcgccgacccgctgaactggggcaaggccgcggagggcctgtccgggagccacctggacgaggtgaagcggatggtggcggagttccgcgagccgctggtgaagatccagggcgccagcctgagcgtcgcgcaggtggccgccgtggccgtgggcgccgggggcggcgaagcccgcgtggagctggacgagtccgctcgcgagcgcgtcaggccagcagcgactgggtcatgggcagcatgatgaacggcaccgacagctacggcgtcacccacgggcttcggggctaccttcccacgncgcancaaggaaagccggcgcgctccagagggagctcatcaaatccctcattggcggcgcgttcggcacttgccgccacggccactttgctgcggggggaggcacccgcgcggggaatgctgggggccttaaaaccctcctcaagggtaatccgggatcccgttttaagaacctgggggcatttccaagtttttaaaccccaaattacccccgggccttgccttccggggaacaatcccccggtggggggaaactccccccttcttcaaaatgcgggggtttaagaggggggcca

SEQ ID NO: 83438 - DNA, 843 bp, Zea mays
  misc_feature: Ceres CLONE 1569349
  misc_feature: Encodes the peptide sequence at SEQ ID NO. 83439
ctccccgcggtggcggccgctctagaactagtggatcccccgggctgcaggaattcgtctcacccctagaaaaattctcctccttgcgggcctcctcgcccagcggactcctactctgctgcgctccgctccgttccgttccgctcccctcctcgcggcagcaatcgaatgtctcccgacgtagacgccgccgtggcaaccgccgtcgctgccgggggaggctgcggcggtgacggagaggcgggcggtggcgcgtcgtcgtccccggcgtccgcggcggcggcgaacgggcgggcgttggtgcggtgggatcagatcctcccgcgccgctccctgcgggtcctcctcgtcgagcacgacgactccacgcgccaggtcgtcaccgcgctgctccgcaagtgcggctaccgcgtggccgcggtcgcggacaggatgaaggcgtggggggtcatgcgggagcgcgcctacgcgttcgaccttgtcctcaccgaggtcgccatgccctccctctccggcatccagctgctctccaggatcgtcgccgccgacgagtgcaagaacatccccgtcgtcatgatgtcatcccaagattctattggcacggtgctcaagtgtatgcagaagggtgcggtggacttccttgtgaaccagtgagaaagaatgaactgcgtaacttatgggcacatgtgtgggagcggcatgcaatgacttgccagacaaatggatcagaaaatcatgcagccagccatcatattagtgcccacgttgctaatgggtcaaagacaggagaaaactgctacgaggatgtgatgccccaagcttttgtagcatgagggatactga

SEQ ID NO: 83439 - protein, 161 aa, Zea mays
  misc_feature: Ceres CLONE 1569349
  misc_feature (56)..(161): Pfam Name: Response_reg Pfam Description: Response regulator receiver domain
  misc_feature: SWISSPROT Homolog: EC 3.1.4.17 3',5'-cyclic-nucleotide phosphodiesterase
MSPDVDAAVATAVAAGGGCGGDGEAGGGASSSPASAAAANGRALVRWDQILPRRSLRVLLVEHDDSTRQVVTALLRKCGYRVAAVADRMKAWGVMRERAYAFDLVLTEVAMPSLSGIQLLSRIVAADECKNIPVVMMSSQDSIGTVLKCMQKGAVDFLVNQ

SEQ ID NO: 83440 - DNA, 1167 bp, Zea mays
  misc_feature: Ceres CLONE 1569350
  misc_feature: Encodes the peptide sequence at SEQ ID NO. 83441
  misc_feature (14)..(14): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (412)..(412): n is a, c, t, g, unknown, or other
  misc_feature (413)..(413): n is a, c, t, g, unknown, or other
  misc_feature (455)..(455): n is a, c, t, g, unknown, or other
  misc_feature (897)..(897): n is a, c, t, g, unknown, or other
  misc_feature (946)..(946): n is a, c, t, g, unknown, or other
  misc_feature (1060)..(1060): n is a, c, t, g, unknown, or other
  misc_feature (1077)..(1077): n is a, c, t, g, unknown, or other
  misc_feature (1114)..(1114): n is a, c, t, g, unknown, or other
  misc_feature (1118)..(1118): n is a, c, t, g, unknown, or other
ggggcgcgggcgtncatttccagtccttacctanannnnnnnnnnnnnnnnnnnnnnnnnaaacnnnnnnccaagtgtgagtaannnnnntggcggccgctctagaatagtggatcccccgggctgcaggaattcgtctcacccctagaaaaaatcgctaccacctatcctctcctgaagccacccggacgccggacgcaatggatttttcaaccgcatctacctcctctccccatggcgccgcctgctgactcgacccctgatctaaggcccgtagccagcgtgcccgtgcccatcaccgtgccgagcccgcgggaccacactcaccaccaccaccacctagtcgatcgtcgggacaggggggggggcccctctttgttatcccaaacgaaaccggcgcggagaggcgatnnactttttttcccccccccaggggagaaagaaaggggggcttnttcttcttacaaaaaaaacccccccggaaaaaactcgttcccggtgtgggggaggggggcaattttcgtacagcgagagccccggcgtcgcctcggggggcaacaacggctctttgcaagatcgggacgggtttgggcccagcgggaaggagtggtctcttcccgcggagaggcccctctgggggtctatgcctgctcgcgtcgggaggggcgtgtggcggctcaagagccgtggccagtatgaaagcgggcgagagggaggtcggacgccgcgtggtgagtgttccggccgacaggaccgagtagatggtgcgccggagcggtcgcgaaagcacctcagcgcgcgatatacggcccatagatgcggccgaatgtggatgcggagggtggaagagtcgccgcgtgcggggcgacatccagcgtcggtcgactcgctccgtgncggcgacacgaggctcacgcgcttctcaccaggcagagctcgggtcgtntggtcgcgctgaccgcagaagccgccgccccgatcgcgtgcggaggcgagcagtacagaggtatggcaggtgtcgtcgtcaacggaaggaattcgcacggagagaggctcgcgntcgaaccgaagacgacngccataagccggccgacttcatatcgctcgtgcccgnacanccgtcatatactgcagcggcggctgcgtgcgcacttttgatcggcagct

SEQ ID NO: 83441 - protein, 154 aa, Zea mays
  misc_feature: Ceres CLONE 1569350
  misc_feature (60)..(60): Xaa is any aa, unknown, or other
  misc_feature (74)..(74): Xaa is any aa, unknown, or other
MAPPADSTPDLRPVASVPVPITVPSPRDHTHHHHHLVDRRDRGGGPSLLSQTKPARRGDXLFFPPPGEKERGAXSSYKKNPPGKNSFPVWGRGAIFVQREPRRRLGGQQRLFARSGRVWAQREGVVSSRGEAPLGVYACSRREGRVAAQEPWPV

SEQ ID NO: 83442 - DNA, 895 bp, Zea mays
  misc_feature: Ceres CLONE 1569352
  misc_feature: Translation starting site: 207
ccccgcggtggcggccgctctagaactagtggatcccccgggctgcaggaattcgtctcacccctagaaaaaacccttcccgttccccaattcgaaatcgagtcgggtactcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtcccccaatttgaagaggtggatcagcacaggagtcgtgccccgattcattgagttccttacacgtgaggaccatccacaaactccagtttgaggctgcatgggcgctcacccactttgcatcaggcccttcagaaaaaccctaagtgggtggtttaaaagtggggctggggcccatcttttgttaaaccccctcaaccccaataagcgaggaattttccgtaaacaaggcttgtatgggcttttaaggaaaggttgcctgggggaaccccccaagatgcccggaaatcttggggccaaggcccatggtggggctatttccccctttggtggcacaaactttaatataggctgtgcctaacgctctccaagg

SEQ ID NO: 83443 - DNA, 1080 bp, Zea mays
  misc_feature: Ceres CLONE 1569356
tccccgcggtggcggccgctctagaactagtggatcccccgggctgcaggaattcgtctcacccctagaaaaagtctgctcccctccactgctgtggcgctctccctctcccgtctcccctcaccttctccacctcccccattccgccaccgcacaagccgacctccctcaccaagaggagaaaagaaagggagagcgaaggaggcaaaccaggtgggacagcaacgcgacgtgcttgctattctctcgaggagctcatgcaaaggtgtaagtcttactgcaagaagggcagctgtgcatgttaagacccatacatagcctctcttgattacacccccgggggggtgaaaaacttcagatacagggtggattctcctggttcagaatatgggttcaaagcccccccccccggcgtcaacttaacaaatgggccctggaggtttcgtggcggagcctggagccaccctcagggaggaaggggccccacccatattggtccccacccggcggatgccctataactggggggggggagcctacacagaaaaaacccggggggaagcctggggggaaaagaaattttttgacaccctccccgtggttgtgaggaaagcgtcaaaaaaaaaaatccgtgggacccttctcaggggaagaaaatggcctcgccgtttgaagggggaagaaaacgcttctccatttgtgggggaggggtggggttgtgtctttccacacctgcctctgtgaggacccgcaagtgtcccccggtgcgcggtgagggagggcgccgccccgagaaatatgtgggtgtggggggagtcttatctcacagggctccacaggttccctggggtggttggggggcgggagtgtccgcccgaggtgggataagatcccggagtctgtggggcacgcgcgtctccagataggagtggtgagagggctccttagaggaggtgtgggctctcgggctccccctccttgggggggagaggcccgcctcgggggcggccccacgattttgttgggggcggggttgttctgggggggttcgcagaagacgggggtttttcaccccgtggg

SEQ ID NO: 83444 - DNA, 897 bp, Zea mays
  misc_feature: Ceres CLONE 1569358
  misc_feature: Encodes the peptide sequence at SEQ ID NO. 83445
ctccccgcggtggcggccgctctagaactagtggatcccccgggctgcaggaattcgtctcacccctagaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaacagcagcggctcatctttgcttgggagcagcttgaggacgggcgcacgctttgcgactacaacatccagaaggagagcaccctccactgggtgctgcgccctcaggggaggcatgcagaatcttcgtgagggaccctgaccggcaaaactatcaccccttcgaggtggagtcttcagaaacccatcgaacaacttcaaaggcccaaatccagggaaaagggaaggcatttcccccagaacagacagcgggttcatcttttcttggaaagcaacctttgaggaaggggggccacgcctggcccaaattacaactttccggaaggggagcaccccctccccctttgggtgctgcccccctcggggggaggggcattggcaaatttctcgggaaaaacccttgt

SEQ ID NO: 83445 - protein, 157 aa, Zea mays
  misc_feature: Ceres CLONE 1569358
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPEQQRLIFAWEQLEDGRTLCDYNIQKESTLHWVLRPQGRHAESS

SEQ ID NO: 83446 - DNA, 889 bp, Zea mays
  misc_feature: Ceres CLONE 1569367
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (725)..(725): n is a, c, t, g, unknown, or other
  misc_feature (726)..(726): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (754)..(754): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (786)..(786): n is a, c, t, g, unknown, or other
  misc_feature (787)..(787): n is a, c, t, g, unknown, or other
  misc_feature (803)..(803): n is a, c, t, g, unknown, or other
  misc_feature (804)..(804): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (834)..(834): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (866)..(866): n is a, c, t, g, unknown, or other
  misc_feature (867)..(867): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
ctccccgcggtggcggccgctctagaactagtggatcccccgggctgcaggaattcgtctcacccctagaaaaaaactaatccacacaagcacacccaagaggcaaggcaagagagtaggtgtaagtgcaagagatgatgagcaagacgaaggcggctgtgcgaccaagatcctggcacctccctttcctcttcctgctgctcctcgcccagacttgttccccgcaggagcaaggcggcggcggcggcgccctccacgggagcttcgtccgctgcgtggcgcgcctctcgccggccaccgccgacacgtccaggctcgtccacgccccgtcggccgcttcgtacccttccctgctgaacgccaccatccagaacctccgcttcgcgtccccgcggacaccgcgcccggcgctgctgctgaccccggcgaccgtcgccgaggctcgggcctgcgtcgcctgctgcaggcgccacggcctcacggtccgcgcccgcagcggcggccacgactacgagggcctctcctcgtttggggggggggggggcnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnncnccccccccnnccccnnnnccnnnnnncccccccccccnccnnnnncnnncccccccccccnnnccccccnncccccccccccccccnncnnnncnnnccnnnnncccccccccnnncnccccccccccccnnnccccnnnnncccccccnncccccccccccccccnnnnnct

SEQ ID NO: 83447 - DNA, 857 bp, Zea mays
  misc_feature: Ceres CLONE 1569368
  misc_feature: Encodes the peptide sequence at SEQ ID NO. 83448
  misc_feature (734)..(734): n is a, c, t, g, unknown, or other
  misc_feature (831)..(831): n is a, c, t, g, unknown, or other
ctccccgcggtggcggccgctctagaactagtggatcccccgggctgcaggaattcgtctcacccctagaaaaaagcaccccctcctcgctcgcactccgttcgtctgacatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacatttgaattcatacttttcatcagagccagtatcctcgcattgttacggaggacttcttgccacttccaagcaaagggaaatctggggaagatggctggtatcctnccagccaatggtgatgtgttccccctctttgaatacagtggaaaactcgacatcttattggctcagggcaaggaggtatgtcttcgttgctaactcngaacacttgggttgctatagtcggaa

SEQ ID NO: 83448 - protein, 159 aa, Zea mays
  misc_feature: Ceres CLONE 1569368
  misc_feature (29)..(160): Pfam Name: UDPGP Pfam Description: UTP--glucose-1-phosphate uridylyltransferase
  misc_feature: SWISSPROT Homolog: EC 2.7.7.9 UTP--glucose-1-phosphate uridylyltransferase
MAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTFLDLIVIQIESLNKKYGCNVPLLLMNSFNTHDDTQKIVEKYSNSNI

SEQ ID NO: 83449 - DNA, 812 bp, Zea mays
  misc_feature: Ceres CLONE 1569369
  misc_feature: Encodes the peptide sequence at SEQ ID NO. 83450
  misc_feature (392)..(392): n is a, c, t, g, unknown, or other
  misc_feature (742)..(742): n is a, c, t, g, unknown, or other
ctccccgcggtggcggccgctctagaactagtggatcccccgggctgcaggaattcgtctcacccctagaaaaaactgtgattggcggtagcccatcgacgacacgagatatcagctgcctcagatctcgtcggtgggtgccaatcacattcttcgacagtttgtcgatcgtcgtcaagacatttcaacagctagctagcctgcctataaaatgcgcgcgcacgaacctctgtagcacaaatggacctgtgagaaagcaagaaataaagatatatacacacatggctactacgggcacaacatctatgccagcacctgtgtttcaccccacggtgtggggggactacttcatcaaatttgtcccagagccattgcaggtttcagatgaaacnatggcagagagaatcaggcatttgagagaggaggtaagtggtatgttccaggcttgcaagaacgttgtggacaaaacgaacctagtagacgtggtacaacgtcttggaatagatcaccatttcgaggaacagatagccactgccctagccagcatccacagcgctggattattcaatagctcaagcctacacgaggctgcccttcggtttcgcttgcttaggcagcaggggttttgggttcctgcagatgaacttgtcaagttcatcaagaacgaagacgggagctttatcgatggtataaccaatgacccaaagggcctgttgagcttatacaacgcagctcaccttgntactcacgacgaggggacgacgacacttgaagatgccatcgcatttgcaaggcagcatctggaagctgcc

SEQ ID NO: 83450 - protein, 177 aa, Zea mays
  misc_feature: Ceres CLONE 1569369
  misc_feature (19)..(176): Pfam Name: Terpene_synth Pfam Description: Terpene synthase, N-terminal domain
  misc_feature: SWISSPROT Homolog: EC 4.2.3.9 Aristolochene synthase
  misc_feature (154)..(154): Xaa is any aa, unknown, or other
MATTGTTSMPAPVFHPTVWGDYFIKFVPEPLQVSDETMAERIRHLREEVSGMFQACKNVVDKTNLVDVVQRLGIDHHFEEQIATALASIHSAGLFNSSSLHEAALRFRLLRQQGFWVPADELVKFIKNEDGSFIDGITNDPKGLLSLYNAAHLXTHDEGTTTLEDAIAFARQHLEAA

SEQ ID NO: 83451 - DNA, 872 bp, Zea mays
  misc_feature: Ceres CLONE 1569370
  misc_feature: Encodes the peptide sequence at SEQ ID NO. 83452
  misc_feature (669)..(669): n is a, c, t, g, unknown, or other
ctccccgcggtggcggccgctctagaactagtggatcccccgggctgcaggaattcgtctcacccctagaaaaaccaccaccaccggtcaccgaaacgcagcaactgacaggcacctgacggagagctagtcgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtgccggtgccgccggcgcggccgttcctggacacgttccacgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctgatcgccggcatcaccatcgccagcctcgccatcccgcagggcatcagctacgccaagctcgccaacctgccgcccgtgctcggactctactcgagcttcgtgccgccgctggtgtacgcgctgatggggagctccaggactggcgtggacacgtgggggggggggggccttcctgtctatcnctccttggttcggcggcgagggggccccgaacggaaaaccccgggctttacctggcacctggctttaccggcaccttttttggcggggggtttccagggctctgttgggcctcctcagggtggggcttccttcggggaaccttgtttgccccctccaaagaattgggggggttttagggcgggcccgcgacaactgtgggtgg

SEQ ID NO: 83452 - protein, 208 aa, Zea mays
  misc_feature: Ceres CLONE 1569370
  misc_feature (141)..(141): Xaa is any aa, unknown, or other
MGGSADANGAGSVRVPVPPARPFLDTFHGNLKETFFPDDPFRGVVRERGAGRRTVAALRYFFPFLEWAPAYALSTFKSDLIAGITIASLAIPQGISYAKLANLPPVLGLYSSFVPPLVYALMGSSRTGVDTWGGGGLPVYXSLVRRRGGPERKTPGFTWHLALPAPFLAGGFQGSVGPPQGGASFGEPCLPPPKNWGGFRAGPRQLWV

SEQ ID NO: 83453 - DNA, 869 bp, Zea mays
  misc_feature: Ceres CLONE 1569372
  misc_feature: Encodes the peptide sequence at SEQ ID NO. 83454
  misc_feature (609)..(609): n is a, c, t, g, unknown, or other
tccccgcggtggcggccgctctagaactagtggatcccccgggctgcaggaattcgtctcacccctagaaaaagccctcctacttgcagaatctccatttccccccgcaccaaaccagccaaaccactggcgcacgccgaggagagagaaagggggtgtgcggggcggcgaccggcctccgacgacgcggggcgtcgcggcgtcgtggcggtgaagcggatgaggctgtgggaggaggaggacgatgacgaggacgaggaggggatggaagtggacggggaggcggaagatgagccggggtggccgtgtggggcgccggaggcggggcccggcgaaacgaggccggcagcgatcctcgtggcggacgcggcggaggtcgacttccccgtcatctacgtcaacgccgccttcgaggccgccacggggtaccgcgcgcacgaggtgctcgggcggaactgccgattcctacaattccgggatccacatgcccaaaggcgacaccccctcgttgatcccatggtcgtttcagagattcggcgatgtctcagcgaggggatcgaattccaaggcgagctgctgaatttccggaaggacggtgctccacttcancacagattaaggctcgttcctatgcacggcgatgatggctatgtgacgcatgttatcggaatccagctattctctgaggcgaacatcgatctcagcagcgtatccttatcggtgtacaagcaaaagtccagcagcaggccccagcatcaagatctggactcatctccccacgagcacgctccgaaaatccagagcgcagaccactgcggcttgcttcagttgtcaaaccaagttcttccacacaaaattctatcccggcc

SEQ ID NO: 83454 - protein, 216 aa, Zea mays
  misc_feature: Ceres CLONE 1569372
  misc_feature: SWISSPROT Homolog: EC 2.7.11.1 Non-specific serine/threonine protein kinase
  misc_feature (130)..(130): Xaa is any aa, unknown, or other
MRLWEEEDDDEDEEGMEVDGEAEDEPGWPCGAPEAGPGETRPAAILVADAAEVDFPVIYVNAAFEAATGYRAHEVLGRNCRFLQFRDPHAQRRHPLVDPMVVSEIRRCLSEGIEFQGELLNFRKDGAPLXHRLRLVPMHGDDGYVTHVIGIQLFSEANIDLSSVSLSVYKQKSSSRPQHQDLDSSPHEHAPKIQSADHCGLLQLSNQVLPHKILSR

SEQ ID NO: 83455 - DNA, 849 bp, Zea mays
  misc_feature: Ceres CLONE 1569377
  misc_feature: Translation starting site: 210
  misc_feature: SWISSPROT Homolog: EC 2.6.1.42 Branched-chain-amino-acid transaminase
  misc_feature (356)..(356): n is a, c, t, g, unknown, or other
  misc_feature (447)..(447): n is a, c, t, g, unknown, or other
  misc_feature (448)..(448): n is a, c, t, g, unknown, or other
  misc_feature (461)..(461): n is a, c, t, g, unknown, or other
  misc_feature (572)..(572): n is a, c, t, g, unknown, or other
tccccgcggtggcggccgctctagaactagtggatcccccgggctgcaggaattcgtctcacccctagaaaaaggacattgtcttcgtctccttcatcccctgcccacctgttctgctctgccgccgccgccgctgccgctcccgctgccgcaggaaccctagaccacgctgagcaacccccggcctacacggcgtagctttgcaggaaatggaatacggcgccgtcctcgccgccgcgccgctcgtcgcacggccgaactggctcctcctctcgccgccgccactggcgccgtctattcagattcagaatcgtctttattcgatctcgtcattcccactaaaggctggacctgtnagggcatgcagagctttagcaagcaactacacgcaaacatctgaaacagttgatttggactgggagaaccctggtttttgggatgtgcaannctgatatatgtantattgctaagtgcgggacagacgggaatttttctgagggtggaatggtgccttttggacctatagcgctgagtccatccttctggagtcctaaatattgaacaggaaatgntttgagggcctaaagggccttaaaaacctggagggaatcctcctatttttcccccaaaagaaatgcttaaaggaaacccacgggggctaaaagaaattaattcccccccccttggtggggggggttttttgggcgaaaaaaccacccgtttttaaaaaaaaaaaaggatcccccctccgggaaaaggttcccttgtaaatagggcctttattttgggaaaagggggggttttttgggtttcccccccccccccgagaaaaacttacaataaatttgg

SEQ ID NO: 83456 - DNA, 900 bp, Zea mays
  misc_feature: Ceres CLONE 1569380
  misc_feature (456)..(456): n is a, c, t, g, unknown, or other
ctccccgcggtggcggccgctctagaactagtggatcccccgggctgcaggaattcgtctcacccctagaaaaagcctgtctgtcgcctcgtgacgtctgttcaagaacactcgctccccacctgttcgctgcttcttcttcttgccaatctgctcctgcttctacctagatcttgcatggagctagacatgaccatggaggtagcaaatatcatcgatgtatgtagagtacgcggctgctagttagttcaccaggccagcaagcgagctccagcttcttccgatctatagatacgagctgtaccagcttggcatccatacatcaattgacagatcttagattcacgccatccccgctacgagttggtggttagccatcacaacgagcacgacacactcacgagcgagccatggccatggagtctgatcatgacgagcctctggactcagctgcgntacatcgtgttctgggtgctgaaagtagttcctgcaggggcttccccttcccatcggatgcaccgtggactccccgctgggcgcccggctaaaggttcctcctgggtgttataaaggcggataaccctacccctaccgggaacttgccatccggggcctgctggaacgcacccggggggggaaactttaccctgggaacggacaaacctttcggggaccctggggggccctgtctatttggcccaaccccggggggggggacaccttggggggccctaggggggcgggccccaggggtccttccccaaatatcaccaggaaacccggggggggccggttccccccgttgttttacaaaaaaaccccgggaggaaaaaaccctctccctccccccccctttttgtgaaggggggggggccgggcgccttttttttgtctctcccc

SEQ ID NO: 83457 - DNA, 855 bp, Zea mays
  misc_feature: Ceres CLONE 1569382
  misc_feature: Encodes the peptide sequence at SEQ ID NO. 83458
ccccgcggtggcggccgctctatactagtggatcccccgggctgcaggaattcgtctcacccctagaaaaatctggcaatccccatccccaaatctcccatggcttcttcccctccccagccactcacccgcaccgtcctcgccgctaccctgctcctcctcctgcacaatgccgccgccagagccgacggcgcgtcgccggcggtgaacccattcacggcgaaggcggcattcatccgatactggaaccgcaaggtgcccaacaaccgcccgcacccggccttcttcgtcgccaaactctccccgctcccggccgctgactccgcctccttcccatccgcgctgcccgacatccgcgccagcctacccgcgctctgctccaaagccgcgctcctctgccccgggccggctaccaccgatgcggcgtcgctggtggcatcgggccgcaggggcggggggcccttcaaaggctacaacaacgccaacttctccaactacggcaccggcggcgtagcggggaccgactcgttccagaagtactccccggacctcaacatcgccgccgacagcttccgccgctacggccgggactcgtcgggacgcgccgacagcttcacctcttacgaggacgacggcaacgtcgtgaccgccaacttcacctcctacgccggcggcgccacgggtgggttcgggctctttcgcgcctacgccgccgaagacaacgtcccggactccacttcaacaactacgacgccgccgccaaacgccggcggcggagcttcgcgtcctactccaggaggcgaaccatggggagtacggctttctccgctacggcagaaacggcaccgcgtgccc

SEQ ID NO: 83458 - protein, 252 aa, Zea mays
  misc_feature: Ceres CLONE 1569382
MASSPPQPLTRTVLAATLLLLLHNAAARADGASPAVNPFTAKAAFIRYWNRKVPNNRPHPAFFVAKLSPLPAADSASFPSALPDIRASLPALCSKAALLCPGPATTDAASLVASGRRGGGPFKGYNNANFSNYGTGGVAGTDSFQKYSPDLNIAADSFRRYGRDSSGRADSFTSYEDDGNVVTANFTSYAGGATGGFGLFRAYAAEDNVPDSTSTTTTPPPNAGGGASRPTPGGEPWGVRLSPLRQKRHRVP

SEQ ID NO: 83459 - DNA, 841 bp, Zea mays
  misc_feature: Ceres CLONE 1569386
  misc_feature: Encodes the peptide sequence at SEQ ID NO. 83460
  misc_feature (802)..(802): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgacagaaagctaccagtgtcggtgagaaagatgtcctcatctttgatctttgaggtgggtacttttgatgtctcctntcctcccattggagggagggatcttttgagtcagggccc

SEQ ID NO: 83460 - protein, 227 aa, Zea mays
  misc_feature: Ceres CLONE 1569386
  misc_feature (9)..(226): Pfam Name: HSP70 Pfam Description: Hsp70 protein
  misc_feature (215)..(215): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMVLIKMREIAEAYLGSTIKNAVVTVPAYFNDSQRQATKDAGVIAGLNVLRIINEPTAAAIAYGLDRKLPVSVRKMSSSLIFEVGTFDVSXPPIGGRDLLSQG

SEQ ID NO: 83461 - DNA, 830 bp, Zea mays
  misc_feature: Ceres CLONE 1569387
  misc_feature: Encodes the peptide sequence at SEQ ID NO. 83462
ctccccgcggtggcggccgctctagaactagtggatcccccgggctgcaggaattcgtctcacccctagaaaaactccacgcagctccactccacgggctagcagcagcagcagcttccccatgcatgcaatggcgtggtggggcggcgaggagggcgagccgttattcccgtccgtggacaagtgcgacgcgtcccgcctcggtcgggactccacgctggtggcggacctggacggcgcgctgctccgctccccggacgccttcccctactacgcgctcgtcgccttcgagacgggcggcgcggcgcgcctggcgctgctgctgctgctggcgccgctggccgcggcgctgcgccgcgcggtgtcggagtccgcgggggagcgggtgctggtgttcgcggccacggcgggcgcgcgcgtcgccaacgtcgagtccgcggcgcgcgccgtgctgcccaggttctacgccgccgacgtgcgccgggacgcgtggcgcgtcttctccgcgtgcggggggcggaggctggtgctcaccgccgcgccgcgggtcatggccgagccgttcctgcggcggtacctcggcgccgacgccgtcgccggcacggagctcgccgcgtggcggggacgcgccacgggggtgggtggacgcgcgccgcggcggcgtgctcgtcggcgagagcaagcccaggcgctgcggcagatgctcgacgcccggggagggtgcccgatgtcggggctcgggccacgggagatcggattacgcccttcatgagtttctgcaagggtttcccctaccttttattaaccaacaacccatcccaagaaaaaaa

SEQ ID NO: 83462 - protein, 213 aa, Zea mays
  misc_feature: Ceres CLONE 1569387
  misc_feature: SWISSPROT Homolog: EC 2.3.1.15 Glycerol-3-phosphate O-acyltransferase
MAWWGGEEGEPLFPSVDKCDASRLGRDSTLVADLDGALLRSPDAFPYYALVAFETGGAARLALLLLLAPLAAALRRAVSESAGERVLVFAATAGARVANVESAARAVLPRFYAADVRRDAWRVFSACGGRRLVLTAAPRVMAEPFLRRYLGADAVAGTELAAWRGRATGVGGRAPRRRARRREQAQALRQMLDARGGCPMSGLGPREIGLRPS

SEQ ID NO: 83463 - DNA, 838 bp, Zea mays
  misc_feature: Ceres CLONE 1569388
  misc_feature (403)..(403): n is a, c, t, g, unknown, or other
  misc_feature (634)..(634): n is a, c, t, g, unknown, or other
  misc_feature (635)..(635): n is a, c, t, g, unknown, or other
agctcaccgcggtggcggccgctctagaactagtggatcccccgggctgcaggaattcgtctcacccctagaaaaaggtgggctccggtgggatgccgtcctcgcactcagccaccgtcacagcgctcgccgtcgccgtcggcctgtaagaggggctcgccagctcgctgttcgccaccgtcgtcgtctttgtcttcgtgattggttccccttcccactccccctctccctttcgacaccaaaaaaacgcgctgaccatctttggcaagctgtcgcccaccccaccccaaaaccctagctctattccatcgctcccgtactccctattgcggcggttgagaacagtggcgacaagatctcatggagagaagctatgcggaccccaggaaaggtgaaatcgtcntgcgatggtggagatggccgatgggaggctccaccagccctagggtgtggccaacaagacgctactcgccactgcgtgggtcggcagtgagatctcagggagagaagcccatgcaccccatgaaaggcgaaactgtcgcacgatggtggagacgaacggcgggaggatgcaagtatgagcatttggcaagagagtattcctcccatgctcccgctcccctctgaaccccannggtggcgagaggcggctgaaatttgttcgagctttgccgaggcatcatgggcccccgggggcggggggtaaacattaaatcaaccccggtaaattccggggtttggtcctccccctccgggggatggatcccttcaaagggggcgggggggggggaaaaccgttttttccccagggcgtatttccggggggctgtaaaaaaaa

SEQ ID NO: 83464 - DNA, 854 bp, Zea mays
  misc_feature: Ceres CLONE 1569390
  misc_feature: Translation starting site: 181
  misc_feature: SWISSPROT Homolog: EC 1.4.1.2 Glutamate dehydrogenase
gagctccccgcggtggcggccgctctagaactagtggatcccccgggctgcaggaattcgtctcacccctagaaaaactgacgcctcgcgaagccatcatcttccaaaccctcgccgcagccgcagccgcagccgcagccacccttgcttccgcacgatagtgcccgggaccagccttctatggcggcgtcgctgctcctccgcgctgtgcgccgaagggagctcgcgtcccctctcggatccctgggtgccaacttacagtcaacatgtgctgccaacatatgctcaaaatggggaaattttgcaagaccttttagtgcaaaagctgctggaaatgaggttattgggattgatttggggacaactaactcttgtgttgctgttatggaaggaaagaacccaaaagttattgagaatgctgaaggtgcgagaacaacaccatctgttgtcgcatttactcagaagggtgaaagacttgttggtactccagccaagcgccaggcagtaaccaatccccagaatactttctttggaacaaagaggatgattgggcgacgctttgatgatccacagacacagaaagagatgaagatggtgccatacaaaatcgtgaaggctccaaatggtgatgcttgggttgaaacaacagatggcaagcagtactcaccgagtcaggtcggtgcatttgtgctgaccaagatgaaggagacagctgaatcttaccttggcaatcagtctcaaaggcagtgattactggtccagcttatttcatggatgctcagcgtcaggccacaaaggatgctggtcgcattgctgggccttgatgttgaaaagatcatccatgaacctacagt

SEQ ID NO: 83465 - DNA, 843 bp, Zea mays
  misc_feature: Ceres CLONE 1569392
  misc_feature: Translation starting site: 164
  misc_feature (642)..(642): n is a, c, t, g, unknown, or other
  misc_feature (726)..(726): n is a, c, t, g, unknown, or other
  misc_feature (730)..(730): n is a, c, t, g, unknown, or other
ctccccgcggtggcggccgctctagaactagtggatcccccgggctgcaggaattcgtctcacccctagaaaaatcttctctctccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatggggtcctcggcgtcatcagtttggtacaaccctccaggtgtcgcacccgaccaaggaggcgcccgtcatcgactacaagctcgcgttgctcttccagcccnatgctatgctcggcataacccatcgcgtagagctcagcgtcatcttcccatactggctaatcactgtccctcatataatcctcntcgnaggcacctcgtcgagatccttctaacagggcattctgatgtggagggaggagtccagaattctgaatgagacacccgggcgaagaagagcaatcaagtctacctgcgctgcag

SEQ ID NO: 83466 - DNA, 841 bp, Zea mays
  misc_feature: Ceres CLONE 1569397
  misc_feature (680)..(680): n is a, c, t, g, unknown, or other
  misc_feature (746)..(746): n is a, c, t, g, unknown, or other
ggagctccccgcggtggcggccgctctagaactagtggatcccccgggctgcaggaattcgtctcacccctagaaaaagtgattttctgggtgaatttttcccggcctccgctccggccagatcggcgcgggtgaaccccggcccctaccgatccggatccgtccccatcgcctcgtgtgttttccgtcgagtattttagcgtgtgtgtctccccttcttcgcttcggttggtgcgtgcggctgtctcgggtagatctggtggtttagttcgccttgaaggcgcgcggcggcggtgtcgcggcttgtagcttgcgatttcacggtggagcttgtcggctgttggggtcggatttggtgcgtggctgcttcggcgctaggcgatccttgtgctgtttccgtgggatatttgtcgttgaatagataggtgaagttgctgtaaacattgcttaccgtgtaggggactgtaaagaatcgttcacgctcgtgcaggctgtgacgaattcgctcgatggttcgggctgatctctgagatgaccccgagctgacgtacccatttcacaacggcaccgaccgtgaagcgactcatcatgggcaggcttagcttgttctgttgttagctgttggtgcttaggtcgtgcatatttctgaaacatgatcgggttaagagtatttggctatnctgcatgggtggttggggcacttcatcatctgtctgcatacgggggtggagatttacgtaaaaccnacttggacctgtgaggcattatgtctttttttttacgaaaatcaggtatcttgctacctaaaagttgctagatttgcatgctagatcatcacata

SEQ ID NO: 83467 - DNA, 840 bp, Zea mays
  misc_feature: Ceres CLONE 1569398
  misc_feature: Encodes the peptide sequence at SEQ ID NO. 83468
ctccccgcggtggcggccgctctagaactagtggatcccccgggctgcaggaattcgtctcacccctagaaaaagccgcacaacgatccgagcgcgcccgtccctggcccagaagatcccaacgccgggcgcgcgtccccatccgtccgccgcgccggggtatctatcgcggcgtcgtggggtcggagctccgggtccggggccgggcaggcgggaagcagggcgcaagcgcaatggtggagatagggagccgggtgcgggggttcctgcggaaccggtggctggtgttcgtggcgtcgatgtggatgcagtcctgcgccggggtcggctacctattcggcagcctctcgccggtgatcaaggcctcgctcgggtacaaccagcgccaggtggccgggctcggcgtcgccaaggacctgggcgacagcgtcggcttcctcgccggcacgctctgctccgtgctcccgctctgggccgcgctcctcgtcggcgccgcgcagaacctcgtcggatacggatgggtctggctcgccgtcacgcgccgtgtccccgtgcccccgctctgggcgatgtgcattctaatcttcatcggtaacaatggtgagacatacttcaacactgctgcacttgtctcatgtgttcagaacttccccaagagccgtggaccaatttgtggtatcctcaaaggattcgctgggattagtgggagcattctaacacagatttatgcaattgtgcactctcctgatgatgctgcgctgatcttcatggttgcagttggcccaacatgatttgtatagcttttatgttcattgtaagacctgttggaggccacagaca

SEQ ID NO: 83468 - protein, 185 aa, Zea mays
  misc_feature: Ceres CLONE 1569398
  misc_feature (15)..(185): Pfam Name: Nodulin-like Pfam Description: Nodulin-like
MVEIGSRVRGFLRNRWLVFVASMWMQSCAGVGYLFGSLSPVIKASLGYNQRQVAGLGVAKDLGDSVGFLAGTLCSVLPLWAALLVGAAQNLVGYGWVWLAVTRRVPVPPLWAMCILIFIGNNGETYFNTAALVSCVQNFPKSRGPICGILKGFAGISGSILTQIYAIVHSPDDAALIFMVAVGPT

SEQ ID NO: 83469 - DNA, 802 bp, Zea mays
  misc_feature: Ceres CLONE 1569399
  misc_feature: Encodes the peptide sequence at SEQ ID NO. 83470
ggagctccccgcggtggcggccgctctagaactagtggatcccccgggctgcaggaattcgtctcacccctagaaaaactaatcaagctggaggaaccagaataaaaccttattctcaaacaccagatgttgacagtgctactagtggtactcagcctgctgcaaaacttgattccatatcagcaatgcctgagtacaaagagaagagtcatgaagaattgaggtgggaagactaccagcgtggagacaagggtggaccgaacacttctggaactcaaacattggcacctagctttccatcaccaatacaacataacacttttgcttcgacaagtaatccattctcaacgaacccattttcaacaaacaacccgtttgctcctaagcccactacaactactagttcaccattcaacacctcatttaacaatgcatcagttgcaagttcgagtctattcacatcatcccctggtaccacaatgtttgggcaaccaggtgtttctacacttccagctccagcaagtaattcaccatcattatttggaaatatcaatcctgctcctgctacatcgtcaatatttgccacgtcagtgacgaataatccaagtccattcggcactggcacatcattggctaacactcaatcagcccccactatttcctcagcatttgctcaaccgacatcaagtacaccggctttctcctctggggagctattttggctcactaatccctggcagtctgtttaccagcagcggtccttcactttttttcacaccaaacatttcaaccatctgcccct

SEQ ID NO: 83470 - protein, 205 aa, Zea mays
  misc_feature: Ceres CLONE 1569399
MPEYKEKSHEELRWEDYQRGDKGGPNTSGTQTLAPSFPSPIQHNTFASTSNPFSTNPFSTNNPFAPKPTTTTSSPFNTSFNNASVASSSLFTSSPGTTMFGQPGVSTLPAPASNSPSLFGNINPAPATSSIFATSVTNNPSPFGTGTSLANTQSAPTISSAFAQPTSSTPAFSSGELFWLTNPWQSVYQQRSFTFFHTKHFNHLP

SEQ ID NO: 83471 - DNA, 852 bp, Zea mays
  misc_feature: Ceres CLONE 1569402
  misc_feature: Encodes the peptide sequence at SEQ ID NO. 83472
ctccccgcggtggcggccgctctagaactagtggatcccccgggctgcaggaattcgtctcacccctagaaaaacaagtttgatacgtttactcctgcagctgagcgggggctcccggtcacaagggtcatagccgcatgacgctgcaacagatccttgctcgagcagttggcgatgacgctatattgaatggaagccatgtagtcgattttacagatgatggcagtaaggttactgccatattggaggacggtaggatatttgaaggtgaccttttggttggtgccgatggaatatggtcaaaggtgaggaagacactattcgggcactcagatgccacctattcaggttacacctgctacactggaattgcagattttgtgccgcctgatatcgatacggttgggtaccgggtatttctgggccacaaacagtacttcgtctcttcggatgtcggtgccggtaaaatgcaatggtatgcttttcacaaggaagaggctggtggcactgaccctgagaacggcaaaaagaaaagattgcttgagatatttgatgggtggtgtgataatgtcatcgatttggtaacccgcaccgacgaagaagcgattcttcgccgagatatatacgaccgcccacctactataaattggggggaaaagtcgtgtcaccttgctcggcgattctgtccatgctatgcagtctaatcctgggtcaaggtggctgcatggctattgaggaatggtaccagctgggcgtagaactagagaatgcctggcaagagagtgtcaagactggaactcctatggacatagtttccctctttgagaacgtatgagaaagaaaagaggctgg

SEQ ID NO: 83472 - protein, 188 aa, Zea mays
  misc_feature: Ceres CLONE 1569402
  misc_feature: SWISSPROT Homolog: EC 1.14.13.90 Zeaxanthin epoxidase
MTLQQILARAVGDDAILNGSHVVDFTDDGSKVTAILEDGRIFEGDLLVGADGIWSKVRKTLFGHSDATYSGYTCYTGIADFVPPDIDTVGYRVFLGHKQYFVSSDVGAGKMQWYAFHKEEAGGTDPENGKKKRLLEIFDGWCDNVIDLVTRTDEEAILRRDIYDRPPTINWGEKSCHLARRFCPCYAV

SEQ ID NO: 83473 - DNA, 845 bp, Zea mays
  misc_feature: Ceres CLONE 1569404
  misc_feature: Encodes the peptide sequence at SEQ ID NO. 83474
  misc_feature (610)..(610): n is a, c, t, g, unknown, or other
ggagctccccgcggtggcggccgctctagaactagtggatcccccgggctgcaggaattcgtctcacccctagaaaaagcggtcgcgcaggcgtaccaaacagctagggccgggggccgcagccgcgcacacagcaagcaatggcggacgccgccgagatggtgcgcttcctctatctccggaccccgccgcggccgttgctcccgcagttcgctgtacatacacagcggccacaaagtctgctcagagtttccccccgcttccgccctcccatccgtcttcggtgccgcgcgctcgacgccagtagaccggttgcggtggagggggagcgggatgaggaggacggtctcgaggacgaggaggagtcctacttctcggtcacctcgtcggggctctcggaggtggactacctaggggaaagcaccaggggggatttgaacgtgaggagggagcgcctcgaggcgcttgggaacagcaagtcaactttgcatggtcctattgaggagatagcttggaaagaagcgggagaagctgaaacattgcttcatgacttgggaattgcagacccgttttcagtaagacactctcctcgtggaattttctgcaccangacactaaatcttcgatctatcagtgtagttggctacgatatggattatacattaattcattaacatgtgatggccctgggaaggacgtgcatatgactatgggatgggacacctcaggagcatgggttttccagtagatgactttaaatttgaccctgacctggtcataagaggtctgttatggaataagaagaaggaaaacttggtaaggctgatcgatttgggtaaataaga

SEQ ID NO: 83474 - protein, 177 aa, Zea mays
  misc_feature: Ceres CLONE 1569404
  misc_feature (157)..(157): Xaa is any aa, unknown, or other
MADAAEMVRFLYLRTPPRPLLPQFAVHTQRPQSLLRVSPRFRPPIRLRCRALDASRPVAVEGERDEEDGLEDEEESYFSVTSSGLSEVDYLGESTRGDLNVRRERLEALGNSKSTLHGPIEEIAWKEAGEAETLLHDLGIADPFSVRHSPRGIFCTXTLNLRSISVVGYDMDYTLIH

SEQ ID NO: 83475 - DNA, 874 bp, Zea mays
  misc_feature: Ceres CLONE 1569405
  misc_feature: Encodes the peptide sequence at SEQ ID NO. 83476
  misc_feature (408)..(408): n is a, c, t, g, unknown, or other
tggagctccccgcggtggcggccgctctagaactagtggatcccccgggctgcaggaattcgtctcacccctagaaaaaaccaacaccaaccaacaggtggcgagagcgagagcgagagcaaagagctgagcgggacggagcagctagcgctagggataacgcacacccaccaccatggcgacgcccggagagcagccggcggaggtcgtgtccgtcgagatgcccgcacccgacgggtggaccaagaagtttactcccttgagaggggggagatctgagattgtttttgtttcaccaactggcgaggaaattaagaacaagaggcaattaagtcagtacctaaaggcacaccctggaggccctgctgtttcagagtttgattggggaactggtgataccccaacgcnttctgctcgtattagcgagaaagtcaaggtatttgatagcccagagggcgagaagatcccgaagcgcagcaggaactccagtggtaggaagggtaagcaggggaagaaggaaacccctgagaccgaagaagccaaagatgctgaaactggcaaggaggcagaggaagcccccaagcgaagatgctgcaaaggagactgatgtggagaatgaagcctgcctgagagggtgaagggggcctctgctgaaacagaagatgctgacatggctgatgctcctgccccgcacccttgggaggaggataggaaccaacctggaagactgggcaaaagttattgcacctccctccgtgccatcggaagaagaagaaagatgtcaaggccaccttaatccttaaacttgcagcaaagcaccccaactgggggattcgggcccctggctcctgcggaaacccgggtgaaaggtccc

SEQ ID NO: 83476 - protein, 143 aa, Zea mays
  misc_feature: Ceres CLONE 1569405
  misc_feature (8)..(78): Pfam Name: MBD Pfam Description: Methyl-CpG binding domain
  misc_feature (78)..(78): Xaa is any aa, unknown, or other
MATPGEQPAEVVSVEMPAPDGWTKKFTPLRGGRSEIVFVSPTGEEIKNKRQLSQYLKAHPGGPAVSEFDWGTGDTPTXSARISEKVKVFDSPEGEKIPKRSRNSSGRKGKQGKKETPETEEAKDAETGKEAEEAPKRRCCKGD

SEQ ID NO: 83477 - DNA, 889 bp, Zea mays
  misc_feature: Ceres CLONE 1569406
  misc_feature: Encodes the peptide sequence at SEQ ID NO. 83478
  misc_feature (405)..(405): n is a, c, t, g, unknown, or other
  misc_feature (623)..(623): n is a, c, t, g, unknown, or other
  misc_feature (717)..(717): n is a, c, t, g, unknown, or other
  misc_feature (784)..(784): n is a, c, t, g, unknown, or other
aagctggagctccccgcggtggcggccgctctagaactagtggatcccccgggctgcaggaattcgtctcacccctagaaaaagaagcggcacctgtccaagacggtggacttcatccacgagaactggaagcggatatggctcgtgacgctgtggctggtcgtcaacgtcgccctgttcgtgtacaagttcgagcagtacaagcgccgaaccgcgttccaggtgatgggctactgcgtctgcgtcgccaagggtgccgctgagatcctcaagctcaacatggctctcatcctgctgcccgtctgccggaatacgctgacgacgctcaggtccaccgcgctcagccatgtcatacccttcgatgacaacatcaacttccacaaggtcatcgcgctgtccatcgcnatccccacagcgatccacacgctcgcacacgtgacctgcgacttcccaaggctgatcagctgcccgacggacaagttcatggccaccttggggtccaacttccactacaagcagccgacttacctgggcttgctggagagcacacccggggttaccggaatcctcatgatcatcataatgtccttctccttcacgctggcaacacatcccttcaggcngagtgtggtgaagctgccatcgccgctacaccaccttgccggtttcaatgctttctggtacgctcaccacctgctgggccctggcgtatgtccntgctggtgggggcactcctactccataatccctccccaggggagtggtaccaagagaacgacatggnatgtaccttggattgtcccctggtcttctttctatggcctgtgaaaaaagtccttcgggaatatttcgtgaagaacaactaccaatggcgggaattgggtgaagg

SEQ ID NO: 83478 - protein, 200 aa, Zea mays
  misc_feature: Ceres CLONE 1569406
  misc_feature (9)..(166): Pfam Name: Ferric_reduct Pfam Description: Ferric reductase like transmembrane component
  misc_feature: SWISSPROT Homolog: EC 1.6.3.1 NAD(P)H oxidase
  misc_feature (133)..(133): Xaa is any aa, unknown, or other
  misc_feature (187)..(187): Xaa is any aa, unknown, or other
MGYCVCVAKGAAEILKLNMALILLPVCRNTLTTLRSTALSHVIPFDDNINFHKVIALSIAIPTAIHTLAHVTCDFPRLISCPTDKFMATLGSNFHYKQPTYLGLLESTPGVTGILMIIIMSFSFTLATHPFRXSVVKLPSPLHHLAGFNAFWYAHHLLGPGVCPCWWGHSYSIIPPQGSGTKRTTWXVPWIVPWSSFYGL

SEQ ID NO: 83479 - DNA, 908 bp, Zea mays
  misc_feature: Ceres CLONE 1569407
aaagctggagctcaccgcggtggcgagtccgctctagactagtggatcccccgggctgcaggaattcgtctcacccctagaaaaacctagaaaaaattttttgcagacctgcgtatcccctcaggccggcatggttagcgggagcgggtgccgttggaggaggtctgatctcgtctgcggcgggggcgagagagcaaggccacggcgtcgcggcaatgagcagcaccaccgccgacacatccccggagagcgtcggctcctgccgccctcccactcctcctacttcccttccccctcattcagcgccggcggcggccctccgcggcgctccagtgaggcggcaactggacttcgcggacgcggacgcccaactcctgttgccggcgcccgggtggcgaacctggacgaactaccacccaccccccttattccccgcccgtggaatgaacatttgaggcgggggctttttaacgaggggccaagggcaaccgcgcctccccgcccgggggggttttggcgggggggggccgggcttttttttgccccgggtgtgtgccaaaagggggggacctaaccccacgaaccccggccggggggggggggaagttgatacgccttcggggggccaccacttcgcacccccccaaaaaagttggtaaaacaaatgcttctccccccctgggtgtgtttagggggagatgttgtattttagagtaaattctccgaaataattcgcctcctccctcctgtttgtgtctgggaaaaagtggttttcttccccagaaaaaaagaccgctatctcctcctgttgtgggcgccttcttgagcatcttttattatacgagaggcgccctctcgtctcgtgaacaacaaaacggagtgtctagtcatcaaacacccgccaggtg

SEQ ID NO: 83480 - DNA, 847 bp, Zea mays
  misc_feature: Ceres CLONE 1569409
ctccccgcggtggcggccgctctagaactagtggatcccccgggctgcaggaattcgtctcacccctagaaaaagccccaccctccttcctcagctccgttgcgcaccgccaccggcggccggccagccgccggagcaccgaaagacccccgttctttcctgtaaaaaaaaacccgccgcctttagctagctaaccggtcgtcctcttcaccccctagctttgctagctctagctaggaacgaaagaaattaaaggataactgagattgctgattggtggtccgggtacggtgttcttgagtcgtgaagcgacagtacagtggctagggtcgtgccgcccctgcagtctccggggatgcgtgcaggatggtcgtcagggatcgggagtgaggaggcatcagctctcgcggtcgtggagcctaaatgtaccgcaacaacgactcggcactctccagcgactacctctacctcctctgggtcttcttctagaagtagacaccaccagttcgccaggtagttagcagcccagttgcgactggggatcggtggcgggctgccgcttgcgagttgtaagcttgcaggggaggggagcaggagcacgagatgcacctggatctgaacgtggctcaggcgccgccgccggaggagatggaggcgagcaactcgaggtcgtcggtgcttaacgcgtactgaagcggcgtccgctggcggcgcgctcgttccgggctgaggagggatctagttcaaggccggccggtgctggagtttaccatcttcattcaggagcgataacaaacacggaccggcgcggaaccaggaccagggactccactacattgaccttctt

SEQ ID NO: 83481 - DNA, 855 bp, Zea mays
  misc_feature: Ceres CLONE 1569410
  misc_feature: Encodes the peptide sequence at SEQ ID NO. 83482
ctccccgcggtggcggccgctctagaactagtggatcccccgggctgcaggaattcgtctcacccctagaaaaaatcggcaggacatccacaccaacccgtgctcaaggaaaaaaaaccggggcggcgaaaaccctcgaaccctaatccttacgcccctcatggcggacgctgatgcggcgctgccaacgccgcctccggaggtagtagcccccgaggagcatcccgtgggcgccgaatccaccgtcgccgcgccggccgaagtcgataacaagcggaagctagaggaggtcagcgccgacgcggaggtgaaaggcaccagcgaggacgccaagcgcccgcgcgtggacggcgagcccgacgccgcaacaggggttgagcagcaaatcgatgggtcctccgtgaatgcggatcccgcagctccggaggataaggctgctcttaacgttggcgcagcaatggatggtgataatgacacgcctgctcccgctcccgctccagactcgcaggcggtttctgacgagaagccgcttgaagcagcagctgaagctccacagcagggaggtgatgcagcaactgctgtacaggagatttctcgtaagatcgaagtgcccaacagcaaggttgggtgtcgttattgggaaaagctggtgagacaatcaggaacttgcaaatcagctcggggtgcaaagatccaaaatcaccaagggacatcgaagcggactcaaatgcccctgaactcggcccgggttgaactagtttggaaacacctgggcagcggttgataaaagctgagcagcctttattaaagagtgtcactaacctgaaggcttgaaggctgggtggggttcccccg

SEQ ID NO: 83482 - protein, 207 aa, Zea mays
  misc_feature: Ceres CLONE 1569410
MADADAALPTPPPEVVAPEEHPVGAESTVAAPAEVDNKRKLEEVSADAEVKGTSEDAKRPRVDGEPDAATGVEQQIDGSSVNADPAAPEDKAALNVGAAMDGDNDTPAPAPAPDSQAVSDEKPLEAAAEAPQQGGDAATAVQEISRKIEVPNSKVGCRYWEKLVRQSGTCKSARGAKIQNHQGTSKRTQMPLNSARVELVWKHLGSG

SEQ ID NO: 83483 - DNA, 887 bp, Zea mays
  misc_feature: Ceres CLONE 1569411
  misc_feature: Encodes the peptide sequence at SEQ ID NO. 83484
ggagctccccgcggtggcggccgctctagaactagtggatcccccgggctgcaggaattcgtctcacccctagaaaaaggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatcgatatgccgttcggccacacgcggctcgatgtccggcgtccgccgcagtcgtcctacctctgctgctccacaaccaccgtcgccgtattcgtcgcgctctgcctggtggctgtgtggatggcgtcgtccatgctcgtcacccctgccgagttccctccatttcagtccaaagtgcgtccactgaggcctcatgactctcctcctgcccacggaagcttaaccagtgctgatcagggcgatggcatcaccacccatgatgatccaccacctgctacacaacaattgcctcctgtaacagacagcatggatggtgaaaatcagcaacaagaacttttcactacagagcgcggaccatgttcaaacaagggctgaacaatctaacagggacgctaaagagcaacctttgaccttcaatagcccactgagctcccgttggccgttatatcaccgtccatgctggagcaaaataatattcatgccttcgaaacgtaacagctttcaagaagctcctttcccccaggctttcaaaccccgaaaaaggctttcccccagaaaaatccccacccgcctggtcccccaaccgaagggctaaggaaaccaatttggggggccaaaaacaaaaaacaaatttgggacaaaaccctccc

SEQ ID NO: 83484 - protein, 122 aa, Zea mays
  misc_feature: Ceres CLONE 1569411
MPFGHTRLDVRRPPQSSYLCCSTTTVAVFVALCLVAVWMASSMLVTPAEFPPFQSKVRPLRPHDSPPAHGSLTSADQGDGITTHDDPPPATQQLPPVTDSMDGENQQQELFTTERGPCSNKG

SEQ ID NO: 83485 - DNA, 872 bp, Zea mays
  misc_feature: Ceres CLONE 1569413
  misc_feature: Encodes the peptide sequence at SEQ ID NO. 83486
  misc_feature (412)..(412): n is a, c, t, g, unknown, or other
  misc_feature (413)..(413): n is a, c, t, g, unknown, or other
  misc_feature (450)..(450): n is a, c, t, g, unknown, or other
tccccgcggtggcggccgctctagaactagtggatcccccgggctgcaggaattcgtctcacccctagaaaaaaaccgcgcccccacaccccgctcctctcgctgctcgctcccttttcaccttccccttcccaggctcaggctcccccctcccctgccgtgccgtgctctctcaacaagggagaaggggaaaccaccaccaccaccaccaccaccaccaccacacctgataagaagggggccttcccgctcccgccgctacgccatggacgcctgggaggccaccaaggcggtgttcgaccgggtgcgggcactggacccggacaacgcgtccaagatcatgggcctgctactcatccaggacaacagcgacaaggagctcatccgcctcgccttcggccccgaacacctnnctcacgcctttgtctccgccgcgcgcgccgacctcgncgcaagcccgcgtcccccccgtcggccgtgctgggcccgctccacagacctgggggagcgccgacgcacccaagccctaccgcgggttcgaacacccaaaccaggccccttttgcccccgacctcgggtttggttaaaaatttaaagggcccgggcccgggcctaaaacctttttttcccaaaaaaataaaattgttggttaccggggcggggcccccccccccccgaatttttttctttaggaaaccccaagcccccccccccccccaaagggtcccctgggaagggccctttttttatttttccccgggggttttttaaaaaaaagggttccccgggggttttttccccggggttttttggggagaaaaaaaaccccccttttaaaaaaaaaaaaaattctcattattgccccaaacacc

SEQ ID NO: 83486 - protein, 109 aa, Zea mays
  misc_feature: Ceres CLONE 1569413
  misc_feature (50)..(50): Xaa is any aa, unknown, or other
  misc_feature (62)..(62): Xaa is any aa, unknown, or other
MDAWEATKAVFDRVRALDPDNASKIMGLLLIQDNSDKELIRLAFGPEHLXHAFVSAARADLXASPRPPRRPCWARSTDLGERRRTQALPRVRTPKPGPFCPRPRVWLKI

SEQ ID NO: 83487 - DNA, 896 bp, Zea mays
  misc_feature: Ceres CLONE 1569414
ctccccgcggtggcggccgctctagaactagtggatcccccgggctgcaggaattcgtctcacccctagaaaaaacctccccgaccacccaccgcatcgccagtcgccacgcgacagcgacgccccgcatccccgcggacgccgacggctgggcctaccgcctgcgcctctgggggcggcgggtccagacgccacgcgcactctagaagagttgttgtgcggcgccgggcgcggcggccgttggatcccgtgccgtgccgccgccttcgccccgcccgtcctcggcgcgtcagcgaccccctcattgtggctgcgtgcctgcgtcggccagcccgcttgctttgcccctcgcttcgcttcaaatggtagagccgctgcaggctgagcgaccgcgagcttgacccggggcgcagtcggctcgcacccagccatgtcggcgccctggattcgatgacccccagcttccgccgctgaggctccgcgccttcgtgcgggggcgcgatcggcaagccacgctcctggttcctcctgtgaaaccttcgtcaggatggcttccacgcccctcaggtaatgctaaatccgggcggtgctaagggtccccacacccttgggaaccggtggaaggggtcctccttcggaaaagaaattttggaagggccccccaatacaaacccccttgatgggttttttccagggaaagggggttttaaaaaaaccccctttttaaacccccccaaaaatattggccccaaggggggggaaaactttttttttggggctcaggcacccctttttccgggaaaagaaaaccccgcacatttgaagaagggcccctcctccccacccccttaaagagagggggggggggcccctcttggtggggccccacaaaaaaa

SEQ ID NO: 83488 - DNA, 868 bp, Zea mays
  misc_feature: Ceres CLONE 1569416
  misc_feature: Encodes the peptide sequence at SEQ ID NO. 83489
ctccccgcggtggcggccgctctagaactagtggatcccccgggctgcaggaattcgtctcacccctagaaaaaaacatctccggcccatcgcccgtgctctgcactgtctcgcctccgacctccgcgccctctcaaggtctcaccggagaccgcgctgcggtccgcgggctttgggtagcgcgggatggcctccgtggggtgggctgcacgcgacgcgtacgacgaggaggccgcagtccgccgccctctcgagctcgagggccgtggcgtcgccgcatcgtcctccgaccaccggcccggcgggaatgtcatgcctaggtatcaagtgggctcgacaaagggtgattcaagtagtagacgacactctgaggagtggcggcaacctagcacagatgatgtgcgcatgagcaagccggggtcgagatatttcacggcgtttggggggtggatctgtcccctgataatatggcagttgccattgtatattttgtgcaaggggttttaggtcttgcacggcttgctgtgagcttttacttgaagatgatcttcatctagatcagctgagactgcagtggtatctgggtttctcgtccttgccggcctgatcaagcccctctttggctttatcaggtcccacaatccctcccaattcaattcctttcggagggtactttggagcctttttcttggacttaagggccccacggggggggcgtaaattccgggcagactttctttattctttttgggccccattttggtgcccctcccaaaggtttggagggaattttgggtttaaaaaaaaccccggggaaaaactcaaaaaatttgggggaccccccggcccccttgggtgggggatttct

SEQ ID NO: 83489 - protein, 106 aa, Zea mays
  misc_feature: Ceres CLONE 1569416
MASVGWAARDAYDEEAAVRRPLELEGRGVAASSSDHRPGGNVMPRYQVGSTKGDSSSRRHSEEWRQPSTDDVRMSKPGSRYFTAFGGWICPLIIWQLPLYILCKGF

SEQ ID NO: 83490 - DNA, 900 bp, Zea mays
  misc_feature: Ceres CLONE 1569422
  misc_feature: Encodes the peptide sequence at SEQ ID NO. 83491
  misc_feature (482)..(482): n is a, c, t, g, unknown, or other
  misc_feature (489)..(489): n is a, c, t, g, unknown, or other
  misc_feature (585)..(585): n is a, c, t, g, unknown, or other
  misc_feature (710)..(710): n is a, c, t, g, unknown, or other
ctccccgcggtggcggccgctctagaactagtggatcccccgggctgcaggaattcgtctcacccctagaaaaagaagcaagcatcagaaatcctaaataggggggcgcaccaagaactccactgagaatccccaatcatttctcggtgcatttggccccgctccaccatcaccgaaatctccaagaaaactcatcccgaatccgcccccgcccccaaatcggccctacaccgcaccagatcacagctcataattccagtgagaattcggaaaggaggggagcaatgacggaggtggcgctcctccggggcccgaccaacctcgcttccaccgcaagccgcgcccccgcctccccctccccctccccctcctcctcttcgctgcggtatttagccaatgccgacagcgacgtgctccaaggaagcggcagcccggagcgcactgcgggatctgcggggagccgacgactccttgaactgcgncgacaanaggcggcggaggaggaaaaagagcggtgggtctttctggcgctgctctttgagctactgcggaaagtcgtgctcgggtgcaggaccgtgggcggcnggcaaaaggcgaacacggcgctgcgggatggaagatgggttgcccaacggacgtgcagcaccggggcgcacgtcacgttccaatagggttccacggaatccctaggcctggccccgttgaatttnaaggcccgagaggcccccccccggtctcccaggggcaagggcaagggggttttccgggtgtttaaccaaaaatcaaggggggggttccttttgaattccccaagggaaaaaaggttccacaaaaatccctttttgagaagggcaaaaaacccctttttataaaaaggggggggcctcttggggagaaaaa

SEQ ID NO: 83491 - protein, 128 aa, Zea mays
  misc_feature: Ceres CLONE 1569422
  misc_feature (69)..(69): Xaa is any aa, unknown, or other
  misc_feature (101)..(101): Xaa is any aa, unknown, or other
MTEVALLRGPTNLASTASRAPASPSPSPSSSSLRYLANADSDVLQGSGSPERTAGSAGSRRLLELRRQXAAEEEKERWVFLALLFELLRKVVLGCRTVGGXQKANTALRDGRWVAQRTCSTGAHVTFQ

SEQ ID NO: 83492 - DNA, 924 bp, Zea mays
  misc_feature: Ceres CLONE 1569423
  misc_feature: Encodes the peptide sequence at SEQ ID NO. 83493
  misc_feature (498)..(498): n is a, c, t, g, unknown, or other
ctcaccgcggtggcggccgctctagaactagtggatcccccgggctgcaggaattcgtctcacccctagaaaaaggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcaccaccaccacgtgcagaaggtcgtgaagcggcttcagcagaggaacccgaagaaagacggtcttgtttgcacggccaggaagccctggatcgctgttggcatgcngcacgtggactacaagcgtgcgaggcattttcgaggtcgacttttctttccttcaggaacaatccttgagatcgacaaaaagaggatgggttgccaagggtccagccccctttgtcacatggggtacaaataaacaggagcctacttggcccaatggaacttttgcccttggggggtcgttccccaaacttcaaagacctccccttgttggggggggttgattcaacgggttaccggcattccggggggagccccctccccctcttggggccctttttcccacaacccgtttttcccccaatggaaggtttttttttcccaaaaaggggccggggttcctctgaaccccccccgggggcaacacggagaaccctctgaacctttttctattggggatttccccgggcgccacaggggaaacacctg

SEQ ID NO: 83493 - protein, 141 aa, Zea mays
  misc_feature: Ceres CLONE 1569423
  misc_feature (98)..(98): Xaa is any aa, unknown, or other
MADVHEPLVRRKRKKVLVDYLVKFRWILVIFVVLPISTLIYFNIFLGDMWSAMKSEKKRQKQHHHHVQKVVKRLQQRNPKKDGLVCTARKPWIAVGMXHVDYKRARHFRGRLFFPSGTILEIDKKRMGCQGSSPLCHMGYK

SEQ ID NO: 83494 - DNA, 899 bp, Zea mays
  misc_feature: Ceres CLONE 1569426
ctccccgcggtggcggccgctctagaactagtggatcccccgggctgcaggaattcgtctcacccctagaaaaagaaaggccgccaactgcgcaactggccctcgctagatgtagctggggcgctctctaccgccgctagggtttctaccgccgccgtcgatgggcgccctcaccgacagccggaagcgtctctcggcggaccactgcctctcggccgaccaccgcctcccctacccctcctccccgccgtcccttacccctcccttcaagcgggccaagctctccccaattcctgaacacgatccctccacctccgatttcccgcctatccgtccctctccccaaatcatccactccgctgcggcggcatccacctcctccacgccgggcccatccccctcttctaccaccgcttccaccccgcttccgcacaggcgccgactcccaccgccggcattccagcgctcgatccacggcccccagcggatcctccgcgtcttccagcttgggaggggcgcacgggccccacgcggccggccaatcatggttctcccccgaatcacccccgccttttcctctgggattcagcaatacgtttgagttcgtcaaaagggttcaccaaccgggggccgcccattcccgcccccattacccaaggttccaaggggggggggaggggggcccctctcagggggggccccctcctcgggggggtggggcccaaggggaaccccccaaacccagagggggggtttttggggaaccttgtttattaaaaaagggcccccccataaaaggggagtttttaaagggcgttctccaacaaaaacgggggagcccaccttctataaaccctccctagtttgggggggcggcgccctaatagaggaggggccct

SEQ ID NO: 83495 - DNA, 934 bp, Zea mays
  misc_feature: Ceres CLONE 1569429
  misc_feature: Encodes the peptide sequence at SEQ ID NO. 83496
  misc_feature (397)..(397): n is a, c, t, g, unknown, or other
agctccccgcggtggcggccgctctagaactagtggatcccccgggctgcaggaattcgtctcacccctagaaaaagctaccccctcgcctcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggccactcccaccgtcccacagcagcttcgcgtcggcttctcgcgccgccgcgcccagcgcgtcgtcgccatggctggatcccggcagttcttcgtcggaggcaactggaaggtgcgtagtgcatgttctgcttcttcagctttacgcggcttggagatgctcccnacccatgatcctggagatgctgtgtaactgtatcatttttttggctgttgccgcattgggcattccaacgggacagggacgagattttttttgtcgtaatgcatacccagggtttcattgaccattggccacagggttgcggcgggcctccccctccttgtttccttgccaaaatgcaacccttggcccccggacccaaaaaaaaattgggggaattaccccgggaacggggcccctttttaaaaaataaaattgtttttttttttgccccaacccaattttggttttccccccaaagccctttttttttcggtaaaaaaaaaggggggtttgtggttttttttttggaaaggggggggttaaaaaaggggaatttgccctttttccccctttaaaaacccttttgtgtggagaaaaccggggagggcccccttttcttccccccccccaaaaaaaaagggggtctttttttttttttttagcccctttttttaaaaattttaaaaaacccccccgggagaagaaagaatatattaa

SEQ ID NO: 83496 - protein, 88 aa, Zea mays
  misc_feature: Ceres CLONE 1569429
  misc_feature: SWISSPROT Homolog: EC 5.3.1.1 Triose-phosphate isomerase
MAAAPSSLVSSHLSRLADLRRAAAPATPTVPQQLRVGFSRRRAQRVVAMAGSRQFFVGGNWKVRSACSASSALRGLEMLPTHDPGDAV

SEQ ID NO: 83497 - DNA, 842 bp, Zea mays
  misc_feature: Ceres CLONE 1569430
  misc_feature (548)..(548): n is a, c, t, g, unknown, or other
  misc_feature (597)..(597): n is a, c, t, g, unknown, or other
  misc_feature (606)..(606): n is a, c, t, g, unknown, or other
  misc_feature (607)..(607): n is a, c, t, g, unknown, or other
  misc_feature (622)..(622): n is a, c, t, g, unknown, or other
ctccccgcggtggcggccgctctagaactagtggatcccccgggctgcaggaattcgtctcacccctagaaaaaaccaccgccaccgccaccgccggctcctgctgccaccgcccgctggctggcttagcgcgtaggctgtgactgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgcccgacgcggcgccggagccggccaagccctcgctgccggccacgtggctgctgctgcacgcgctcttctgcgccacatccatggccgtcggcttccgcttctcccgcctcatcgtcttcctcctcttcctgcccaccccgcccatcaaccccgccgcgcacctcgtctcgctcgtgtcctcgcccgccgtggcgctcgcggggggcaacgccacggccacgatcaccacgaccaccaccaccanccaccacgtcaccaccaccaccaccacgtgggccgcgacatcggcgggngcccaccgnnacacaacaccacggncacggccccgtcttcgtcgggcgccacccgatccgcgtccgcgcctgcccccacccggaccccagcgagctcctcaagcgcaccgcatcctcgccggcgtccaagacgcgcagcgcagcactagcgccgcggcgcgggacccgggaggccgttatcgcggttaccccgaacacacctcggggttcaaggggcgtcgctcagtttctggggcataccttcg

SEQ ID NO: 83498 - DNA, 837 bp, Zea mays
  misc_feature: Ceres CLONE 1569432
  misc_feature: Encodes the peptide sequence at SEQ ID NO. 83499
  misc_feature (766)..(766): n is a, c, t, g, unknown, or other
  misc_feature (812)..(812): n is a, c, t, g, unknown, or other
ctccccgcggtggcggccgctctagaactagtggatcccccgggctgcaggaattcgtctcacccctagaaaaaatcggtcagcacgatgtcattgacccgatgagaggtcgaagaagggcggatgcttcaagctttctctgctcggttaggttgctgtcgctcgctctgagtctgaggcctcgacgcgctgctagctgagagccgaaagaaggaatcctcggccggcagcaggagaggagagccaccgtttgatcagcgaccgggcaagagcaggccgcggccggccaccccgcccgtctctgtccgaccccgcaccagcgactcgccgagcgcaggcacaagaggggggctccatccatgaggcagccatgctggtgctcatcaacaggtatttcaggagcaggaacagcagcccggccggaggaggcggcgaagagatggcgccggcggcggtctccagcgaccacctctgtttgccgggctgcgtgcccgtgcgcgccaagcgggcctcctcctccgccgccgccgcggccacggccaccacggcgcgggcgtcgcggcacaacttcgtcagggccgcggcgtcgggcctgctggcgggggcgcacttcaccaaccacgagtcgctgccgccgcttccccacgcgtacgccgagttcgtcgcggcgttcccgcagtacgcccacggcgcgctggcgcggggcgacgcgatccggggcgaggagtaccagcacctgggaccgccacgtgtgccctggactacnacggcatcaacctcttctcgcacgcgcagatgagcggcctccttgncggtcaacctccttcggggcggccg

SEQ ID NO: 83499 - protein, 142 aa, Zea mays
  misc_feature: Ceres CLONE 1569432
MLVLINRYFRSRNSSPAGGGGEEMAPAAVSSDHLCLPGCVPVRAKRASSSAAAAATATTARASRHNFVRAAASGLLAGAHFTNHESLPPLPHAYAEFVAAFPQYAHGALARGDAIRGEEYQHLGPPRVPWTTTASTSSRTRR

SEQ ID NO: 83500 - DNA, 854 bp, Zea mays
  misc_feature: Ceres CLONE 1569433
  misc_feature: Encodes the peptide sequence at SEQ ID NO. 83501
ctggagctccccgcggtggcggccgctctagaactagtggatcccccgggctgcaggaattcgtctcacccctagaaaaaattggacgcgggcgatttagatggcgcacgacccctgcctgtgcttcgcggactatttctcgggggtggcggcggctggtgccacggctatggactacgacgtcggggcgccggagctctatggcctgtatgccgaccacatgtagttcctcggcctgcgtggtctggccgccatgcctcccggcgcggaatacctctagcaccaccaccatcacggtcacatcaaggccggtgcgctcctcgacaacaacgacacgtgggtggggtctgacttcagcatgctccgcggacgactccaccttgcgcttcactgagtcgagcggtatcagcagcagcaccaggctccgctgatcgctgtcgctgatgtccggccggacttggcgactacgttgcatcagcagcgtcacctcgtcggcggtggctcctcgtcccggtactctcatgagcagcatcctgcgggttgggtgcaacatcatcgcgactactctccgtctccgcagcagcacgcgtggtacctgcgcagctccaggtatcctcgtcacggcgcagcaggtcctgcacgagttctgcagcctccccgtggacacagcagcgacttcgtcctctagcaagagcgtcaagtcatctatgaagcggtcctcgactatagcagctgctactctacggcggcagcgccaagcggtcgacgtcgaccgtcatctgcgtgccgtcgcacagatccagtccatggatgctctagtgctgcaacggctcaggtagagctctcatcaggct

SEQ ID NO: 83501 - protein, 41 aa, Zea mays
  misc_feature: Ceres CLONE 1569433
MAHDPCLCFADYFSGVAAAGATAMDYDVGAPELYGLYADHM

SEQ ID NO: 83502 - DNA, 854 bp, Zea mays
  misc_feature: Ceres CLONE 1569434
  misc_feature: Encodes the peptide sequence at SEQ ID NO. 83503
ctccccgcggtggcggccgctctagaactagtggatcccccgggctgcaggaattcgtctcacccctagaaaaagacaaaaacccttccgccccgagccgaccggaaccctacccatcccgcatcgccgccggccggccgccccgccccgccccttcaccccctacctcttcttgcgccgtcatcccgatcccctacgctcgctgaggcattatgggtaaatcaagcaagaagtccagtgttaaggctgcacctgctgctgtctcagttccagaggtgaaatctgcaaagaaggggaagagaaatgcagaagatgagattgagaaggccgtgagtgcaaagaagcaaaagactgtacctgaaaaagctgtgccggttaagaagcagccccctccaaacaaagttgagagcagcagctctgaggaggattcttcagattccgaagtggaggttaaggtccagccgaagaaggttattcaaccgaagaaaggtacacaacctgctaaacaggagtccagtgatgacagcagctctgagagctcctcagacgatgaaccttccaaaaaaccagttgccggttcaaaaaagcctcctgccagtagtagcagcagtgatgatagcagtgacagtgatgatagtagctctgatgaggaaccagcaaagaagcccacgggtctttcaaagaagcccactgtcctttcaaaaaaacctgtcacagcagtcagtaatggttcaaaacaggtaaaccctgatagcagcagctctgacagtacctcagatgaggatggaaaaacctgcgctagcctaaaagagcctggttgttgcctctgtgcaaaagaagaacccaggattctc

SEQ ID NO: 83503 - protein, 214 aa, Zea mays
  misc_feature: Ceres CLONE 1569434
MGKSSKKSSVKAAPAAVSVPEVKSAKKGKRNAEDEIEKAVSAKKQKTVPEKAVPVKKQPPPNKVESSSSEEDSSDSEVEVKVQPKKVIQPKKGTQPAKQESSDDSSSESSSDDEPSKKPVAGSKKPPASSSSSDDSSDSDDSSSDEEPAKKPTGLSKKPTVLSKKPVTAVSNGSKQVNPDSSSSDSTSDEDGKTCASLKEPGCCLCAKEEPRIL

SEQ ID NO: 83504 - DNA, 820 bp, Zea mays
  misc_feature: Ceres CLONE 1569435
  misc_feature: Translation starting site: 279
  misc_feature (441)..(441): n is a, c, t, g, unknown, or other
  misc_feature (463)..(463): n is a, c, t, g, unknown, or other
ggagctccccgcggtggcggccgctctagaactagtggatcccccgggctgcaggaattcgtctcacccctagaaaaacccctctcgtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcccctcccgacacgtcgctctacgtgggcgacctggagggggccggtctcgactcgcagctgtacgaactcttcanccaggcggggcaggtggtgtcngtgcccgtctgcagggatgtcacctcgggccgctcgctcgaatacgctacgtcaactaaggcattcccttggatgctgcaagagcattgggaatggctaacttttgctggtcttaccaaaaagcttttcggggggaggatttcaaccctggatccaacccccccaggaagggatttgccaacatttttcaaaaaaaattttgcaagaaaatagaaaaaaaaaccctttttggagaactttttttttttttggggccacttccccccacaaaagggaacccccgggataaaaaaggcgccaatccaaaggggtttggttttttttttccccttttaccaaaaaaaaaaaccttcccca

SEQ ID NO: 83505 - DNA, 899 bp, Zea mays
  misc_feature: Ceres CLONE 1569439
  misc_feature: Encodes the peptide sequence at SEQ ID NO. 83506
ctccccgcggtggcggccgctctagaactagtggatcccccgggctgcaggaattcgtctcacccctagaaaaaccctttccgccacttcgctccgctcccatgcctcctgccccctctcgccgtggaggcaccccaaaccctagcccctgaaaccctagatcctcctcccctgttccgatggcgggggccgcggcgtccccagcggcgggccacgtggtggagcggttccgctcgcggctgcgcgaggaagcgggcggcggcgagccgggcgccgccgcggtcgtgcacgtgtacgcggaggcgctccgtgagctaaccttcaactgcaagccggtcatcaccgagctcaccatcatcgcgggccagcacgccacgctcgccgcccggggaatcgccgacgccatctgcgcccgcgtcgccgaggtgccaccagatcagatattaccatctttgtatctgctagatagtattgtgaagaacataggtggggaatatgtagagcattttgcaactaggttgcgaagtgtatttgttgatgcatactacagagttcatccaaaccagtatactccaatgaggcgcttcttttcgacctggggggcaaggttcccctctttcgggccttcgcagcattggaggatgacccttcaattttcctcctccgggaaaaaaaccgccccccccccctcaaaaaaattttgtttcaaaagaaaccgttatttcctaggggcctttcccgggggaatcaggggaaaaactccaaaaaccgtggagagcccaaacaaaattttcgagcccggccaaagggggggtggccccccccacaactcttggggaaccttgggaaaaataatatatattttcgggggggttctcttaaaaaaaggggaattccca

SEQ ID NO: 83506 - protein, 240 aa, Zea mays
  misc_feature: Ceres CLONE 1569439
MAGAAASPAAGHVVERFRSRLREEAGGGEPGAAAVVHVYAEALRELTFNCKPVITELTIIAGQHATLAARGIADAICARVAEVPPDQILPSLYLLDSIVKNIGGEYVEHFATRLRSVFVDAYYRVHPNQYTPMRRFFSTWGARFPSFGPSQHWRMTLQFSSSGKKTAPPPSKKFCFKRNRYFLGAFPGGIRGKTPKTVESPNKIFEPGQRGGGPPHNSWGTLGKIIYIFGGVLLKKGEFP

SEQ ID NO: 83507 - DNA, 875 bp, Zea mays
  misc_feature: Ceres CLONE 1569440
  misc_feature: Encodes the peptide sequence at SEQ ID NO. 83508
  misc_feature (481)..(481): n is a, c, t, g, unknown, or other
  misc_feature (484)..(484): n is a, c, t, g, unknown, or other
  misc_feature (663)..(663): n is a, c, t, g, unknown, or other
  misc_feature (720)..(720): n is a, c, t, g, unknown, or other
ctccccgcggtggcggccgctctagaactagtggatcccccgggctgcaggaattcgtctcacccctagaaaagcccctctggctcttgcattcaatggagctgggctttggatcatgagcggagcacatgggagaaaaccagcgcagcacaagtccaaagaccgaacttcttgatctggttcgggccgacgccgcgcctgacggtggcggagccggagctggtgcgcgagatcttcctgacgcgcgcggaggcgttcgaccgctacgaggcgcacccggtggtgcgccagctcgagggcgacggcctcgtcagcctccacggcgacaagtgggcgctccaccgccgcgtcctcgccgacgccttctacccggacaacctcaaacggctggtgccccacgtcggccggtcggtggcggctctggcggagaagtggcgcgccatggcgtccgcctcctcgagcggcgaggtggaggtggacntcncggagtggttcaggcggtcacggaggaaggcatcacgcgcgccaccttcggcgcagctacgacgacggccgcgtcgtgttccgcatgcagggccgcctgatgggcctacgctccgaggctttcgcaaggtcctggtccccggctaccggttcttgcccacaaagaaaaactgccattcntgaaagcttggacgggagatacggcggaacctgaaccgttttatcccccggggcaangaaaaggcccaggccaaagaggagaaatagccacccccccccgggggggttcccggaccttttctgggcccttgaaaaaagcccgggaaaaggaaaaaacccccccggggggggcgaatcccgggggggggaaaatcctggagaaaaaaacaaac

SEQ ID NO: 83508 - protein, 74 aa, Zea mays
  misc_feature: Ceres CLONE 1569440
  misc_feature (14)..(14): Xaa is any aa, unknown, or other
  misc_feature (15)..(15): Xaa is any aa, unknown, or other
MASASSSGEVEVDXXEWFRRSRRKASRAPPSAQLRRRPRRVPHAGPPDGPTLRGFRKVLVPGYRFLPTKKNCHS

SEQ ID NO: 83509 - DNA, 770 bp, Zea mays
  misc_feature: Ceres CLONE 1569441
  misc_feature: Encodes the peptide sequence at SEQ ID NO. 83510
ctccccgcggtggcggccgctctagaactagtggatcccccgggctgcaggaattcgtctcacccctagaaaaaagccagagggacatcaaactgtgctgcctgcgtgtgtgccttctttcttgcctctcccttcttcaacctttgctagcttgccagggagggagagtccatgaattccagcagaagcctcctctcttcgcccctctttgctagctcgtctccaaacttcaggagcagtgcttccgtctcctcctccccatccccatcccgcaccacagttccaatgatacatgacaccagcagcagcagagcatccacggcgtgccactactcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttaagagaagcaacagccgagtgctttaccacccaacatcatcattgaagaggatgaagattatgaattcttttttcggaaaagtttttccccattatttgggccaaacccccggggaaatttttgggatctttgggaaaacttaaaaaaaggggaaaaacaaaggctttcccccccgcggtgggggggagtccccaaaacccttttttttaaaaaaaaaaaaaggggtttttttataaaaaaaccccccccccggggggggaagg

SEQ ID NO: 83510 - protein, 88 aa, Zea mays
  misc_feature: Ceres CLONE 1569441
MIHDTSSSRASTACHYSPSLVAEEQLHGSKDTLTLKGEKALLELLLGMALDQHVDGRKLITQQEAEDSDFESYLREATAECFTTQHHH

SEQ ID NO: 83511 - DNA, 883 bp, Zea mays
  misc_feature: Ceres CLONE 1569442
  misc_feature: Encodes the peptide sequence at SEQ ID NO. 83512
ctccccgcggtggcggccgctctagaactagtggatcccccgggctgcaggaattcgtctcacccctagaaaaagctcgtctcttctggaaccgtccctcgctcgtcatctttccgccttcgctacgcaattcctgtccacgctgcgggccagttgtgacgaccgcgaagctcgtcagagaaagaagagaggccggcaggcgggcggcgatcggagatggcgccagagaagccccggaaggagcaggaggaggaggaggaggagttgatgctggaggatggaggcatcgaggagagcccgcgccgcagcttcgaggactgcggtgattccgacgaggaggacgatgacggtgacaacgatgaggagcgggacggcgacggcgtcggttcgccgcgctccttccagtcccacaagtggccgcagagctacagggaaacaactgatacttacacaatcgctgcatcaccgagctttggttacttgggcccttctacaagcaaatactcactcctcgatcttggtcgtagcggtctggggtctgacctgaagttgcctctattgtcggacaaggctgacggaaagcaagattctgtcaaaccctgccgaaaacccttggttcataagagatgagagggtctcatttcaattgcaacacccgggagaactctcctttactcaagggtgcaaggtgacgcaaacagccctccaaggggattaagggaccttgcgggggttgggcctcttttcccccccggtttacaattcctaaaccctgggtggcccggccctttccgattttgaaatttttttgcaaattgtttgcgggtataaccgggggatcttttctaaaacacttgtttttgagggagaaaagtgggtgtct

SEQ ID NO: 83512 - protein, 137 aa, Zea mays
  misc_feature: Ceres CLONE 1569442
MAPEKPRKEQEEEEEELMLEDGGIEESPRRSFEDCGDSDEEDDDGDNDEERDGDGVGSPRSFQSHKWPQSYRETTDTYTIAASPSFGYLGPSTSKYSLLDLGRSGLGSDLKLPLLSDKADGKQDSVKPCRKPLVHKR

SEQ ID NO: 83513 - DNA, 807 bp, Zea mays
  misc_feature: Ceres CLONE 1569443
ctcaccgcggtggcggccgctctagaactagtggatcccccgggctgcaggaattcgtctcacccctagaaaaagtgattttctgggtgaatttttcccggcctccgctccggccagatcggcgcgggtgaaccccggcccctaccgatccggatccgtccccatcgcctcgtgtgttttccgtcgagtattttagcgtgtgtgtctccccttcttcgcttcggttggtgcgtgcggctgtctcgggtagatctggtggtttagttcgccttgaaggcgcgcggcggcggtgtcgcggcttgtagcttgcgatttcacggtggagcttgtcggctgttggggtcggatttggtgcgtggctgcttcggcgctaggcgatccttgtgctgtttccgtgggatatttgtcgttgaatagataggtgaaagtgctgtaaacattgcttaccgtgtaggggactgtaaagaatcgttcacgctcgtgcaggctgtgacgaattcgctcgatgggtcgggctgatctctgagatgaccccgagctgacttacccattttcacacgggcaccgacggtgaagcgactcatcaggggcaggcttagcttgttctggttgtagctgtttgtgccttaggtcgggcatattttttaaaaattgaacggttaaaaatatttgggtaatctgcctggggggtgggggcccttcattatttttttggcatcggggggggggatttttccttaaaaccatttggccctgggaggggattttttctttttttttaaaagaaaaatagggtgaccctcccat

SEQ ID NO: 83514 - DNA, 900 bp, Zea mays
  misc_feature: Ceres CLONE 1569449
  misc_feature (430)..(430): n is a, c, t, g, unknown, or other
  misc_feature (493)..(493): n is a, c, t, g, unknown, or other
  misc_feature (814)..(814): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (874)..(874): n is a, c, t, g, unknown, or other
  misc_feature (895)..(895): n is a, c, t, g, unknown, or other
  misc_feature (897)..(897): n is a, c, t, g, unknown, or other
  misc_feature (900)..(900): n is a, c, t, g, unknown, or other
ggagctcccgtcgattgcagctattctgtactagtgtgatcccgctggctgcaggaattcgtctcacccctagaaaaagcccctctggctcttgcattcaatggagctgggctttggatcatgagcggagcacatgggagaaaaccagcgcagcacaagtccaaagaccgaacttcttgatctggttcgggccgacgcccgcccctgacggtggcggaacccggactggtgcccgagatcttccctaacccccccgaagcgtttcaacccctacaagggcccccgggggggcccccgcttaggggggagggggtggtttaaccttcccggggaaaaaggggggcctccacccccccggttccttttccgaacccttttttacccgggaaacctctaaaggggtggggggccccccccccccccccccccntgggcccttcttcttgggaaaaagatggggccccccagggggcccccccccccccgtggaacnagagaaggggaggggggggacctctctcgcaaaagggttcccccgcgcgggcccccggggggggggggggattttttctctcgtggccccccttttggggggcggccacacaaaaacaaaaaggcccggccctccttgtttttgccctaccaggggggcgccccccccaggtgaggagccgccccccccctcgagaggtttttctcaataggaggggggtgtcgtcctcgccctcgctcagatcgtttttttcctctccccaaaaaaaaaaacccccctcccttgttaagacccgtgtggggggagatgaatgttgttatntctattatttattttatagtagggggggggaaaaggggnnnncctgtnnnnncccggganaaaaaaaaaaatgaaaaaaananaan

SEQ ID NO: 83515 - DNA, 943 bp, Zea mays
  misc_feature: Ceres CLONE 1569450
  misc_feature (710)..(710): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (778)..(778): n is a, c, t, g, unknown, or other
  misc_feature (779)..(779): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (806)..(806): n is a, c, t, g, unknown, or other
  misc_feature (807)..(807): n is a, c, t, g, unknown, or other
ctggagctcaccgcggtggcggccgctctagaactagtggatcccccgggctgcaggaattcgtctcacccctagaaaaagtctgctcccctccactgctgtggcgctctccctctcccgtctcccctcaccttctccacctcccccattccgccaccgcacaagccgacctccctctccaagaggagaaaagaaagggagagcgaaggaggcaaaccaggtgggacagcaacccgacctgcttggtattctctctcggagcagctgtgcgggtgtaagtctactggcagaagggcagctgtgcatgtaagacccatacatagcctctcttgatacacaccaccgggggtgaaaaattgaggaaaattgaatctcccgggttcaaaaaaaggggggccaggggttggctcccccctcctgagcaaggggcctgtttagtttttttggcgaccccgggcacaccccgggggaaaggcgccccaccccttttgtttcccccgcggggggccccatataactgggggggggggggcccctcaaaaatcgggggaaggtgggggggaaaaaaaaaattttaatcccccccccctgttggtgagaggcgcagaaagaaaaaaattggggggcccctcccgggaagagagagccctccctcaagggggagaaaactttttcttttttggggggggggggggtgtgttcccaaaccntannantgtgggccccgggtccccaaaaggtaggggggggggggcgggcccaataaactccgcggggnnaaatggggccccgggnnnnnnnnnngnnggggggggggttgggggggatcccccccaaaaaaaaaaaaaaaaccttggggccgcgtccttaaaggggttgggggagccccacaaagggggtgttttggggcccccccatggtggggggaggggccccccagggg

SEQ ID NO: 83516 - DNA, 845 bp, Zea mays
  misc_feature: Ceres CLONE 1569451
  misc_feature: Encodes the peptide sequence at SEQ ID NO. 83517
  misc_feature (360)..(360): n is a, c, t, g, unknown, or other
  misc_feature (539)..(539): n is a, c, t, g, unknown, or other
  misc_feature (551)..(551): n is a, c, t, g, unknown, or other
ctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggccctcgcctnagggcttcttcgagtgcactcacgacgtgacgtcgctgacgtgcgccgacttcctgcgcgcgcccggcgtgcggacgcccgtgatcgtgcgcttctcgacggtgatccacgagcgggtttcccggagacgattcgcgacccgcgcgggttcgccgtgaagttctacaccgccaagggcnactgggaactgntgggcaacaacttccccggctttttcatccgggaggggattaagttcccccgacgggattcagcggttcaagcccaaccccggggtccaccgtgcaggagtactgggcgggggtttcaatttcctggtccacccttccggaaaagctgggaatcttttttttttcttttttaaaaaaatggggggttgcctttcaaattccccccaaatggaaagggttcggggttgaaacccaaaacacttttttaaacccccggggggaaaagcccccaaactttaaaaatttccctgggaa

SEQ ID NO: 83517 - protein, 192 aa, Zea mays
  misc_feature: Ceres CLONE 1569451
  misc_feature (18)..(193): Pfam Name: Catalase Pfam Description: Catalase
  misc_feature: SWISSPROT Homolog: EC 1.11.1.6 Catalase
  misc_feature (72)..(72): Xaa is any aa, unknown, or other
  misc_feature (132)..(132): Xaa is any aa, unknown, or other
  misc_feature (136)..(136): Xaa is any aa, unknown, or other
MDPTKFRPSSSHDTTVTTTNAGAPVWNDNEALTVGPRGPILLEDYHLIEKVAHFARERIPERVVHARGALAXGLLRVHSRRDVADVRRLPARARRADARDRALLDGDPRAGFPETIRDPRGFAVKFYTAKGXWELXGNNFPGFFIREGIKFPRRDSAVQAQPRGPPCRSTGRGFQFPGPPFRKSWESFFFLF

SEQ ID NO: 83518 - DNA, 868 bp, Zea mays
  misc_feature: Ceres CLONE 1569453
  misc_feature: Encodes the peptide sequence at SEQ ID NO. 83519
ggagctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaaccctcagagcgccgccagcaccgccgctgacaggcgcgccgcctgcaactgcctcaagaacgctgccaggggcgtcagcggtctcaacgccggcaacgccgccagcatcccctccaagtgcggcgtcagcatcccctacaccatcagcacctccaccgactgctccagggtgaactaaaacctagacacgcgcgacaacggccgcctgatcgattgaacaaccatttcgcccttcccgccgggcggataatcgaatcgccgcatgatgaataccatcaatccaccccgggaaaatcgaagggcaacctggccaacgggcttggaccaacaaaaaaaacccccccccggggtgccccacccctttgctttggctggggaaccttttttttccaaaccccccccatttttgtgtgtggaaatgtaaaacccccgggggggggggggggggggaggagaaacgggttttctttggaagagggccgcccccttttggggggttggggataatacac

SEQ ID NO: 83519 - protein, 121 aa, Zea mays
  misc_feature: Ceres CLONE 1569453
  misc_feature (32)..(117): Pfam Name: Tryp_alpha_amyl Pfam Description: Protease inhibitor/seed storage/LTP family
MARTQSAVAVAVVAAVLLLAAAATTSEAAITCGQVSSAIAPCLSYARGTGSGPSASCCSGVRNPQSAASTAADRRAACNCLKNAARGVSGLNAGNAASIPSKCGVSIPYTISTSTDCSRVN

SEQ ID NO: 83520 - DNA, 972 bp, Zea mays
  misc_feature: Ceres CLONE 1569458
  misc_feature: Encodes the peptide sequence at SEQ ID NO. 83521
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (61)..(61): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
ggcggggggggggaaaggaccagagacacccggcnnnataaaannnttannnntttttttngggttnnncccagagctggactccggtcggaggtggccgttttcaaacgggggatgcccccgggctgtaacaatacggcggacccctagaaaaagaagcaagcatcagaaatcctaaataggggggcgcaccaagaactccactgagaatccccaatcatttctcggtgcatttggccccgctccaccatcaccgaaatctccaagaaaactcatcccgaatccgcccccgcccccaaatcggccctacaccgcaccagatcacagctcataattccagtgagaattcggaaaggaggggagcaatgacggaggtggcgctcctccggggcccgaccaacctcgcttccaccgcaagccgcgcccccgcctccccctcccccgccccctcctcctcttcgctgcggtattcacccaatgccgacagcgacgtgctccaaggaagcggcagcccggagcgcactgcgggatctgcggggagccgacgactccttgaactgcgcggacaagaggcggcggaggaggaagaggagcggtggtccttcttggcgctgcgcggggagctactgccgaagtcgttgctcgggggcaagacccggggcggcggcgaaggcgaacactgcggctgcgggaaggagaagggggtgcccacgggactggcagcacgtgggcgcaggaacacgttccgaaagttccaacggaacccaagggcccgccccggagaaaaccaggccggaaaagccccgaccgggctcccaggggccagggcaagagggcctgcggcgggtctcaacaagaaacccaagggggggggggcctaaggaaatacccgaaagaaaaaaaggggaccccacaaacaaaacccatatgaagagagaggcgcagaaaaccccccgtatgaagaacacgggg

SEQ ID NO: 83521 - protein, 171 aa, Zea mays
  misc_feature: Ceres CLONE 1569458
MTEVALLRGPTNLASTASRAPASPSPAPSSSSLRYSPNADSDVLQGSGSPERTAGSAGSRRLLELRGQEAAEEEEERWSFLALRGELLPKSLLGGKTRGGGEGEHCGCGKEKGVPTGLAARGRRNTFRKFQRNPRARPGENQAGKAPTGLPGARARGPAAGLNKKPKGGGA

SEQ ID NO: 83522 - DNA, 829 bp, Zea mays
  misc_feature: Ceres CLONE 1569460
  misc_feature: Encodes the peptide sequence at SEQ ID NO. 83523
  misc_feature (489)..(489): n is a, c, t, g, unknown, or other
ggagctccccgcggtggcggccgctctagaactagtggatcccccgggctgcaggaattcgtctcacccctagaaaaaccatccgagatctcaaccgcctcgccggcgagcgactgacgggcggacggtcccgccggctatggggaactgctgctccgatgaggtgagccacgccggtgctcatcccgtcggctccgccaccgccaaagccgcctccgcagcctccgccgcggccgatcgctttctccgctcccgtggtgccggcgcgtccacgcagatcgagttatctctctctgcatcaaatttgggtgatcaagaatattttcccaagagtaatcccatggtggttgtgtattccaaaaagagagatggtacactagaagaaattgggcgcagtgaagtaattttaaattcattgaacccattttggacgaccaaaatcagtgtgcagtaccagtttgaggttcttcagcaattgggtgttttcanggtcttttgacattcccaccaaggcagtttcccctggaagggcccggggaaaaaaaatgcttttaaaccttagggggaaacaaaaaatttttttttggggaaagggggccccccggcggtttttttttgtccgaagggggttttttccccccaaaaagggggggaaaaaaattgtggttttactttttttaaaaaatttggggggggggtttctccccaaaaaaaaaaaaaaatttttgttgcccccaaaaccccccccccaaaaaaatttttttttttggtggggggggagaaaaaaatattttttttttttcgggggggggggaaaaaaaaaaaaaaa

SEQ ID NO: 83523 - protein, 119 aa, Zea mays
  misc_feature: Ceres CLONE 1569460
  misc_feature (117)..(117): Xaa is any aa, unknown, or other
MGNCCSDEVSHAGAHPVGSATAKAASAASAAADRFLRSRGAGASTQIELSLSASNLGDQEYFPKSNPMVVVYSKKRDGTLEEIGRSEVILNSLNPFWTTKISVQYQFEVLQQLGVFXVF

SEQ ID NO: 83524 - DNA, 848 bp, Zea mays
  misc_feature: Ceres CLONE 1569463
  misc_feature (848)..(848): n is a, c, t, g, unknown, or other
ctccagtcgattgggatttggttgatactgttttattcgactggttgtatgatttcgactgacccctagaaataccgaattagttgtgtgagtgtttacgtggcactcgagcaacatcgtacaagtgcgcgtggtaatagattggtagcgggtgccattaggaggcgcaaatcacggagaagaatacagagccctcctctgcgttttggcttcggctcgtgcacgtggctgtttgcctgtctacctacaagccttggtgcgatgcttctcgtgctgccgctggggtcgtatcgtatgtgctgatgcgcgggcacacgtgaacagcttttcgcggacattgtcgtgtggggactgccgggccaggacctcgcaattcatttgggctcgaaggatctcccgacgaccgagcgtggcgctcggtgactcgatttgctaccggagttcatccaattatgatgaattatacaagcctacgtattggtcacctaagtcaagcaagatgtactttgtcatggtgcaccaggagagtggactgactcgggatggtcatctccgagtatatgatgtccatactcatgatcatggtaacgtcttgttcgaactatttgaattagagactctatcatgccacaagtggtccgtatttactaatgacagcgctatgactaattgggaaattcgatggtttagtctcttccaagacggttatgtgcatcatctaacaggacatcccggagctaagggttctcatctcaaagcagtcaactgaatgattctggaattcgcgctgatatactcctcgggcaaaagcgtaaagtacaggtgctatcttgaaccccactgatctn

SEQ ID NO: 83525 - DNA, 843 bp, Zea mays
  misc_feature: Ceres CLONE 1569464
  misc_feature: Translation starting site: 273
  misc_feature (787)..(787): n is a, c, t, g, unknown, or other
  misc_feature (788)..(788): n is a, c, t, g, unknown, or other
ctccccgcggtggcggccgctctagaactagtggatcccccgggctgcaggaattcgtctcacccctagaaaaattcctgaggaacaggaactccatgagatccgcggcatccgccgtcccgttcatctgcacaaaaagaccgtaatccttctttttcctctcctccccatccgcggagtgtaaatcgtctctcgctagcgcgttcagtagaaaccctaaaccccgcctcctcccctcgccggggtaggggctacgggtgtcaacgcccgccatggacgcattccggaagcaactggatgtgctcatgggcgctaaccgcaacggcgacgtcgaggaggtgagccgcaactactacgaccgcgacgtctgccggctcttcctcgccggcctttgcccccacgacctcttccagctcacgaaaatggatcttggtccttgttctaagattcactcgcttcaactgcggaaagattatgaagaagcgaaagcaaagggaacagagattttgacagagaactcgaggatatgatagaaaggctcattgtggagtgcgacaggaaaattcagagggccctgaaacgacttgcggatgacgatgccaaggctgctattgcgatatccgtctcggaggttactctgacggatgacatactgcagctgtcaaaacagatcaaggaaaaatggtagaaagtgatgcctttgattttgaagggagaactgatgataaataaagccccagaagtagtggaagactcagaataaaagagctgatatgcaggctacccnntctgctgatgcttttaacaggacagagcttcattactcagcctgcttcacctctc

SEQ ID NO: 83526 - DNA, 829 bp, Zea mays
  misc_feature: Ceres CLONE 1569468
  misc_feature: Encodes the peptide sequence at SEQ ID NO. 83527
tggagctccccgcggtggcggccgctctagaactagtggatcccccgggctgcaggaattcgtctcacccctagaaaaagtccgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctgggagatccctgtggaaacattggagctaaattggtcagggcagctgcagctaagaccaacgatcttgctggagatgggacaaccacctctgtgggtctttgctcaggggctgattgctgaggggtgttaaggtcgtaagcaccttggggctaaatcctgttcagaaataccccgggggatttgagaaaaacagctttaagccccttgtttgaaaaaactccgggaagttttccttaagggagggttaaaaaaaaagtggaacctttcccaaaattttttcttccaattttaaggggctgggccaaacccttttttgaaaat

SEQ ID NO: 83527 - protein, 135 aa, Zea mays
  misc_feature: Ceres CLONE 1569468
MASTFGATSTVGLMAAPTGKNVRLQRRANFRVKAAKELYFNKDGSAIKKLQTGVNKLADLVGVTLGPKGRNVVLESKYGSPKIVNDGVTVAREVELGDPCGNIGAKLVRAAAAKTNDLAGDGTTTSVGLCSGADC

SEQ ID NO: 83528 - DNA, 882 bp, Zea mays
  misc_feature: Ceres CLONE 1569469
  misc_feature: Translation starting site: 290
ggagctccccgcggtggcggccgctctagaactagtggatcccccgggctgcaggaattcgtctcacccctagaaaaattcccctcccgttcactcgcgtaccgtcgctcgccgtattcccctgccgcgcacagttcactcgcgcacctctcgccccctcgctctacgacgactagtgggccgccggcgctggcgccgccttacgccaggtgccgaggtcttcgttgatctcttcgccggcgacgagcacccaccagctggaaaaaaaaatctatagccaaacataataatggctatgattgatgaacctctctacccgattgctgtactgattgatgaactgaaaaatgaagatattcagttgcgccttaactccatcaaaaaactttctacaattccccgggcattgggtgaagaaagaacaaggaaagagctgattccattccttagtgaaaacaacgatgatgaagatgaggtgcttcttgcaatggcagaagagttgggcgtttttattccttatgttggaggagtagagcatgcacatgttttgcttccaccctgaaaacattgtgtactgtggaggagacctgcttcagagacagggctgttgaatcactttgtcagaatggagcccggatgaaggaaattgattttggggactggtttgccctgtccaaaaaagggttggccgtagggtgagtggttcccagcttcgggtttcttcagggggccttttttcattccccctacccaagggcccctggaacaactgaagggggaaactgaggcacatttttgggcccgtttatgttcaggacaacctgccctttgggaacaaaaaagactcctcccacttaaatcttgggggaaatttgcttccat

SEQ ID NO: 83529 - DNA, 851 bp, Zea mays
  misc_feature: Ceres CLONE 1569470
  misc_feature: Encodes the peptide sequence at SEQ ID NO. 83530
ctccccgcggtggcggccgctctagaactagtggatcccccgggctgcaggaattcgtctcacccctagaaaaattcattgaggcaatgaataactacggaaaggatttttctcggatctcgtcttgtgtgaagagcaagtcatatgaacaatgcaaagtgttctttagtaaggctcggaaatcacttggtttggatttgatccatcaaggggcagccgatgttagtatgccagctagtgataccaatggagggaggagcgatactgacgaggcctgtgctgtggaaatggattcagctatctgtaggaagcagtcttgttcaaagattgtgcaagatgtttgtcctactgaaggagccattttagggcctgactctgttttaatctctaagcagacagaaggagatatatcaaataggtgcattgttgatgttaaaattgaggaagatgataaggaagctgataaaaattgcagcaatgttgatgataagaggtccagtgatagtactcatcaagctggccctatcaacatcaattgcccagaaagtacagataagctgcaaggaactgatgatgccgttgaccaagtaaacatgcatagtagtgtcctcaactcttcaaatgagcatgcaatggccatgcactcagaagtgagatccagtttacactctgtagatgtacttcaaacagacaaagctgaaagtactggtactgatcctagccaggtggaaagatgttcacatcatgctgtctacacaccgatgacagctgggaaatctggttcctcagcttttctacttcagatagtggtatcaaggacaatgttcacatctcaaacatgtctggtgcct

SEQ ID NO: 83530 - protein, 283 aa, Zea mays
  misc_feature: Ceres CLONE 1569470
PRGGGRSRTSGSPGLQEFVSPLEKFIEAMNNYGKDFSRISSCVKSKSYEQCKVFFSKARKSLGLDLIHQGAADVSMPASDTNGGRSDTDEACAVEMDSAICRKQSCSKIVQDVCPTEGAILGPDSVLISKQTEGDISNRCIVDVKIEEDDKEADKNCSNVDDKRSSDSTHQAGPININCPESTDKLQGTDDAVDQVNMHSSVLNSSNEHAMAMHSEVRSSLHSVDVLQTDKAESTGTDPSQVERCSHHAVYTPMTAGKSGSSAFLLQIVVSRTMFTSQTCLVP

SEQ ID NO: 83531 - DNA, 781 bp, Zea mays
  misc_feature: Ceres CLONE 1569471
ggagctccccgcggtggcggccgctctagaactagtggatcccccgggctgcaggaattcgtctcacccctagaaaactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcgcctccctcgacgtcgctgctgcctccacttcaccatggcgcttcacgccccgggtcctcgttctgaaggactcgctgaagcgggagtctgggcgcgaagttccacaaggccaacatcagggcggcccagggctgtccgctgacttcataccgcacttactttgggggccccaaaaacccctccttgaaaaaaggctttttgggaaggcctagggggaggggaattgggggggttaccaaaaaggggggggaaaaggccccctttttggggggggaaaaaaaaaaaactttgtgccaaccccttggggtggccaaaggtttttaaaaattcacaaacaaaaaatgctcttcccccccgggggtaaaaaaaaaaaaattgggggggaaagggggccccccaaacccccggggggaaaattttgtgttccccccgcgggggggggagagaagaggttccctttctcttgtttgttcccaaggggggttttttttcttttttgggaagaaaaagaaaaaaaacccccccctccccaccgggcggggttgtttttt

SEQ ID NO: 83532 - DNA, 865 bp, Zea mays
  misc_feature: Ceres CLONE 1569473
  misc_feature: Encodes the peptide sequence at SEQ ID NO. 83533
ctggagctcccgtcgatggcgatcgctcgagcacgtgtggatcccccgggctgcaggaattcgtctcacccctagaaaaatccgcacgctcgcctccctgctagtgctacgcttcgtgccgccgccgcaacctattccttcccgttccagattgcagatcatttaacataaatggctgacgcagaggacattcagcccctagtctgtgacaatggaactggaatggtcaaggctggctttgctggagatgacgctccccgtgctgttttcccaagtatagttggtcgtccacgtcacactggtgtcatggttgggatgggacagaaggatgcttatgttggtgatgaagcccaatccaagaggggtattctgactttgaagtaccccatcgaacatggaattgtaagcaactgggatgacatggaaaagatctggcatcacaccttctataatgagcttcgtgtcgcaccagaagagcacccagttcttcttacagaggcccctcttaacccgaaggctaacagggaaaaaatgacgcaaatcatggttgaaaacttcagtgttcctgctatgtatgttgctatccaggctggcctttccctaataggctaggggccgaaccccgggtaagggatcaataaaccatcatttttattgggggcattcatcttggccttggcggtcgggaaacctaaccctccaggggaacaccctttggccaagggggaatggcctaattggggggcaaaaaaagccaaaaactaaatccgtgtcgggacctccttcccaaaaaaaaaaacccgggactttgtgcttggcttaaaaaaagaaaaaaaaggggggaaaccttggtgtgagggccccc

SEQ ID NO: 83533 - protein, 146 aa, Zea mays
  misc_feature: Ceres CLONE 1569473
  misc_feature (4)..(147): Pfam Name: Actin Pfam Description: Actin
  misc_feature: SWISSPROT Homolog: EC 2.7.10.2 Non-specific protein-tyrosine kinase
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMVENFSVPAMYVAIQAGLSLIG

SEQ ID NO: 83534 - DNA, 821 bp, Zea mays
  misc_feature: Ceres CLONE 1569474
  misc_feature: Translation starting site: 188
  misc_feature (441)..(441): n is a, c, t, g, unknown, or other
  misc_feature (464)..(464): n is a, c, t, g, unknown, or other
  misc_feature (492)..(492): n is a, c, t, g, unknown, or other
ccccgcggtggcggccgctctagaactagtggatcccccgggctgcaggaattcgtctcacccctagaaaaaatcgccagggcgtcggatcggagcgagctcattctcaactcgactcaagagctctgcctcctccatcttcccttctctttctggacgttgagggcctccggggccacgctgagagatggaggcgaatccgaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacanggagatctacgacgaggtgctgncagcaggctctgcgttgcagaagctggnagtgcagccagggtcccgggtgggggatctacggagcgaactgtcctcagtggatagtggcaatgcagggcttgcaatggctatagtctagtctgtgtcccactgtacgaatactttagggtgcgggaagctggccaatactttatcgattatgccggagatccaatgtttttcttcataccgggaacagaaaaataaagagaaatactgtccccaaaactggaagttttcccaaaaaactgaaaacttttggttggctttccattttggggaacacttgaaacagaaacaaaaaagcgggaatcaatttgggggtacaaaatgtttgc

SEQ ID NO: 83535 - DNA, 897 bp, Zea mays
  misc_feature: Ceres CLONE 1569476
  misc_feature: Encodes the peptide sequence at SEQ ID NO. 83536
  misc_feature (444)..(444): n is a, c, t, g, unknown, or other
  misc_feature (445)..(445): n is a, c, t, g, unknown, or other
  misc_feature (458)..(458): n is a, c, t, g, unknown, or other
  misc_feature (484)..(484): n is a, c, t, g, unknown, or other
ctccccgcggtggcggccgctctagaactagtggatcccccgggctgcaggaattcgtctcacccctagaaaaagccacagcaccaaccccgacaccaccgttggcaaccgcaacccgcaaccagagccatgggcctcttcggcaagagcacctccaagcagaccgccaagctcaagtccctggtcaagctcgccgcggcgcgcctcgccgtcgtccgccggccgcgcctcggccgccggtccatcgcccgtagcgacgtcgggcagctcctctctatcggccatctcgaccgcgcgctcgtccgcgcggagcaggtgatcgaggaggacaacatgctggaggcgctggacgtcatcgagctctactgcaaaatcctcgtcgagcagaccgcgcagctggagaaacccaaggaatgcagcgaggagatcaaggaggcggctgcnngggctgatgttcncgtccgcgcggtgcggcaagctgccngaagcttctggacccgcgcgccatccttgcagaacagttcgggccgagaactcgccagggcggcccaaggagggcgcccacgggggtcctccacccccaccgttgggtgccggaagtttttcccggcaaaagggccaacccttaaaccaaacaaggaggtttggcaaaagaaaatccccccccaaaaaacaaatttttgttggaagtccctgggaagccccgtgggggattcccaaaaaggggcccccgacctccccgggtcacactttaaaaggcggggaaagaaaactaaaattgccccgcccaaaaattttttttcggggaaagagggttttaaaaaggggtcccctggggggggagacaaaatttttttacggggaggggaacccagacttttcacgtagacccgggaa

SEQ ID NO: 83536 - protein, 252 aa, Zea mays
  misc_feature: Ceres CLONE 1569476
  misc_feature (21)..(143): Pfam Name: DUF292 Pfam Description: Eukaryotic protein of unknown function, DUF292
  misc_feature (106)..(106): Xaa is any aa, unknown, or other
  misc_feature (110)..(110): Xaa is any aa, unknown, or other
  misc_feature (119)..(119): Xaa is any aa, unknown, or other
MGLFGKSTSKQTAKLKSLVKLAAARLAVVRRPRLGRRSIARSDVGQLLSIGHLDRALVRAEQVIEEDNMLEALDVIELYCKILVEQTAQLEKPKECSEEIKEAAAXADVXVRAVRQAAXSFWTRAPSLQNSSGRELARAAQGGRPRGSSTPTVGCRKFFPAKGPTLKPNKEVWQKKIPPQKTNFCWKSLGSPVGDSQKGAPDLPGSHFKRRGKKTKIAPPKNFFSGKEGFKKGSPGGGDKIFLRGGEPRLFT

SEQ ID NO: 83537 - DNA, 849 bp, Zea mays
  misc_feature: Ceres CLONE 1569478
  misc_feature: Encodes the peptide sequence at SEQ ID NO. 83538
  misc_feature (773)..(773): n is a, c, t, g, unknown, or other
tggagctcccgtcgattgggatttggttgataacgttttactcgcctggttgatgcatccgactgatccctagaaatagccagagggacatctgactgtgctgcctgcgtgtgtgtcttctttcttgcctctcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccacagttccaatgatacatgacaccagcagcagcagagcatccacggcgtgccactactcgccgtcgcttgtggcagaggagcagcttcacggctccaaagacaccttgaccttgaagggcgagagggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatgtacggagcttctgaatttattagcagtgaagaggatgatgatgattctatttcggagagctcttcagcatcattggccaaaccagctggaactttggatcttggcaagctgacagaggaaccacagttggatgtaccacagcctcaccgccgcagtgtggatccaaacattcgtatgatcaagtgtttattagatcccctcggttactgggagaggagatccnagaaaacgcacgcgggcacaaggctttgggataatggtgtgccgtgcagtggtgttgactccaagaagaaagacaa

SEQ ID NO: 83538 - protein, 187 aa, Zea mays
  misc_feature: Ceres CLONE 1569478
  misc_feature (163)..(163): Xaa is any aa, unknown, or other
MIHDTSSSRASTACHYSPSLVAEEQLHGSKDTLTLKGERALLELLLGMALDQHVDGRKLITQQEAEDSDFESYLREATSRVLYQPTFMYGASEFISSEEDDDDSISESSSASLAKPAGTLDLGKLTEEPQLDVPQPHRRSVDPNIRMIKCLLDPLGYWERRSXKTHAGTRLWDNGVPCSGVDSKKKD

SEQ ID NO: 83539 - DNA, 964 bp, Zea mays
  misc_feature: Ceres CLONE 1569480
  misc_feature: Encodes the peptide sequence at SEQ ID NO. 83540
ctccccgcggtggcggccgctctagaactagtggatcccccgggctgcaggaattcgtctcacccctagaaaaaacttctgcccaaccccaaccccaacccccctccatccatccaaacagctttgcctagcttattccttaccgacaaacaaaactgacacggatccgcacaggccacagctagcgcaacgaactcgcccagtccggctgctgctgcacaacggactcgatctcacgggcccgccggctcgcagccatgcagacacagtcccgcctggccatgagcggcggcggcagcagcagcagcagctcggcctcggaggacgagcacgaggcggtgatccgcgagctgacgcgggggcacgagctgacggcgcagctgcgggccgaggccctgcgcgcgctgcgcggggagggccaggccgaggccaccgcggcattcatcctgcaggaagtgtcccgcgccttcaccggctgcctctccatcatggagctcgcccgcccgcgccccgccgccgaatatggaaattggccgcgcctggccctgggcccccgaagggggccgggaacgacagccatcccaagaaagcaaacggagggacgtcctcccccgcacagggaccgggtaccagtgggaaggaagtaccggccagaaaaaggatcacttaaatcgcccgtttcccgaggggcctaccaaaaagtgggagctttccaaccgagagggccagcttgccgggccaccaagcagggtgcagcaatggcagccgacgggatactgccaccctgccccaagaacgtggttttggacttcaaagaagaaacatgcgaaagggcgcgggggggagccaccgctggggggtgggccgctgcaccctttattttgggacggccccgtcacacctttgttaacgtcccccccgcagggtgatatagccaccggccaatggcgcctctcccccctcg

SEQ ID NO: 83540 - protein, 223 aa, Zea mays
  misc_feature: Ceres CLONE 1569480
MQTQSRLAMSGGGSSSSSSASEDEHEAVIRELTRGHELTAQLRAEALRALRGEGQAEATAAFILQEVSRAFTGCLSIMELARPRPAAEYGNWPRLALGPRRGPGTTAIPRKQTEGRPPPHRDRVPVGRKYRPEKGSLKSPVSRGAYQKVGAFQPRGPACRATKQGAAMAADGILPPCPKNVVLDFKEETCERARGGATAGGWAAAPFILGRPRHTFVNVPPAG

SEQ ID NO: 83541 - DNA, 960 bp, Zea mays
  misc_feature: Ceres CLONE 1569483
  misc_feature: Encodes the peptide sequence at SEQ ID NO. 83542
  misc_feature (577)..(577): n is a, c, t, g, unknown, or other
ctccccgcggtggcggccgctctagaactagtggatcccccgggctgcaggaattcgtctcacccctagaaaaacccctccgccgccgccgtatcctccacggcgctcgctgcaaaccctagctctggcgccagcgaggaaggaggcgcccgctctccgccgtcgccgtctcagagggggcgggccaaggtggtgatcgttatgggcgccacgggcgccggcaagtcgcggctggccgtcgacctcgcggcccacttcgccggcgtcgaggtggtcagcgccgactccatgcagctctaccgcggcctcgacgtcctcaccaacaaggctcccctccacgagcagaacggtgttcctcatcatctacttagcgtgattgatccctctgtcgagttcacttgccgtgatttccgcgaccgtgccctgccgattatacaggaaatagtggaccgcggtggcgtccctgtggttgtcggcggcacaaacttctacatccaggctctcgttagtccattcctcttggatgatatggcagaagaaatgcagggctgtactctgagagatcacatagatgacngcctttaccgatgaagatgaaggcaatggggtttgaacgcttgaaggagatcgatccctatggctgcgcagaagatccctccaaacgacctttgaaaaatcaaaccctccctcgagttgttgcaaccacgggtgccctacccagcgatctgttcaaagagaggccgctaaggggaggaatttttccctgtacttggcggccctgccttgaaaaatgccccccttttgtcatggacatgagcagaattttgcctcaaaggtttttttgttttgttttgttccccggaatgaataaaaacctgcgggggattccggggctcttggtcaaaaagaaatgggggcggccttttacccccaacccaccggtggttccgggggggaaaa

SEQ ID NO: 83542 - protein, 129 aa, Zea mays
  misc_feature: Ceres CLONE 1569483
  misc_feature: SWISSPROT Homolog: EC 2.5.1.8 tRNA isopentenyltransferase
  misc_feature (126)..(126): Xaa is any aa, unknown, or other
MGATGAGKSRLAVDLAAHFAGVEVVSADSMQLYRGLDVLTNKAPLHEQNGVPHHLLSVIDPSVEFTCRDFRDRALPIIQEIVDRGGVPVVVGGTNFYIQALVSPFLLDDMAEEMQGCTLRDHIDDXLYR

SEQ ID NO: 83543 - DNA, 962 bp, Zea mays
  misc_feature: Ceres CLONE 1569484
  misc_feature: Encodes the peptide sequence at SEQ ID NO. 83544
gagctccccgcggtggcggccgctctagaatagtggatcccccgggctgcaggaattcgtctcacccctagaaaaagcacgctcgccgcctgctctcttgtctgctctgctcagctcaggcgacacggcgcgctccgtgccgcccacgaaacctcatcggcgtcatcctcatcaatccctgcctctgccgtccgagataaccatgctccacggtctctgactcacccctgcatctgccgtgtagccttcttgtacagcttggactggactagactggatcactagaggtggacatccctccattaatttaagggatttttatgtccaccgccgccgccagcgccaactaaacccgcgacgacggtcgaccatggcgtcctcgctgctctcctcccccgctaaacccaccaccaccaaaacgaccccggccccaagacccgcccgctccgcccatgtccatgtcctctccgccgcccgctgcctccgcctccgcctccgcgcggtccccgcccgagcgtcgtcgcagcatcctccgcctccgcccaccccgcggtcgcggcggccggagtacgtcccgaaccgcatcgacgaccccaactacgtgcgcattcttcgacaccacgcctgcgcgacgggggaccagtccccggggcgccaccttgacgagcgcccagaaacctcttcttcccgcgccagctgggccgcctcggcgtcgaaatcatcgaggccggggttcccgggcttcccccacggacgacctcgaaccccgggcgtccattgcccttgaaggtcggaaacccggggcccaggacccgccggggaggaagaacccgtccccgtgtccggtattttggggcctctcgcggtgaacacggagggaactccacccccggcggtggaggccgtgcccacaccggccgcggccccggatacaaccatttattcccccccaggagatttta

SEQ ID NO: 83544 - protein, 138 aa, Zea mays
  misc_feature: Ceres CLONE 1569484
  misc_feature: SWISSPROT Homolog: EC 2.3.3.13 2-isopropylmalate synthase
MASSLLSSPAKPTTTKTTPAPRPARSAHVHVLSAARCLRLRLRAVPARASSQHPPPPPTPRSRRPEYVPNRIDDPNYVRILRHHACATGDQSPGRHLDERPETSSSRASWAASASKSSRPGFPGFPHGRPRTPGVHCP

SEQ ID NO: 83545 - DNA, 1071 bp, Zea mays
  misc_feature: Ceres CLONE 1569486
  misc_feature: Encodes the peptide sequence at SEQ ID NO. 83546
  misc_feature (737)..(737): n is a, c, t, g, unknown, or other
ccgcggtggcggccgctctagaactagtggatcccccgggctgcaggaattcgtctcacccctagaaaaaagtggacgaggaagctgggccacaccctctcccgcatcgtcacgaccaagccgcgcttcgccttctcccagcccaggcctaggcccaggcccaggcccgcacaacccggtctgccttcctcacaacccgtctcgatcccgccgcagccgccggagcttccccccttcgtccccaccgccatgccgcaccacggcagccaccgcccgccggcgccgccgccggggggccccgtgttcccgcgcgcaacgtccaacggggtggccgaaccgtcccgtttcttcgggccggcggtccttcgcgggccggctccaaaaaatccttcctcaagaacttcgtgctcaagaacggggaccagccggaatacgtcccccccgaactccgtccgtttcccccggaaggcgccccttctttaaatctggtaaccctttcgcgggaacaactcccccgtccctttgttaatcccaaaaccttccgtccccgggacccttaaccgggctctaaacaccccctcgggaagaagccgcaaaggcccaatggggggtctctcggccttttcaaataaaaccccctccccggttccagttttaaaaaatgtgttatctcgggtcgccccccgcggtgtcttaaccctctcagcgccgccaggaaatgaccctgtttaaagagnaactctggtacgaccacctaacgcggccgggtcttccctcttttataacttcccccgtgcccggatgctaattataaggagagtatctaacacaaaagagtgctccgtctcgtcgagaaaataccccggggactcaaatgggggcgcccttgaggggaaaaaaaatatgagacagaggacatgcgtcccgtttaaggatgaggggcccccatatggggtgcggagacaaaacacccaacaactcagggtgcccgcgtcaggggttcaagagaagaaagccgtgtgttgccctcaccaccccaattctacattgggggcgtggcccctaacacaa

SEQ ID NO: 83546 - protein, 175 aa, Zea mays
  misc_feature: Ceres CLONE 1569486
RGGGRSRTSGSPGLQEFVSPLEKSGRGSWATPSPASSRPSRASPSPSPGLGPGPGPHNPVCLPHNPSRSRRSRRSFPPSSPPPCRTTAATARRRRRRGAPCSRAQRPTGWPNRPVSSGRRSFAGRLQKILPQELRAQERGPAGIRPPRTPSVSPGRRPFFKSGNPFAGTTPPSLC

SEQ ID NO: 83547 - DNA, 1281 bp, Zea mays
  misc_feature: Ceres CLONE 1569488
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (472)..(472): n is a, c, t, g, unknown, or other
ctctcggtgggcccgcgggccacgctcccatcanaatnnntnacntnnnnnttttttttttttttagttggagctccccgcggtggcggccgctctagaactagtggatcccccgggctgcaggattcgtctcacccctagaaaatcgtcctcctcttcgcattagcgcggccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcaccttgagtactgacggacgactgggggagaggttgagggacatgtacacccaagacgggacctgggacatgaaaggggaaatcccgccttgaataaggggaccggcaaatggnccccccggcccctacatccctccctaacgaattgctgcgagaggccggcttccctttgggttggagccccaaccctgggtgaaattacttggaagaaccccatttggggcccagggggaacccccgttggtggccccaaagatgttcgcccaaaatgtggtaaaggggacgtgggctgacattcacctccggtgtaattgggccgccctttttttgcgccggcacggtggtttcctggggggagggttgctcgggaaccaatgggggcaaagcgttcctaggaattatcatctccccatttctgcgcgcctccgtgggcacgcgcttctggccgttaattgcgctctcccgcgccgctggggaataggggcgccctgggtattccctcttccttggtgctgggtctctgcatactcggtaggctttgcgttgcgtcctatcatccctaggttggcaccacgcgctcagttctgcgtcccacgtcgtttctctccgccggccgtgagcggtcttgctttcttccgctcatttatgtggtagggttggagcgtgtggggctgtaccacgcctatggcggccttgtctcacctcgttggtgtggtgcagcactgttggcgctgggagatagtgactgtgcagtgtggggctgcgacaaaaccagtgttaatgtcgggcctgtacttgtggagacgcgtgcccagagtcgccggcgtgttgtgagatgtatgcggcgctttgttatgtcccccacacctatttgttctgtctcactctccgttgaactagcgtgggatgcttggtgtgtgttg

SEQ ID NO: 83548 - DNA, 1014 bp, Zea mays
  misc_feature: Ceres CLONE 1569493
  misc_feature (274)..(274): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (325)..(325): n is a, c, t, g, unknown, or other
  misc_feature (326)..(326): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (341)..(341): n is a, c, t, g, unknown, or other
  misc_feature (344)..(344): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (367)..(367): n is a, c, t, g, unknown, or other
  misc_feature (368)..(368): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (434)..(434): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (484)..(484): n is a, c, t, g, unknown, or other
  misc_feature (485)..(485): n is a, c, t, g, unknown, or other
  misc_feature (495)..(495): n is a, c, t, g, unknown, or other
  misc_feature (531)..(531): n is a, c, t, g, unknown, or other
  misc_feature (557)..(557): n is a, c, t, g, unknown, or other
  misc_feature (580)..(580): n is a, c, t, g, unknown, or other
  misc_feature (583)..(583): n is a, c, t, g, unknown, or other
  misc_feature (601)..(601): n is a, c, t, g, unknown, or other
  misc_feature (630)..(630): n is a, c, t, g, unknown, or other
  misc_feature (633)..(633): n is a, c, t, g, unknown, or other
  misc_feature (663)..(663): n is a, c, t, g, unknown, or other
  misc_feature (665)..(665): n is a, c, t, g, unknown, or other
  misc_feature (668)..(668): n is a, c, t, g, unknown, or other
  misc_feature (733)..(733): n is a, c, t, g, unknown, or other
  misc_feature (785)..(785): n is a, c, t, g, unknown, or other
  misc_feature (804)..(804): n is a, c, t, g, unknown, or other
  misc_feature (808)..(808): n is a, c, t, g, unknown, or other
  misc_feature (835)..(835): n is a, c, t, g, unknown, or other
ctcaccgcggtggcggccgctctagaactagtggatcccccgggctgcaggaattcgtctcacccctagaaaaatcctatcttcagtctcctcaccgcgcgctctctaccgcttgtccgtttcttcctcttccgaggtagcaacgtggtgagtgaggcagccgctgctgtgctgcactgctgctgcggatgcccaagccgaccggcggagagcacccgtccttgggcggcggagggtggaagaataaggccgggcttgcggatgccggggtgcngagtagcggggagagtgggtgtgggggtttnnnnnnnnnnnngnnnnnntnngnnnnnggggagagnggnccgggnnnggggtgggttggggnnggggtttttgttgtnnnttgtnnnnnnttttgggggtttgggtttgtggtgttttgtggttgtgtnttggnnntttggggtnnnnttttgtgtggggtgtgttgtgtttgtggggnnttgttgtttntttttgtgtgtgtggggttgtggggtgggttggggngttttttgtggttcggggttgggggnttgttgtgggtgggtgtgtttgnttngttgtgttgtgtggttgnggttgtttgtggtggtggggggttgggtnggnggttgtggtgttttgggggtgttggggggngnttntttgtgggtggtgtggggtgtttttggggtggttgtgttgggttgttttgtgggggtggtggggntgttttgtttggtggggttgttgggtgttgtggtgggggtggggtgggttgncggtggtttgtgggggggngccnggtgggtttttgttgtttttcggttgngtccgctgtgcggcgtccgctgtttgcgcctggcggtgttttgtgttgccgctttccctcccgcgggtgcgcgcggggggtgtggctgttcgttcgcgtgtgtggcgtccctgtgtttgcgcggcggtcctccgttggtggggctgtgtgtgcgtcttctcgccggtggggttgtgggg

SEQ ID NO: 83549 - DNA, 958 bp, Zea mays
  misc_feature: Ceres CLONE 1569494
  misc_feature: Encodes the peptide sequence at SEQ ID NO. 83550
ctggagctccccgcggtggcggccgctctagaactagtggatcccccgggctgcaggaattcgtctcacccctagaaaaaatcaggcatccaagaagctcaaagcaagcagatctaagttccaggcagcgtcaggacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgcccgatgaatactacaaataagacgttgttgtgactgtgaagctcatgggattctcccgttctctctagaagcacttgacgcctagcctctaccccaagggtttggggcggccaaaatagcttccacgggcaaaggttttggaaaaggatgcttaggggttcggggaccccgaaaagcttcttcttattgacctccgggaaaatttaaaagggcctgggggccgtcctccctttgggggaaaatccccacttgtttcccccccttggggccctcggaggggggggccccgttttttttggggaataaaaacggggggcctcggcccaggggggatagccttttggagaagtgcgatgggggggcgggttatcctttggaatatgcttttgcgggaccccaaaaataccacgttcggccccctttatacacccaaaaagcccccccgccaggggttaccggggttatggggg

SEQ ID NO: 83550 - protein, 63 aa, Zea mays; identical to SEQ ID NO: 28299
  misc_feature: Ceres CLONE 1569494

SEQ ID NO: 83551 - DNA, 979 bp, Zea mays
  misc_feature: Ceres CLONE 1569495
  misc_feature: Encodes the peptide sequence at SEQ ID NO. 83552
ctccccgcggtggcggccgctctagaactagtggatcccccgggctgcaggaattcgtctcacccctagaaaaaaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcaggaggtggtgtcccggatcccgctcaccacggccgatgagttcaaagctgccgtcgatgccgccaggacggccttccccggctggcggaacacgcccgtcacgacgcggcagcgcgtcatgttcaagttccaggagctcatccgggctaacatggacaagcttgcagagaacatcactacggagcaggggatgacgcctaaagatgcttggggcgacgtgtttcgcgggcctaaagtggggggagcatgcttggtggatgggaacactgcaaatgggcgaatatgtatcaaatgtttcttatggggattgacaccttcagcattcgggaacccctttggggtttgcgctgggaaatgcccatttaatttttcctgctatgattcccccttgggatgtttcccatagcaattacgggggggaatactttttgttcttaacccctccgaaaaagaccccggggctgctttaaagcttgcggaaactaaaaatggaaaccggttttccccaaaggtgggttttagaactcctttcatgggccccaatgattgtggcaaaaaaatttttgggaacatgaagaaattaaagggttgtatctttttgttggtgtcacaacccgcggggggggcgaattttttccg

SEQ ID NO: 83552 - protein, 203 aa, Zea mays
  misc_feature: Ceres CLONE 1569495
  misc_feature: SWISSPROT Homolog: EC 1.2.1.27 Methylmalonate-semialdehyde dehydrogenase (acylating)
MLRSALFRSAPGLRRSPATAHLSTAAAAAAAWLSNGPASAPSRVRLLIGGEFVESRADEHVDVTNPATQEVVSRIPLTTADEFKAAVDAARTAFPGWRNTPVTTRQRVMFKFQELIRANMDKLAENITTEQGMTPKDAWGDVFRGPKVGGACLVDGNTANGRICIKCFLWGLTPSAFGNPFGVCAGKCPFNFSCYDSPLGCFP

SEQ ID NO: 83553 - DNA, 1102 bp, Zea mays
  misc_feature: Ceres CLONE 1569498
  misc_feature: Encodes the peptide sequence at SEQ ID NO. 83554
  misc_feature (309)..(309): n is a, c, t, g, unknown, or other
  misc_feature (546)..(546): n is a, c, t, g, unknown, or other
  misc_feature (862)..(862): n is a, c, t, g, unknown, or other
  misc_feature (1007)..(1007): n is a, c, t, g, unknown, or other
ccccgcggtggcggccgctctagaactagtggatcccccgggctgcaggaattcgtctcacccctagaaaaacccgagaattgagaaagcccactcgttagtcgttgctcccaagaccgggaatccatggagccggcctatgtcgtcaccctctccttcctcttcctcttcttgctccaccatctcctcggccgccaccgccgcaggaccaatggcaagaacaagagaacgcagctgccaccgagccctcccgccatcccggtcttgggtcacctccacctcctacggaagcctatccacgcgacgctngctcgcctcgcggagcgctacggtccggtgttcttcctccggctcggttcgcggaaggcggggtgggtgtcctccgccgctttccccccccgaatgcttcaccgagaatgacgtttggttcgcggaaccggccgggggttccccacgttccctggcgggttcccctcggggcggccatccctcccaatgttgccgccaccggcccgtacttgcgcccaccccccgtccccggccgtnaggggggtatttcctttggctcccatacccgtggcgaggcgggtttggttcccccccgtcattacccccccggaggggggcccccccaaaggggcctcgataaggttatgttacaaaaattcagtgccccgccggccgggtttccccccccgcgcggcgcctgttttagaggggcgccccaccccataattaattgggaaagggtgttgttccggaaggcccctccccctgtttgtgtcgccctgtatcgggaagagttcatggggcgcggagagaacaaaaaataagttttctcgctggcccctctgttgggtgnggatgatagcccgaatgacggtgttgtttttgtgcacccacgatacaatttgtaagaaggggtcgtggcgacgcgcgctcctctctccgtagttgtacgcgtggtggccccagcccgcgtggggatgcactcgttgcgcggcggntgtgtgtggtgttctaatctcctcgccgaccgggttaccatctatttcccgcccacgccgccgtgtgttgtgacggccacctcccactcgcaacg

SEQ ID NO: 83554 - protein, 97 aa, Zea mays
  misc_feature: Ceres CLONE 1569498
  misc_feature: SWISSPROT Homolog: EC 1.14.13.89 Isoflavone 2'-hydroxylase
MEPAYVVTLSFLFLFLLHHLLGRHRRRTNGKNKRTQLPPSPPAIPVLGHLHLLRKPIHATLARLAERYGPVFFLRLGSRKAGWVSSAAFPPRMLHRE

SEQ ID NO: 83555 - DNA, 1203 bp, Zea mays
  misc_feature: Ceres CLONE 1569499
  misc_feature: Encodes the peptide sequence at SEQ ID NO. 83556
  misc_feature (45)..(45): n is a, c, t, g, unknown, or other
  misc_feature (457)..(457): n is a, c, t, g, unknown, or other
  misc_feature (1115)..(1115): n is a, c, t, g, unknown, or other
aggtgggtctaccacctccataatcccttccttctcccccccttntggcgccattgacccctggtccccacctcttaaggcaatacctcaatccggaccccccggttgccggaagccctcttcccctacaaaaaacacaatccttgcctctgaactctgatcagagatctaagaggtagccgttaagttaaccatggcttccgccaacctcgcagaggccatggagcccgggaagaagagcaacgtcaagtatgcttccgtctgtgccatcatggcctctatggcctgcttcatccttggctataacattaccaccatgagtggggcggccatcctcatcaagaaggacctcaagaccacggacgtgcaggtgggaaatcctgataggcttgatgagcctctattcccccccccaatccgggggtggggtggggggcgtttcaaccgatttgtaganacctccaccgtcctccgcgccgagggccattttagttttatgacgccatcccctaggggcgcccccagtgttggaaaggtggcggggcagggcgggccccacctaccaggctggtgtgtcttgccgggggggtgagtgccgcccatcctccgagcctttctttactccgcccgcccacaatttctgttacgggggcatcccccctttagcgtagcccacacatcccgttgcctgtgtgagtagctcacccaatgtcccagtcgacgtccgccgggtacactggcatggccatgtcctggacgcgcctggccattatattgttggcagctttccgttgccgcctgtcccgcatctattgtgggtgctggcgtttgcttcctattctcgctctatagaatacttcgtctatcatctagcacgatgtttttttcttgccccctctgcgtttgtcgcaccccagcacaacaactatgttatcacattttgtaggagttcgcacccctaactatttaatgatgtccagtgcctggcggatacatcaaacttcgtgtggccgtcattacagtgacctctactccattacgcattatttatttttccccctactacgttcacacccacttactcctgtgatggtctccctctagaccacgtaacnccccctactgctctaacgtggtggttgctctcccccctctcttacggacgtgttgtggtgcaactgactgtcgtgggcgcgcctactg

SEQ ID NO: 83556 - protein, 132 aa, Zea mays
  misc_feature: Ceres CLONE 1569499
  misc_feature (88)..(88): Xaa is any aa, unknown, or other
MASANLAEAMEPGKKSNVKYASVCAIMASMACFILGYNITTMSGAAILIKKDLKTTDVQVGNPDRLDEPLFPPPIRGWGGGRFNRFVXTSTVLRAEGHFSFMTPSPRGAPSVGKVAGQGGPHLPGWCVLPGG

SEQ ID NO: 83557 - DNA, 1004 bp, Zea mays
  misc_feature: Ceres CLONE 1569501
  misc_feature: Encodes the peptide sequence at SEQ ID NO. 83558
ctggagctccccgcggtggcggccgctctagaactagtggatcccccgggctgcaggaattcgtctcacccctagaaaaacccctcacctctcactaccaccaccactgccccggatccataccagctgcagcagcagcgcgcgcgaagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcgggcgcgagctgggcagcctcagccgcgacgagctgtggcgcaaggtgtgggggggaggccacctacgacctcgccaccgtggctcgccttcctcgccggtccttcgccttcacaatcttccgtctacataatgtccagggcccaggcccggggtacctcatccgacttccccatggctacaagccggggccaacgaagctcaaaggggggcccaaggggggagtttcctcggacccttgggcccgcaaagtcccgggaatgtttctaacaaaaggaaagccctgggcgtttccaagttccgccgtttggctgggccaaaattccggggatttccggggaaaaatgtccttaattgcccggccctggggtgtttcaaaccccaaggccaggtggggcccaaattaaagggaggggcccccctaagagtcccccgggccttgttccggcgccctggaaaacttgtccaaaaaaggcccgtcccgccaaaagattgggcgcgcttgggggaaatgagtcctcttaaccgaggccccccggggccggtggtgtgaacccataaaaggggggaagacttgggtccaaggggggg

SEQ ID NO: 83558 - protein, 117 aa, Zea mays
  misc_feature: Ceres CLONE 1569501
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGRELGSLSRDELWRKVWGGGHLRPRHRGSPSSPVLRLHNLPST

SEQ ID NO: 83559 - DNA, 882 bp, Zea mays
  misc_feature: Ceres CLONE 1569504
  misc_feature: Translation starting site: 215
ggagctcaccgcggtggcggccgctctagaactagtggatcccccgggctgcaggaattcgtctcacccctagaaaaaactcctccctcccctcctctgctttccccccatttcgcgtctcggggtttggaccagccacccggcggaggcggccgggcagactgggccgagcgaccggagcgccgccgccatcggcaaagccacgggacggcccatggagtcgcgagcgctcctgcacgcccggcccgccgccctccctcaccgcgccggcctgcgcctccatctcccgctcctgcgcccgcgggcagtctcccgctcccactccgccaagcccgcgctccagtccccgctcctcgcgtcgaggggccccttccttcaacggcacgatgcggttctgggcaacgggttcgtgaaacggagagcggccagcgctggcggtgatgtgtccttccgcgcccaggcggcggcctcggcggcggtgccggcgccgcagccggaggagtccacaaaatagctccttggcatcgacgtgaagacgctcaagaagatcgtgccgttggggctcatgttcttctgcatcctctttcactacaccatcctgcgggacaccaaggacgtgctggtggtcactgccaaggggagcagcgccgagatcatcccctttctcaagacctggggttaacctgcccatggccatcgggtttctgctcctgtacaccaagctttcaacggtctctcccgggatgcgctcttctacacggcatcttcccgttcattcgctttctcggcgccttcgctttggggctctacccggtcagggacgtcttccatcctacggcgctcggggacaaatttctggcccggccgggcccgagcttcttg

SEQ ID NO: 83560 - DNA, 975 bp, Zea mays
  misc_feature: Ceres CLONE 1569507
  misc_feature: Encodes the peptide sequence at SEQ ID NO. 83561
ggagctccccgcggtggcggccgctctagaactagtggatcccccgggctgcaggaattcgtctcacccctagaaaaactccccagtcaaggcatatccattccatggatctcgcgtccctgctcctctcccagctgctgctgcttccggtggtaacggttgtctccggcgagaccgccgcgcacccgggctacgcgcacgctgaggaggcatgcagcggtatgctagaggcagaggcggagaaagcaacggtgctggtgcctgcgccggagcggcgcgaagagttcgacggcgggcggatcgtggacatcagccactactaccgcgaggacatgccggagtgggagtcatcagagggctccggcgagttcctgcagctggcgcggtccatgcgcaacggctccgacatcgctaacttctcggagctccggctcactgcgcactccggcacccacgtcgacgcgccgggacacgtcttcgagcactactacgacaccgggctcgacgtcgacaccctcgacctcgctgtcctcaacggaccagcgctgtttggtgacgttccccgagataagaacatcacagctgatgtttatggcatcccctaacatccctaaaggggttcgacgtgtactctttcggaccctaaatacagacaggtatggttttaggctggtctccgcagcgtccccttatatttcgcccctaaaaggttattcctctgtcctttacaaaaactccaaaagattctgccctctaaaattctccggctccagcaaggtcctctaaattccgccccctaagctacagggtgtacagattcccattttccaatttccttttacattttccttggggttcccccccattgacccgccataatgaaacccaaaaattggttttttttaatttggaaaaaaaaaattccaaatggcgaaatttaaataccctgcgcttgttttgttgtgggggaattgg

SEQ ID NO: 83561 - protein, 166 aa, Zea mays
  misc_feature: Ceres CLONE 1569507
MDLASLLLSQLLLLPVVTVVSGETAAHPGYAHAEEACSGMLEAEAEKATVLVPAPERREEFDGGRIVDISHYYREDMPEWESSEGSGEFLQLARSMRNGSDIANFSELRLTAHSGTHVDAPGHVFEHYYDTGLDVDTLDLAVLNGPALFGDVPRDKNITADVYGIP

SEQ ID NO: 83562 - DNA, 891 bp, Zea mays
  misc_feature: Ceres CLONE 1569510
  misc_feature: Encodes the peptide sequence at SEQ ID NO. 83563
ctccccgcggtggcggccgctctagaactagtggatcccccgggctgcaggaattcgtctcacccctagaaaaactgactgcctgcctccactcccctcccttcccttcccgtctcttcttcccccttccacttcttggccgagcccctcttggtgttggcatcctgctcgatcgaagaatgctggatcaggcatattggaggttgcagtaaaggcggtaggtgcttttcttcttccccgttggtggttagagggactggggagaactacaacagattggaggctgcaagttctcgggaggagccgggcttctcttgcggcggcaaacatgaggaagctcttcttcgtctacctcgtcctcctgctggccgctgcagtagttcacggtgaagatggtgcgtacattggcgtgaacattggcacggccatgtcgtcggtcccggcgccgacgcagatcaccacgctgctccgctcgcagaacatccgccacgtccgcctctacgacgccgaccccgccatgctagcggcgctctccaacaccggcatccgcgtcatcgtgtccgtgcctaacgagcagctgctggccatcggcaactccaacgcgacggcggccaactgggtggcgcgcaccgtgggcgcgcacttccccgccggtcacatcacggccatcgccgtgggctccgaggtgctctccgcgcaacccaacgcggcgccgctgctcatggccggcattgcctaccttcataacgcccctggtggcccccggcgctggaccggtacatcaaagattccgaccccgccctcgtcggtcattaatcctcaaatcccttcccgccgtcggagggctttcttcaacaggtccctggaaaaccgggcttggggcccaatccc

SEQ ID NO: 83563 - protein, 187 aa, Zea mays
  misc_feature: Ceres CLONE 1569510
  misc_feature: SWISSPROT Homolog: EC 3.2.1.39 Glucan endo-1,3-beta-D-glucosidase
MRKLFFVYLVLLLAAAVVHGEDGAYIGVNIGTAMSSVPAPTQITTLLRSQNIRHVRLYDADPAMLAALSNTGIRVIVSVPNEQLLAIGNSNATAANWVARTVGAHFPAGHITAIAVGSEVLSAQPNAAPLLMAGIAYLHNAPGGPRRWTGTSKIPTPPSSVINPQIPSRRRRAFFNRSLENRAWGPI

SEQ ID NO: 83564 - DNA, 963 bp, Zea mays
  misc_feature: Ceres CLONE 1569511
  misc_feature: Translation starting site: 203
  misc_feature: SWISSPROT Homolog: EC 2.7.11.1 Non-specific serine/threonine protein kinase
ccccgcggtggcggccgctctagaactagtggatcccccgggctgcaggaattcgtctcacccctagaaaaagacccaacccgtttgtgtcgtaggcggtttgcactagcgtttccgtgaggcgggcgaaggcgtccgtgaccgaccgaccgaccgaccggagcttcatgcgccaggggcggcggcttcaccccgtcgtttgatgggcaacgcatgcagcggcgcccttagatccaagtacctgcacagcttcaagcacgccgcgtcgcagcgccacgactccgagtacagcgccagcgccagcgccgacgactcgcccaggaagcccacaccgcccgccaccacggacgcccacgcgccggcgccgcccgccgccatgaggcgcggcgcggctggcgcgacgccggacctcgggtccgtgctcggccacccaacccccaacctccgcgacctctacgcgctcggcaggaagctcgggcaggggcagttcggcaccacctacctctgcaccgagctcgccacgggggatcgactacgcctgcaagtccatctccaagcgcaagctcatcaccaaagatgacgtcgacgacgtgcgccgcgagatccagatcatgcaccacctcttcggccacaagaacgtcgtcgctatcaagggcgcgtacgaggaccaggtctacgtccacctcgtcatgtagctctgtggcgggggcgagctcttcgacccgatcatacagcgcggacactacgcgagcgcaagccgccgcgctcacaagatccatcgccggggtctcgaagcctgccattcccccggggcatggcaccgggacttaaagccgaaaaattcttgtcgccaaaagggacaatgccccccgcccaaggcatcaatttcggaacccctggcttttcaagccgggccaatttttcccatggtttgggggcccatttatgggcccccaaattctt

SEQ ID NO: 83565 - DNA, 1039 bp, Zea mays
  misc_feature: Ceres CLONE 1569512
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (115)..(115): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (372)..(372): n is a, c, t, g, unknown, or other
  misc_feature (979)..(979): n is a, c, t, g, unknown, or other
nnnnntttttnnnnnnnnnnnnnnnnnnnnnnnnnnnnnnnggggnnnnnnnnnnnnnnnnnccnnnnnnnannngcnnnnnnnnnnnnnnnnnnnnnnnnnnnnnnnnngcttntnnnttttaaatgctggtgctccacctcgggtggcgggccgctctagaactagtggatcccccgggctgcaggaattcgtctcacccctagaaaaacttttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatngcccgtctcctcccagcaccagcatgagacacaatcacatgacagtggttcctcgaaatctcgagaaaagaccgagacgcgatatgggcatgataggagcgtgacgggatcgtggcccagaaaggggaaggaacgagacagggataaagatcccggaaaaaaatggacagaaacagaaattcccaatccccccccccagggaccctttccaaaaggcccacccaaaaaaaaggaaaaacaccccgggaacccttcccaaaaaaaaacccgggaacccctccccccccttttaatgggttccttttaaaccccccccccccggggggaaaagggattcggggggaaattccccgaagaaagggggaaaaaaaaaaaatatctcctgggacaaaaaaaaaaaaaggggggcaccaccccgggagggggggagttttgtgtttcccccccccttctccccccctctttttaaaaaaaaaaaaaaacccgggggaggaccccccggttgaccccccccccaaaaaacaaaaaaaaaaatatgcggcgggttaacaccccccccctcccctacttttttttttaaaaaaataccccccacaacccccccccnagaagaagggggtgtttttttttattaaaaaaaaaaaaaaaacacccccctcctccaaat

SEQ ID NO: 83566 - DNA, 982 bp, Zea mays
  misc_feature: Ceres CLONE 1569514
  misc_feature: Translation starting site: 320
  misc_feature (399)..(399): n is a, c, t, g, unknown, or other
ccccgcggtggcggccgctctagaactagtggatcccccgggctgcaggaattcgtctcacccctagaaaaaacacacaaaccgccgccgccgctaccttcaccactgcggactgcaccagctgcccgccgactactccgtttctcttcctagtacattgccgcgtcgaaggcgaggtcctcagcagcgccggcggactccgctcgcacgccatactcagcctactccgtcttcccctgtctagcagacaccctcttcccctctccactcccaatcttatcgtcgcctccctcgacgtcgctgctgcctccactttcacatggcgcttcacgccccggtccctcgtctgaaggactcgctgaaagcggagtctggcgcgaaggtgcaccaccccacatnccagcggccaaggctgtcgctgacatcatacgcactacattggggtccagatccatgctgaaaatgcttctggatgctaatggaagtattgggggttactaatgatgggaaatgcctttttaagggaaaataacatggcacaccctgctgccaagtctttgatcgaactaagtcttaccccggatgaaaaaattgggggatggccccacactctggccttgtttctagccgggaaaatgcctccttgttgccaagggtttttcttccacaaaaacatcccctccaactgtttttttgccaaggatttcccaaaacctctggaaaaagcctttggcgggcctgaaaaaaaatccaaaggggcgtttaatataaaataaccggggggaaattttagccccttgagaaaaaccccctttggaaaaaaatcccggggccggtgtgggggcccttttgtgacccccttgtttgtggcccccacacaccggggggttccctgggcgggggtggcgggagtgtgtttccaaaaaattttttttttaaaacccccccggggcccttgggaaaatctccccccccaaagaat

SEQ ID NO: 83567 - DNA, 873 bp, Zea mays
  misc_feature: Ceres CLONE 1569516
  misc_feature: Translation starting site: 135
  misc_feature: SWISSPROT Homolog: EC 3.2.1.4 Cellulase
  misc_feature (603)..(603): n is a, c, t, g, unknown, or other
  misc_feature (694)..(694): n is a, c, t, g, unknown, or other
  misc_feature (816)..(816): n is a, c, t, g, unknown, or other
ctccccgcggtggcggccgctctagaactagtggatcccccgggctgcaggaattcgtctcacccctagaaaaaaaccagagaccccctgagcagtcactacggctcgcatcactcactcactggtgcactgccatggccatgaacgtgattgcactacttggcctcttggcacttgcatcagtggtgaggacggcttccggcgctggcgggcatgactacgcctcggcattgaagaagaccatcctctacttcgaggcgcagcggtccggcgtgctcccgcccaaccagaggatcacctggagagagaactccggcctcttcgatggaaaggccaacggagtatgcacaacgcgtctctcgttgcattaattagcaagcaagcattgtgaccatggcagctgggttcgtcgctgtgctgaacacgatttttgttttgattcttttatgttttgtctcgccggacacaggtggacctcgtcggagggtactacgacgcaggcgacaacgtgaagttcgggctgcccatggcgttcacggtgaccatgatgtcgtggggcatcctggagtacggcaggcagatggcggcggcccgcgagctgcncaacgcatggacgccgtcaagtggggcaccgactacttcatcaaggcgcacccgggagccgaggtgctgtacggcgaagtgggcgacggcnaacacgaacacggctgctggcagcggccccgaggacatgtcacgaaccgccaagcgttccccattgaccccaatacccccgggtcgaactcccctgagaagacgccccgggcatggccgccngcttccctcgtttcccgaacaagttatcgggggtaaaccaaactgctcctttaaaaa

SEQ ID NO: 83568 - DNA, 898 bp, Zea mays
  misc_feature: Ceres CLONE 1569520
  misc_feature (331)..(331): n is a, c, t, g, unknown, or other
ctccccgcggtggcggccgctctagaactagtggatcccccgggctgcaggaattcgtctcacccctagaaaaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaagcaanggaggggagaagatgtagttcacccactaaagtttctctgggagatctttacaatggcacctcaaaaaactctctctttcgcgcaatgtcatctgctccaagtgcaaggcagggctccaattctgggcctcaatgaagtgccctggtgccagggctcaggcatgaaaatccctattcctcagcctgggcccttcctgattacccaaaatcccccccccttgcattattgcaaggggccgggaaaaacctttttgaaaaggccccttcccggggggcaggggaaaaagcctttacaaaaaaaaaggtttttgggtttttttgaaaaggggtcccccccccccaaaaacccccctcccgggaaaaaataaaaaaccccctatatctcccccgggaaaatttttttcccccccccccaagaaagccccccctttttaaaagaaggggggatttttttttatgaaacaccttgttttaataaaaaaacaaggggggggcacattttttttcccacacgggggggaagaggggggttcttttataaaaaccggggggggtttgtttcttccg

SEQ ID NO: 83569 - DNA, 844 bp, Zea mays
  misc_feature: Ceres CLONE 1569522
  misc_feature (743)..(743): n is a, c, t, g, unknown, or other
ctccccgcggtggcggccgctctagaactagtggatcccccgggctgcaggaattcgtctcacccctagaaaaccccctagaaaaaaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccatgtgagtattgcgtgaatcttgcaagttttggttccgtcgcggtttctggttttcttgctgattggttgcctgaatctttgccaagaccttgaattcgagagatgtaggaaagtttagaacacgagtcagggtacaagcacccgagtatttgcaagatcccgcacgggttcaaagctagaattgtttccacctatttgatccctgtataaataccgttttcgtaatttttttccctccggttgctggaatccttcccccatttaatttggggggggccaaaaaaaaaccctccctttttgcctcctggatttgaacacctgtcccttttgtggaaaaaaaaaacaatttttagttggccccttccaaaaccaaaaaaaaaaagggggggaattttttttttttcaaaaatttttttttaaaaaaaaaaaaactggttttcccgggggaacccccctgttttctaaaaaaaaaaggggggaaaaaaaatctttttttcaaaacnccgcaaaataggggttccttgggtctaaaaaggggggcccccccccggggggggggcacacccccccccccaccggggataatataggtggggtgtggttt

SEQ ID NO: 83570 - DNA, 1067 bp, Zea mays
  misc_feature: Ceres CLONE 1569523
  misc_feature (1067)..(1067): n is a, c, t, g, unknown, or other
ctccccgcggtggcggccgctctagaactagtggatcccccgggctgcaggaattcgtctcacccctagaaaagctcgtgccgttgcgctgcggcaaagcctcccccccacacctctctcctccatccgccgcccccgcgggaccgaaaccctagctagggttctgcccgccgccgccgccgccgccttcgatcctgacgcggccaggcttcccgcaacaccgccatggacacggggcgcaagcggaccgcaccggagggcgccaacggcgcggggcgacccccaagcgcgcgagagaatcggagacaactggtgtaggaacaaaacccagccgtgcaccaattttttcagggtctaatctagcttaaattgaaacagtcatccggtaacctcccccaccctattatgccccttctttttttaaattaaaatttgtgatgggagataaatgctgggccttaaggtttacaaagggggtggggtctaaattctcggccacgggatggttttttttccaatccttgggtataacaaccccccacggggggtgagaaatttggggagcccgcccgctttgtttttttccccggggaaaactgggggggccaacgggcgaaaacgctccggggggggtccacccccggggggaaacaccccggtgtcaccatcagggggaaaccgccgcggggcgtggaattgcgcatgcggaaaatatgttgcgagcggtggcgaataaatgggtggttctgcgagagaaaacaataaatttggccgcccgtgaagtggggcaaaatttcgggttgttcacctccccctggggaaacccgggtggcggtgtgggtgggggttctgggggaactccctgttcgggcgcgtgggcgggcgggggacttcctttgctggggcgtgaaattgcggcacatctcactttgccctggtgtgttcgcctcttcacatccttctcgaccgtgagtggcatagaatcactttactccctcaattgcgtctgtggggtattgtaccccccggtcttgcataagtgagtaccctggtcgcggttcttcttn

SEQ ID NO: 83571 - DNA, 943 bp, Zea mays
  misc_feature: Ceres CLONE 1569525
  misc_feature: Translation starting site: 217
  misc_feature (386)..(386): n is a, c, t, g, unknown, or other
  misc_feature (815)..(815): n is a, c, t, g, unknown, or other
  misc_feature (826)..(826): n is a, c, t, g, unknown, or other
ctccccgcggtggcggccgctctagaactagtggatcccccgggctgcaggaattcgtctcaccccctagaaaaaagccgcttcccccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcgggacgtcncgcagaagctggagcagctcgagatgcccatggggatgggcggcctgggcggcgccggggctaccgctgatgacgggttcgtgtcgcacctcgccacggacaccgtgcactacattccccccgaactgtcgtcctgggtccaaaagcatgctgttcaaagttaaaggggccccaagggccgctcccggccgggaaagcccggccccaaggggtcggggtccaaattcgtccaccggtcacaaaggggcgcccccccccccgggggctgggcttaattcaaatcccccccccgcccgtggaaccctccccggaattacctaacccctttgaaagcccatccccccccccggggggggggggcccgttgggccaacccctctccgtggaattgggggcgggagaacccaaaacgaataaagaattgggggngggaaaaaacntttctcccctccttcccccggggtaatacaagggggggggggcacacaagagacccccggggccaaaaggcgccccccgggaaacatatttctcggggggacaatgggcccccgggg

SEQ ID NO: 83572 - DNA, 1000 bp, Zea mays
  misc_feature: Ceres CLONE 1569526
  misc_feature (395)..(395): n is a, c, t, g, unknown, or other
  misc_feature (404)..(404): n is a, c, t, g, unknown, or other
  misc_feature (405)..(405): n is a, c, t, g, unknown, or other
  misc_feature (647)..(647): n is a, c, t, g, unknown, or other
ctggagctccccgcggtggcggccgctctagaactagtggatcccccgggctgcaggaattcgtctcacccctagaaaaaatggagccgagctacatcacgtccgccctccccctctctctccctctccctctctcgacgacacaccaggccaccacgcacatgctttgtcccatggatgccgaccacctcatggtgttcaagaccatgctcgccgtcaggtggtagtcccggcgagcgagatctccccactccaggctctctcccatcgctcgctgccgcctcatgttgtttgcggccgtgctcgccaaccgcggcacggaggcgtcgatccgaccgggagcccttcgcaatggacaaagccttcctcctctcccggctatgagggcatcgtcnccccccccnnctacgtgagcacgtggcagaccctgctgccccccatccttcttcatcttcactaagtgaggaactctctcgacccccttccccaacccttcttgtctttccgagttccgatggcttggagaacacggtggtttggtcatggcttctagaaggtgggggtttttgcatttaaaaaggaaaaaatttggagcatattccaaaacctttgtttgcagatgggggaagaaggtaggagttacctcnccagtagggagggagtggccaggaaaagctcgggggccaccccgtctttcatcgatcgggaaccctctttcccccctagcgaggctattcccaggtttcgaaaaaaaaaattaaaaaaacttcgaaaggcttttatgggggttaaaatttgctaaccttcccccccccttaaaaccccaccccgattctgggagccttcccccccaaaaaacaaaaaaacccggaaaccttttaaaaaacctgaaaaggcgttttgtaacccccccccacgttgatactccaaccaattctgtatacgggacaagagaaacacagtgggacccccctttgaaaaggaccccgcttcaaggggg

SEQ ID NO: 83573 - DNA, 1085 bp, Zea mays
  misc_feature: Ceres CLONE 1569527
  misc_feature: Translation starting site: 326
  misc_feature (409)..(409): n is a, c, t, g, unknown, or other
  misc_feature (929)..(929): n is a, c, t, g, unknown, or other
ggagctcaccgcggtggcggccgctctagaactagtggatcccccgggctgcaggaattcgtctcacccctagaaaaatccagacacacacaacacagcagagagattactacgatccaacagttctagagcaagagagaggaagacacaccgcagagttagcaggctaataacttgcaggagcagcggggatggcggcgacgcgtcgcctctcttgccttctcctcgccgtgcttctggcaggagtggccgctgccaccgccttcgacgaagcggctgctgccggcttcggggcttggccacggcgcgcgtttcgcgcgcaagcatggacgagctgccgctgagatgccccagccggagccacaacctaaaactaagccgggagccccatatgcagcctctcccccanccagaacctaaaccgaaacctatgccacatccagagccaaagccctgaacctcaaccaaaggcccaacccctgaaacctccaacaaatgcccaaggccccctaccaaaaatcccaaaccaggagcccattggccttacaccggaaagcccagaacccctaaggccccggaaccctaaggccctagagccctaatagccccgaaaccggaaaaattgagacgcccaaaagcccaaaaaaccctggaattccaataacacccagaacgccaataggcccgagggatctacacaaaacctgtggaaggcccaaagaaggcccaagagagccccccgtgaacccaataaagcccgggaaggcccttaaaaacccaagaaatccccaatatccccttgtagccccaagatgcgcgagtagcccccgcatacccaaaaatccctggagcgccttatggcccatgaggcccttaataccctgagtacccgtagaaaccggagagcccatagacccgagagtccgccnctccttttatcccagagaattctctaagctccgtgagccgcaaagcccggggaccctaaagcgccacgggccacataccaatgtgcgtgtagtccttaagcccgggaaaccaaaagcctggagtctagaggcgcgggtccccccaccaaatacggg

SEQ ID NO: 83574 - DNA, 879 bp, Zea mays
  misc_feature: Ceres CLONE 1569528
  misc_feature: Encodes the peptide sequence at SEQ ID NO. 83575
  misc_feature (635)..(635): n is a, c, t, g, unknown, or other
ctccccgcggtggcggccgctctagaactagtggatcccccgggctgcaggaattcgtctcacccctagaaaaaaactgtgattggcggtagcccatcgacgacacgagatatcagctgcctcagatctcgtcggtgggtgccaatcacattcttcgacagtttgtcgatcgtcgtcaagacatttcaacagctagctagcctgcctataaaatgcgcgcgcacgaacctctgtagcacaaatggacctgtgagaaagcaagaaataaagatatatacacacatggctactacgggcacaacatctatgccagcacctgtgtttcaccccacggtgtggggggactacttcatcaaatttgtcccagagccattgcaggtttcagatgaaacgatggcagagagaatcaggcatttgagagaggaggtaagtggtatgttccaggcttgcaagaacgttgtggacaaaacgaacctagtagacgtggtacaacgtcttggaatagatcaccatttcgaggacagatagccactgccctagccagcatccacagcgctggatttattcatagctcaagcctacacgaagctgcccttcggtttcgcttgctttagcagcaggggtttttgggtccntgcagatgaaactggtcaaagtcatcaagaacgaagacggggagctttttcgatggtttaacccatgaccccaaagggcttgttgaggctattcaacgcagctcaccttgttacctcccgacaagggggaaaaccacccttgaaaatagccctcccatttgcaagggaacatcctgaaaccgcctaaaaaaagtagtccccaagcccccctaaactaacaagtccggccgggcccttgggttcc

SEQ ID NO: 83575 - protein, 81 aa, Zea mays
  misc_feature: Ceres CLONE 1569528
  misc_feature: SWISSPROT Homolog: EC 4.2.3.9 Aristolochene synthase
MATTGTTSMPAPVFHPTVWGDYFIKFVPEPLQVSDETMAERIRHLREEVSGMFQACKNVVDKTNLVDVVQRLGIDHHFEDR

SEQ ID NO: 83576 - DNA, 1154 bp, Zea mays
  misc_feature: Ceres CLONE 1569531
  misc_feature: Encodes the peptide sequence at SEQ ID NO. 83577
  misc_feature (28)..(28): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (70)..(70): n is a, c, t, g, unknown, or other
  misc_feature (71)..(71): n is a, c, t, g, unknown, or other
  misc_feature (1154)..(1154): n is a, c, t, g, unknown, or other
acggggcgggagggtgtagaaccttttntcctttcttttttccnncgcnnnnnnnnnntnnnnnttggcnnctggggctccacgcggtggcggccgctctagaactagtggatcccccggactgcaggaattcgtctcacccctagaaaaaaagaacagcctcaggttactcgcagaaaagatttattagctcgctgcgggggtcgaaccgaggctcctagctgatcgcgcgcgcacagggcgagcggacaagaaagcttgctttgtgctcaccggcggcacggaccccctgcgatggaagccgtcggcgtcactcctgcccccgtggcggcgccggagaagaagaagctgcttgacctcaaggaccccttccccgccgccgcgaacggcggcgccaaggcgtccccggcggcgaagtgggcgatgaagaagaagctggtgggcggcgacgccggctacgtgctcgaggacttcccccacctcacggattacatgccccagctcccgacatacccgaatcctctccaagacaacccggcgtattcagtcgtcaagcagtatttcgtcaacccagacgacaccctcccgcagaaaattgttgttcataagaacaggggccagggggcaccccactttccggccgtgcccggggccacgggcagcggggtgttacttcccacgtccgattgaaagtgaaacccccccccctttgtccaccctgttgggaagggcctcccgccccccggggatttggaaaaaccgggtccattccccgccgaagactctggtttttggccgggcttttgtttatgaaatattgtatattgggggttccctcccaaacgttcgcttcggggctatagaagggggggggaataccaaaggggggtttcctatttcccaaaaaaatacctgttttgccgttttcaacccccaaaagtccggtggaaaccacatccccatataaaaaaagcgcgggaactgggccctcctgaaaccctccaaaaatgaggggcgttgaaccctgcccaaaatacctgatatgtgtcctccaagagacgggggctatttaacaggggccatatttatcgggagggcacaggccccccgaagaggcccctcctgttttttgttaagaaaacccggaacccccn

SEQ ID NO: 83577 - protein, 131 aa, Zea mays
  misc_feature: Ceres CLONE 1569531
MEAVGVTPAPVAAPEKKKLLDLKDPFPAAANGGAKASPAAKWAMKKKLVGGDAGYVLEDFPHLTDYMPQLPTYPNPLQDNPAYSVVKQYFVNPDDTLPQKIVVHKNRGQGAPHFPAVPGATGSGVLLPTSD

SEQ ID NO: 83578 - DNA, 1231 bp, Zea mays
  misc_feature: Ceres CLONE 1569532
  misc_feature: SWISSPROT Homolog: EC 1.4.1.2 Glutamate dehydrogenase
  misc_feature (46)..(46): n is a, c, t, g, unknown, or other
  misc_feature (47)..(47): n is a, c, t, g, unknown, or other
  misc_feature (53)..(53): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (1210)..(1210): n is a, c, t, g, unknown, or other
tttcttacttttattttcgtttgtttccaaacacgcaacgaagagnnggtgtnggatttacnnnncaaatggagttccccgcggtggcggccgctctagaatagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaacgggcgatggcccggctatcggcatcgatctcggcacgacgtactcttgcgtcggcgtgtggcagcacgaccgcgtcgagatcattgccaacaaccagggtaaccgcaccacgccctcgtacgtcgccttcaccgactccgagcgcctcatcggagatgcgggccaaaaccagggcgccctgaacccccatcaaccccggtctttgattggcaagcggctcatcgcaaaaaccctcagagaatccctctggtccaaaggggattccaaatcggggccccctcaaagggcttttttgtgggcctgggggaaaaaccccaaagatttgtttggtccccccccaaaggggtgaaggaagaaaacaatttttggccaccctgtaaaaaaatactcccccccaacgaaggtccctttaccaggaaagtgccctgaaaaattgcctctaaaaatatttacccccgggggcggccccccaataacaaaaaaaaggccgtcgtggactcaccaaaatccccccggtgcagcagagttttagaatgggagaccctctccaatagaggagacgggggcctccccaacaaaaattacgctccggcggggggtgaaattaagtctaggaggcctcttaaaatctcggcggtgcgcgggatttgtgctgtgaaagaaacaccataaacaggtggtgcgcgactctttattggcccccactgagagcgcttctgacaacatagtagagtcgcctcacaaggtcgctcgctgagaacaaaaataaatacccaccccccatctttgaaattattggagaaggaggggagcaccccacgtaagttgcgcccctctctcgctccgcgggtggggaagaaaaatcccttccagggtttagtggccacctcctgcgtgtgaacacaccccctctgtgggggggagttatatttttaaaaacgacggtggacgctcctcttcccctccnttttattatgtaaaagagcaa

SEQ ID NO: 83579 - DNA, 977 bp, Zea mays
  misc_feature: Ceres CLONE 1569533
  misc_feature: Encodes the peptide sequence at SEQ ID NO. 83580
  misc_feature (400)..(400): n is a, c, t, g, unknown, or other
  misc_feature (410)..(410): n is a, c, t, g, unknown, or other
tccccgcggtggcggccgctctagaactagtggatcccccgggctgcaggaattcgtctcacccctagaaaaaagcagtcagccagccagccagccatggagacggcctccttcctctcagtggcgctggccctggcggccctcgtccccgtctcgctgctccttgtgaaccggctcctctacggcaaactgcccccggggccgcggcggcgtcccgtggtgggtaacctgttcgacgtgcagcccgtgcggtgccggtgctaccaggagtgggcgcgccggtacgggcccatcatgacggtgtggctgggcacgtcgcccacggtggtggtgtccacgtcggagctgggcaagggagtgctcaagacccacgaccagcagctcgccgaccgctgccggnaccgctccancgagagcttcagccgaagccgcccagacctcatctggggcgactacggcccccactacatcaaggtgcgcaagctctgcaacttcgagcttctcacgcaaccgccgcctcaaggggctcaaggcccatccgcgggaggacaagggccacccccctggggccaagttccctctaaaaaaacccctccccccccccctgggaatgcaagggaaaaacctttgggtttaaaaaaaaccccccccccccaaggggggcctttaaaaaaaaaaaccgggggggtgggctttgggaaaaagggtttctgggaaacccgcccgcggaaaatttggaaaaaaaaaggggcccgaattttaagggggattctcccaaaaggggggtaaaaaaaagggggggggccccccttcccctgggaagaaaaaaaacccgggggtgttacccgggggggggcccccctgaaaaaaaaaagggccttttataaacccccccgggagagaagggcccccccccccccccccccggaaataattatgggggagagaccccccggggcgctctttaataaaggggg

SEQ ID NO: 83580 - protein, 230 aa, Zea mays
  misc_feature: Ceres CLONE 1569533
  misc_feature: SWISSPROT Homolog: EC 1.14.13.68 4-hydroxyphenylacetaldehyde oxime monooxygenase
  misc_feature (102)..(102): Xaa is any aa, unknown, or other
  misc_feature (105)..(105): Xaa is any aa, unknown, or other
METASFLSVALALAALVPVSLLLVNRLLYGKLPPGPRRRPVVGNLFDVQPVRCRCYQEWARRYGPIMTVWLGTSPTVVVSTSELGKGVLKTHDQQLADRCRXRSXESFSRSRPDLIWGDYGPHYIKVRKLCNFELLTQPPPQGAQGPSAGGQGPPPWGQVPSKKTPPPPPGNAREKPLGLKKTPPPQGGPLKKKTGGVGFGKKGFWETRPRKIWKKKGARILRGILPKGG

SEQ ID NO: 83581 - DNA, 990 bp, Zea mays
  misc_feature: Ceres CLONE 1569534
  misc_feature (231)..(231): n is a, c, t, g, unknown, or other
  misc_feature (355)..(355): n is a, c, t, g, unknown, or other
  misc_feature (942)..(942): n is a, c, t, g, unknown, or other
ctggaactggtggatcccccgggctgcaggaattcgtctcacccctagaaaaaagccactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctagtnaccagcggcggcgtccgtgtctgcgccgccgttgggggcaatggcgcctactgtgtgggcgggctgagccactcgtctttccccaaggggctccccccccggaggggggaggggggggttactnttctcagggacctatttcccccccggggggggccctcttttcggggattcttttcccgcccgcttcaggtatattttggatgggcaccccaatgggttgtttccccgggcaaccacaccttctttccaccagcaacaaacctccctccttcgtgcaactacacgggaattttgcacgccctttactcctccgaaagggaaggccgggtccaatatcttgcccctgccctgtgttattcggcgaatttatgttcccttttaagtgagtcatcccctgcccccccccccatattttgtcgtcgcacacgcacctcctctcccccgtggtccaaggcatgcactgtccggtacccagagacgactgtagatacgtatgtcagcagaaccgcacttttcgtggcaagtaacacgacaccaaccgttctagatgccgggatacttccgctcacgttatttgcaccgccgctttcagatttatcaccatgtggacaccctagccgtcgtccatatatatatacacgattgtggctcatgactctcaccctcgactcctgcctcctctccctccccttgcgcagctgggggggnctgcccccggccggtgggggacccgcttgaggcctcgacgacaacaac

SEQ ID NO: 83582 - DNA, 929 bp, Zea mays
  misc_feature: Ceres CLONE 1569536
  misc_feature: Encodes the peptide sequence at SEQ ID NO. 83583
cccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacgggggagctcgccgcgcggtggcgggaggtccacggcagcaacaactgggagggtctgctggaccccatcgacagcgtgctcctccaggagctcatccgctacggcgagttcgcccaggccacctacgacagcttcgactacgaccgctttctccccctactgcggcagctgcaagtacccggcgaagaccttccttcacgacgtcgggctcggcggcatccggctcgaagtcacccgctacctctacgcacctgcaacgaactcaaggtcccccacttcggatcaagacgccggccaaccccaaaatgggaacgagtcccgcaccttcatcgggtacctggcctgtccccgcacaagaaacgggcgggtcggcgttgggaaatccccgggcgggggcgggacctcccccccccgagtggtgggcgatttgaggcaaaccaatccctgggcgaaagggggtcccgg

SEQ ID NO: 83583 - protein, 41 aa, Zea mays
  misc_feature: Ceres CLONE 1569536
MGTSPAPSSGTWPVPAQETGGSALGNPRAGAGPPPPEWWAI

SEQ ID NO: 83584 - DNA, 854 bp, Zea mays
  misc_feature: Ceres CLONE 1569540
  misc_feature: Translation starting site: 285
  misc_feature (426)..(426): n is a, c, t, g, unknown, or other
  misc_feature (577)..(577): n is a, c, t, g, unknown, or other
acccgcggtggcggccgctctagaactagtggatcccccgggctgcaggaattcgtctcacccctagaaaaaagcacgcccacacagcagcatcaacctcgggtgctctgcggccactggactgccctgccagtgcccgtgcccgcgcgcgctagcctagctgctcctgcctggttcgccgtagcccgtagcacaacaacaacaacaaaaaaaaaaaatctccgcgccgcggggggaggtggtctgttcaccttggggagcagcggcgggccggcggccgagaaatgcccggtggcgccttcctcctcaacggcagcggcggcggcatggcggactacggcggcggcctcaccgtacccgtcgtcgtgacctgcctcatggcggcctccggcggcctcatcttcggctacgacattggcatctcangaggtgtgtcggagatggaagatttcctgaacaagtttttccccccgggttgctcaagaagacggcgcgcgcccacaagggacgtgtactgcatttacaacaaacagggcgctgacggccttcacgtcgtccctgtaaccgttccgcatgntggggaacctgctggcgagccgcgtgacccgggggctggggcgccaagccgtcatgctgattggggggcggcttgtcttgggcggggccctttgttaaaagcccccgggggcaaaaatccccaagggctaattttgggaaaggaacctgctcgggctggggggttgggttttccgggcaagggccccccgggttgccctcgcccaaaaggggggcccccccgcgtgggggggggggggggttttaattgggcctttcccccctctttattaaaaggg

SEQ ID NO: 83585 - DNA, 967 bp, Zea mays
  misc_feature: Ceres CLONE 1569541
  misc_feature: Translation starting site: 218
  misc_feature (678)..(678): n is a, c, t, g, unknown, or other
ccccgcggtggcggccgctctagaactagtggatcccccgggctgcaggaattcgtctcacccctagaaaaaagaaaaaccgtttccaccctctctctcgtggttctcccgtgctctgtgtccctagcggcgacgactgggcgatcgccgccgccttaagccaggtgctcaggtctgccacttggcacttcgccggcgacgagcacctaacagagagatggctggtggttttcgagtactgcatcttgtgaggccatttctggctttcttgccagaagtacagagtgctgataggaaaataccattcagagagaaagtgatctacacggtcatttctctcttcatttttctggtctgcagccagctcccactctatggcattcattcaactactggcgctgaccctttctactggatgcgtgttattcttgcatcaaaccgtggtactgttatggaactgggtatcactccaattgtaacatctggaatggtgatgcaacttctagtgggatcaaagattattgaagttgacaacagtgtgagggaggatcgtgctctgctaaatggtgcgcagaagttgctgggtatccttattgcattgggagaagccggggcgtatgttctctctggaatgtatggcagtgtgagccaaactgggaactgggatgctatcccctnatacttcagcttttccttgctgggatcattgtcatcggcctagatggactcctacaaaaaggctttgggtggggacctggcacccccctgttcattgcaacgaatatctgggaaaatatcatctggaaggcctttacccaacaacctcaaaaagggggcggggggcctaattttaaagggccttccttggccttggtccatcttttggatcccccacaaattaaagcccgggctccacccgaaggtttccaccggcaaaatcttcaaatggtgaccaattttcttgcct

SEQ ID NO: 83586 - DNA, 996 bp, Zea mays
  misc_feature: Ceres CLONE 1569543
  misc_feature: Encodes the peptide sequence at SEQ ID NO. 83587
ccccgcggtggcggccgctctagaactagtggatcccccgggctgcaggaattcgtctcacccctagaaaaatcgtccgctccggccgcgcgcctccgaccctcgccgatgcggcccccgccccctccgcctctggagctccgcctccgtctctgcctcctcccgccccaccctatggctccttctatgcgtcatgccttctgctcacactccgtcttgtcctgccatctttgggtgaacaccctcgcccgactccgcgatgggcgcccgcgcaccctctgcgacacgcggggcgagggctaggcggagggcttcgcgtggccggatgggtccaaggaggagctgcggcggctcctggagctgctccctagggagctgagtcggcggggccacacccacccagagctcccagagctcgtggaggtggtcatggacctcggccgggccccgctcgcgcgcttcccgtccggagacttcctcctctcccaaggccccatctcctttcgaggacctccgtcacggctgcatcccactcccaggggggggaactttgggagcgggaataatctgggtggaatcaacccgaacgctggaaccggattcagcgccttttgggaaatcggaaggggcgtcctttgtcggccctcccatgcccatgttgggggggtgcaagtgcccccggaagggctaattttggcttcctgaatttgggttaaaggacgggggggttcatttgctggtttcttcgggcccaccggggggtggggggaaaacctcctggcataaaaaaaaaatgtgcccgaattgttaggtggagaactataaaacagcgcggtgggtgtttggtgcaaccctctaaatgatattggggcggggaagggatttttctccccccccgaaaatggccaagtgccttggggttggaaaggccctaacaaaaacatgcccattagggtgcgataaaagccggggaaaaaccatgtgccttggtgattg

SEQ ID NO: 83587 - protein, 91 aa, Zea mays
  misc_feature: Ceres CLONE 1569543
MDLGRAPLARFPSGDFLLSQGPISFRGPPSRLHPTPRGGNFGSGNNLGGINPNAGTGFSAFWEIGRGVLCRPSHAHVGGVQVPPEGLILAS

SEQ ID NO: 83588 - DNA, 937 bp, Zea mays
  misc_feature: Ceres CLONE 1569548
  misc_feature: Encodes the peptide sequence at SEQ ID NO. 83589
  misc_feature (399)..(399): n is a, c, t, g, unknown, or other
tcacccgcggtggcggccgctctagaactagtggatcccccgggctgcaggaattcgtctcacccctagaaaaaagcaggccaagcgcaccaccaccacagacatcatcagatcaccacccagtgcagcaaaagaaagaaagaaagaaaagaaaaaggcaggcgcgccaaaatggacaacggcggcagcaacggctccgccaccgcctccgcctgctgcaacggcaaaattaaccgcgggccgcacgtggcgatgctggcgacgcccgggatggggcacctgatcccgctggcggagctggcgaagcggctggcgtcgcggcacggcgccacggccacgctcatcacgttcgcgtccacggcgtcgcccacgcagcgcgcgttcctggcctcgctcccncccgcggtgtcctcgctgtccctcccgcccgtcgacctcttcgacctgccccgcgccgccggcatcgagacgcgcatgtcggaggagtgcgcgcgctcggtggctgcgctgacggccgtcttcgccggccctaaggcgggcaacggccgccgccctgggggcctttcttggccgacctctttcggcgccaactcgttggaaccggccccgccccgcgggggtcccccgcaagtgcattttttttcccattcaaactggaggggctcagcctcatcctccacctgccggaaactgggacccccgcctggccggggccttcccgggaaatgccgaaaccctttccccctgcccgggggggtgcccctccccggggcccaaattgcttatgccccttgaaggaaaaggccacacccccggcttcccctgggtagtgggcccccgggggcccaaataccggggaacccccacccctcctcttttaaaatttttccccccccctgaaagggggggcgcccccaaaggttttgtggccaaagag

SEQ ID NO: 83589 - protein, 207 aa, Zea mays
  misc_feature: Ceres CLONE 1569548
  misc_feature: SWISSPROT Homolog: EC 2.4.1.218 Hydroquinone glucosyltransferase
MDNGGSNGSATASACCNGKINRGPHVAMLATPGMGHLIPLAELAKRLASRHGATATLITFASTASPTQRAFLASLPPAVSSLSLPPVDLFDLPRAAGIETRMSEECARSVAALTAVFAGPKAGNGRRPGGLSWPTSFGANSLEPAPPRGGPPQVHFFSHSNWRGSASSSTCRKLGPPPGRGLPGKCRNPFPLPGGVPLPGAQIAYAP

SEQ ID NO: 83590 - DNA, 974 bp, Zea mays
  misc_feature: Ceres CLONE 1569549
  misc_feature (40)..(40): n is a, c, t, g, unknown, or other
  misc_feature (67)..(67): n is a, c, t, g, unknown, or other
  misc_feature (129)..(129): n is a, c, t, g, unknown, or other
  misc_feature (140)..(140): n is a, c, t, g, unknown, or other
  misc_feature (974)..(974): n is a, c, t, g, unknown, or other
ctcctcggtggcggccgctctagaactagtggatcccccngggctgcaggaattcgtctcacccctnagaaaaaaaaaaaaaaaagacaatgggcggcgctctgctccatccaagattctggggcaccncagctcaactntcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgctggaccgatcggaggtgccggagtacctcaccggagaggtccctggagactatggctacgacccttttggcccccgcatgaagccagaggacttcgccaagtaccaggcctacgagctgatccatgccagatgggccatgctcgggtgccgctggcgctgtcatcccagaggcctgcaacaagttcggcgctaactgtggccctgaggctgtctggttcaagaccggcgcgctgctcctggacggcaacaccctcaacttactcgggaacagcatccccatcaaacctggtggtggccgtgatccgccgaggtcatcctcgtgcgcggcgcccgagtactacccggatccccaacggaccggaacctttgagaccagctgccccccgggggggccctttcaaccccctgggcctgggcagggacccccgaccaggccccctccctcaaggggaaaggaaaacaaaaacggccggctgggccatgtttcccatgtttccccttttttatccaggccttagttcccggggaaaacccccgtggaaaaacctcccaaagcacttaagggaccccttggggaaacacctgttccccttttttccccggccccccaatagaaccccttccctggaaggacagcccccccn

SEQ ID NO: 83591 - DNA, 1039 bp, Zea mays
  misc_feature: Ceres CLONE 1569550
  misc_feature: Encodes the peptide sequence at SEQ ID NO. 83592
  misc_feature (932)..(932): n is a, c, t, g, unknown, or other
ggagctccccgcggtggcggccgctctagaactagtggatcccccgggctgcaggaattcgtctcacccctagaaaaatctagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacggcggcggcttcgatgactactactgggacgacgacttccatttccacgacgacggcttctccgcctcccctacgacccccggcagcggtggtgcgccccgccagcagcagcagatgggtgatatttcagcctccgactacaaaagaggggcaacacatgcaggggatacccggggaaagaatcaactcccccagggaccagtatccgtcgggatgaggcccaaagagtaacaaaagcctccccaaaacccccccgaggggcccaccaaggggggcttcaaacaacggggaatgccaaaacggggggggaaaagaaaaggaaacacctttccccacaaggttccccccctgaaaacccaaaaaccccgcccaagagccaaaaaaaaagggggcccttttccccggggaaaaaaacaaataccctgggggcaaagagaattttttgggggtggtgcccccctcttcctgcagagttaagcccctgaaaaaggaaaaacacaccccccccatttttaaccacaaaaccccctcgcggggggtggggggggcccccccccaaaaccggggggagggaaagggcctccccccccggggggggggggaaaaaaacctctcaaaaattggggtgggcgggagcgcttttctaaaaagaaaaaaatatttctttaaaaaagccccccctcccnacccccccctttttttttttggagaggaattttttgtgcgatgatattttatttgggcccccccctcttcctttgtttaaaaaaaatatgtcccccccccacacccc

SEQ ID NO: 83592 - protein, 91 aa, Zea mays
  misc_feature: Ceres CLONE 1569550
MAHDLCEDLELVADDGGGFDDYYWDDDFHFHDDGFSASPTTPGSGGAPRQQQQMGDISASDYKRGATHAGDTRGKNQLPQGPVSVGMRPKE

SEQ ID NO: 83593 - DNA, 920 bp, Zea mays
  misc_feature: Ceres CLONE 1569552
  misc_feature: Encodes the peptide sequence at SEQ ID NO. 83594
ctggagctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactactacatccagaaagagagcaccctccacttggtgcctgcgccctccaggggaggcatgcagatcttcgtgaagaccctgaccggcaaaactatcaccctcgaggtggagtcttcagacaccatcgacaacgtcagggccaagtatccaggacagggagggcattcccccagaacagcaagcggtcatcttttgctggaaaacaccttgaaggacggggcgcaccctggccggattacaaaatccaagaaggaagagcaccccccccctttggtgctgccgccctcaggggaaggcttggcaaatctctcgtggaaaaccctggaatgtggaaaaacttttcacccccgggaggggtgg

SEQ ID NO: 83594 - protein, 254 aa, Zea mays
  misc_feature: Ceres CLONE 1569552
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYYIQKESTLHLVPAPSRGGMQIFVKTLTGKTITLEVESSDTIDNVRAKYPGQGGHSPRTASGHLLLENTLKDGAHPGRITKSKKEEHPPPLVLPPSGEGLANLSWKTLECGKTFHPREGW

SEQ ID NO: 83595 - DNA, 934 bp, Zea mays
  misc_feature: Ceres CLONE 1569553
  misc_feature: Encodes the peptide sequence at SEQ ID NO. 83596
  misc_feature (520)..(520): n is a, c, t, g, unknown, or other
  misc_feature (542)..(542): n is a, c, t, g, unknown, or other
ctccccgcggtggcggccgctctagaactagtggatcccccgggctgcaggaattcgtctcacccctagaaaagtgccctgctcggacccctacatcgacgggcccatcatccaggcgtcggtggcgcgtgctctggccagcggcaccaccatggacgccgtgctggagatgctcagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgtacccgcgagtggagtcactcatccaggaggttaagaaagtgactaancagcccgttgctgttggcttcngcatatcaagccagagcacgtgtagcagattgcgcagtgtggcgctgacggggtgatcatcggcagcgccatgttgatgcagctggtcgaaaccgctctccccagcaaggcctgaggaggctgggaagattatgcaaggggcatgaagaacgcgctgccatgagtccatgaccaagtaaaacgtacagagacacttgataatatcttctatcctcccgggagagacgaccgaccattaaaatagccccagtggaggtgagccttgcctgtatttacccgtaactcggcctcctccttcccgtataattccggccgctactagaaaacgtgtccttatatatgttaggcattgggggggaactactactagtgggcgtcattcattaaattcc

SEQ ID NO: 83596 - protein, 148 aa, Zea mays
  misc_feature: Ceres CLONE 1569553
  misc_feature (1)..(148): Pfam Name: Trp_syntA Pfam Description: Tryptophan synthase alpha chain
  misc_feature: SWISSPROT Homolog: EC 4.2.1.20 Tryptophan synthase
  misc_feature (123)..(123): Xaa is any aa, unknown, or other
  misc_feature (131)..(131): Xaa is any aa, unknown, or other
MDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVYPRVESLIQEVKKVTXQPVAVGFXISSQSTCSRLRSVALTG

SEQ ID NO: 83597 - DNA, 966 bp, Zea mays
  misc_feature: Ceres CLONE 1569554
  misc_feature: Translation starting site: 300
  misc_feature: Pfam Name: DHQ_synthase Pfam Description: 3-dehydroquinate synthase
  misc_feature: SWISSPROT Homolog: EC 4.2.3.4 3-dehydroquinate synthase
ggagctccccgcggtggcggccgctctagaactagtggatcccccgggctgcaggaattcgtctcacccctagaaaaatcaccgtcaccgccgctttccgagctctcatggcggcgtccgcgtcctccctccttgccgcccccgcatcctcatcctgtggggccatctccccccagctccctcgtggagctccggccgctgcctccgtcgcttcgccgtcgcgtcactcctgctacctcctccgcgcttccccttcgaggcgccatcggagtcgcttcgtagccaacgccgctcccaccatgcagcctccggcggagtccagggtctccacggtagtcgatgtcgacctcggcgaccgtagctatccgatctacatcggcgcatgcctcctcgaccaaccggacctgctgcagaggcatgttcatggtaagagggtttcttgtggtgaccaacacgaccgtcgcgcccgcttacctggacaaggtgacatgggcactcacccacaacaacctgaatgtatcagtggaaaagcgtgatcctgcccgaccgtgaaaagtacaaaaatatggacacgctgatgaaagtgtttgacaaggcagtcgaatcccctttttgaaccgccggtgccaccatttgaagcactggggggggtgggtggcaattggggaaatgtgggggttttgcaacctgctgcaatccccccgggggggcaattttcatacagataccaactactccgaaggcccaagccaaaaacttgaatttatggcccccaaaagtgggttaccaaatagggtttggttctgaagttgccccgaaaaaccgcttttaggggaatcccccggttgggggggaaaaaccggatttaccccccccccggaaaaaaaatttttggggcgttcttcccaccccaaagtggtttttattgaaaaaaatacctttacaaattggccgaagaggggaaat

SEQ ID NO: 83598 - DNA, 951 bp, Zea mays
  misc_feature: Ceres CLONE 1569557
  misc_feature: Encodes the peptide sequence at SEQ ID NO. 83599
  misc_feature (719)..(719): n is a, c, t, g, unknown, or other
  misc_feature (799)..(799): n is a, c, t, g, unknown, or other
acccgcggtggcggccgctctagaactagtggatcccccgggctgcaggaattcgtctcacccctagaaaaaatcgccaccccaccctcctcctcctccctgtctttctcccccctctctctcccactcttgacaaattttcctccacccattcccttcctcccctcttcttcttctccacccactccaccgatccccctctttctctctgaattctctctcgtcgtgcccacccttcccatctgtctgatgcccctctctcgcaatcagtcactcggctcttgtttcttccgtctgctgggttgattctctctctttctctccgtggagaaacaggaggagagagagggaagaagagaaatcggagccaacctgttctttttgcctggattgcggttcttgcgagttgttcagaaactctgggccagtttctggtcctttaaactactggaaagaggaaccatcagagatgccaaggcagccaacaaattgatatctaattgccctactttggatcatcataatgcaaggacagaggaattctatggagcattttgctgatgtctttggattcgacgttgcatcgagttcaggcaaccctgtgatggatcagcagtcatattggaataatgttcttggatcagtagaatcacataatcttcaaggttatcagatggctcacagtgatgccgccatgccatatgggaaatgaccacagncagatggtacatttcttggtttctgggaattcagcgaagcaagttcaagtgccagtgcactaaactagggcagctctaantatggcaaaacagagcatccttacattggtggggggagtggaactgaggattgggtgaaagcgactggtaacctaacaaggcatttccccgggatgtggatatcaacccttacggcaacgtatacaattttggtgggcaaagtcaaaatgtt

SEQ ID NO: 83599 - protein, 62 aa, Zea mays
  misc_feature: Ceres CLONE 1569557
MQGQRNSMEHFADVFGFDVASSSGNPVMDQQSYWNNVLGSVESHNLQGYQMAHSDAAMPYGK

SEQ ID NO: 83600 - DNA, 917 bp, Zea mays
  misc_feature: Ceres CLONE 1569558
  misc_feature: Encodes the peptide sequence at SEQ ID NO. 83601
ctccccgcggtggcggccgctctagaactagtggatcccccgggctgcaggaattcgtctcacccctagaaaaaacgacttctacgcctccaccacgaggcacgcaacaattagaacacatctcgccgccgccgaggacgacggcgatgatgtggcgttcgcgagctcgtgcgctgctcctactccgctcgaccattacccggccaccgccaccacctccacaaccatatcccactcgaaccctaacccgagtcccacctccccgcttcctgtcctcctccccggatcccatccccgattcctcctccgccgccgccgcggatcccttccctgaagccttctcctccccgaccaaggcttctcaagatgccgctgaggccggagaggacaccccgagctcgatgtgggaggaagctggcgacgccgacgacatctttgcctcccccggcagcgccgacgccgtagccgacgatgaggaggtcgcccccctctgcgccgccgtggagtccacccccgaggaccagatcgcctccaccctcgctgaattgaccggggacttcacgagccactcctagccgcaatccctccttgtggggatcaatgctccggtaaaaaaccgattcccctggccaatttgccgggaaaaaaataccccccttcccaaaaaccccccgaatccttgggggtctccgggagccaacctggccgaatcctggttaaaaaaaaaaagggggaacccctccctgcctttgggggaatccaattagggaaaaaaggcgccgttgtgcccgaaacaagtgggggacacccgtgttttgtataaaaattgtctccgcgcctcttttgggaaaacctctgtaaatttcgaagcccgccggtttggggtgggtgttttccccagttacttaaatatttgg

SEQ ID NO: 83601 - protein, 142 aa, Zea mays
  misc_feature: Ceres CLONE 1569558
MMWRSRARALLLLRSTITRPPPPPPQPYPTRTLTRVPPPRFLSSSPDPIPDSSSAAAADPFPEAFSSPTKASQDAAEAGEDTPSSMWEEAGDADDIFASPGSADAVADDEEVAPLCAAVESTPEDQIASTLAELTGDFTSHS

SEQ ID NO: 83602 - DNA, 1014 bp, Zea mays
  misc_feature: Ceres CLONE 1569559
  misc_feature: Encodes the peptide sequence at SEQ ID NO. 83603
tccccgcggtggcggccgctctagaactagtggatcccccgggctgcaggaattcgtctcacccctagaaaaagacggacgccgccccaccagacctccgcccggatctcgccgcctctcccgcccctgctcgcgagccgccgtcgacagccaccgccatgggcacggccaacggccagcagccggcagagggcgctccctctgacaagctccgccacgtcgagtccatgtcggagctgccctccggcgccggcaagatctcggggatcaacgccgtcgtgctcggggagtcgctcgccgccgaggagaacgacctcatcgtccccagccccgagttctctgccagcgccctcgtctcttctccgaaacagtatcgcgagatgtatgagaggccccccacacaccccgccgggttctggtcggagattgccgagaccttttactggaaggagaagtggaaccccgccgaggtctgctcggagaacctcgatgtcacccagggacccctccagatcaactggttcaaggggaggggaaaaccgacctttggttacaacggctgttgaaccgcaaaccattccaagtctgggccaatgggcgaacaagggttgccaatggtacctggggaagggtaattggagccccgcggcccaggatgggggaaaacttttcccttatttcccggaaactccctgggaagaaatggttttcgccaagcttggcaaatatatcctttaaaaaaagcctcgggtggtcccgcaaagggggaatgcctctttcttattttaccctccccatggtgggtggggaagctcccccctttccattggcttggccggtatcccaccaggggtgcccgttcaccgcggctgtgtggttccgggctctcctatgatattccccggctccaagaattgttgggttgaaggcctaaccttgctccacgattgttgctgggaagggggggtaaccccccctttcttaaaaaaaaaggtaccccgccgtgtctattat

SEQ ID NO: 83603 - protein, 135 aa, Zea mays
  misc_feature: Ceres CLONE 1569559
  misc_feature: SWISSPROT Homolog: EC 6.2.1.1 Acetate--CoA ligase
MGTANGQQPAEGAPSDKLRHVESMSELPSGAGKISGINAVVLGESLAAEENDLIVPSPEFSASALVSSPKQYREMYERPPTHPAGFWSEIAETFYWKEKWNPAEVCSENLDVTQGPLQINWFKGRGKPTFGYNGC

SEQ ID NO: 83604 - DNA, 929 bp, Zea mays
  misc_feature: Ceres CLONE 1569560
  misc_feature: Encodes the peptide sequence at SEQ ID NO. 83605
  misc_feature (369)..(369): n is a, c, t, g, unknown, or other
  misc_feature (394)..(394): n is a, c, t, g, unknown, or other
  misc_feature (399)..(399): n is a, c, t, g, unknown, or other
  misc_feature (519)..(519): n is a, c, t, g, unknown, or other
  misc_feature (582)..(582): n is a, c, t, g, unknown, or other
tccccgcggtggcggccgctctagaactagtggatcccccgggctgcaggaattcgtctcacccctagaaaaaagtctcacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagncagcatgacccaccgatttgtctcnctaanggtgatgctaacgaggagaagacaggccgcttgctaccaagtacgagatccaaggggttcccaaccatcaagatcctcagggaccaggggaaagacaattcaggaatacaaggggccctnagggaggctgatggccattggtggatttacttgaagaaaccaggtttggcccctgcgttccangggaaatccaggtcccccagaaaaatggcccacgggccctttttcgatgaaccagaagaaccccacctttgggggggaatccctccccccgaaattcccccgcgggccccccaaattttccaaaactccctcgtgggggggcccccaaaaaaaaaccctgaggggcctaaaaccccaaaattttggggcccccacttttgtggtggggcccaaccccccccccccccccccggggtgggttttcccccccctggtggaaacccccctcttttggggcggggcggctgtagaaaaccctttttataaacaccctttgttgttttcaacacaaagatgttttttttttt

SEQ ID NO: 83605 - protein, 253 aa, Zea mays
  misc_feature: Ceres CLONE 1569560
  misc_feature (35)..(137): Pfam Name: Thioredoxin Pfam Description: Thioredoxin
  misc_feature: SWISSPROT Homolog: EC 5.3.4.1 Protein disulfide-isomerase
  misc_feature (81)..(81): Xaa is any aa, unknown, or other
  misc_feature (90)..(90): Xaa is any aa, unknown, or other
  misc_feature (91)..(91): Xaa is any aa, unknown, or other
  misc_feature (152)..(152): Xaa is any aa, unknown, or other
MAIRSKAWISLLLALAVALSARAEEEPAAAAEGEAVLTLDVDSFDEAVAKHPFMVVEFYAPWCGHCKKLAPEYENAAKALXQHDPPICLXXGDANEEKTGRLLPSTRSKGFPTIKILRDQGKDNSGIQGALREADGHWWIYLKKPGLAPAFXGKSRSPRKMAHGPFFDEPEEPHLWGGIPPPEIPPRAPQIFQNSLVGGPPKKNPEGPKTPKFWGPHFCGGAQPPPPPPGVGFPPPGGNPPLLGRGGCRKPFL

SEQ ID NO: 83606 - DNA, 945 bp, Zea mays
  misc_feature: Ceres CLONE 1569563
  misc_feature: Translation starting site: 165
  misc_feature: SWISSPROT Homolog: EC 1.1.1.39 Malate dehydrogenase (decarboxylating)
  misc_feature (398)..(398): n is a, c, t, g, unknown, or other
  misc_feature (401)..(401): n is a, c, t, g, unknown, or other
  misc_feature (706)..(706): n is a, c, t, g, unknown, or other
acccgcggtggcggccgctctagaactagtggatcccccgggctgcaggaattcgtctcacccctagaaaaagtaaagggtagaacgtctccactctcccgtacgccgatacccactgacgccaccgcccgaagcctccccgagaaacaggagccggcgcggggatgtcgtccatctcgcggaatctccggcgatccctcgccccggaccgcctgcgccgcctctcccagcacccgcgagagtatgtgacgtcggagtgccaccgccccgtcgtcctccacaagcgcggccccgacatcctccacgacccctggttcaaccggggcacggcgttctcgatgaccgagagggaccgcctcggcctccgcggcctgctcccgcccaacgtcgtctcctcncancagcagatcgacagattcatgcttgatctgaaacggctgcagagatatgcaagagatggcccgtctgatacttatccattggcaaaatggcgcatccttaacagattgcatgacagaaatgaaacgatgtactacaaggtactaatagataacattgaggagtatgcacctatcgtttacacaccaaccgttggactttgttgccaaaactacagtggtctgtttcgacgccctaggggaatgtactttagtgcagaagatcgtggggagatgatgtccatggtgtacattggccagctgatcangttgacatgatagtggtgactgatggaagcaggatattgggtcttggtgatcctggggtgcatgggattggcattgctatgggaaaatgggatttatatggtggtgctgctggaataaatctcaaaggtttcttcctgttatggatgatggccggacgaacacgagaacctcctaaggatccctttatctgggctacaagagcccgtcttgagggaaagaattgttccacttatgacaa

SEQ ID NO: 83607 - DNA, 1006 bp, Zea mays
  misc_feature: Ceres CLONE 1569565
ctccccgcggtggcggccgctctagaactagtggatcccccgggctgcaggaattcgtctcacccctagaaaaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagatggcaaaggaggggagatgatgtagttcacccacttaaagtttctctggaagatctttacaatggcacctcaaacaacctctctctttcgcgcaatgtcatctgctccaagttgcagggcaagggctcgaagtctggtgcctcaatgaggtgccctggttgcccagggctcacgcatgaaagtcactattcgtccaggtggggcccttccctgatacagcagtatgcagcagcccttgcaatgaagtgcaagggggactggaatataacttcaattaaaaagggaccgcttttcccaggggggcaaggggggaaaaaaggccttcaaaaaaaaagaagggttctttgaaggttcctttgttgaaaaaggggggatgcacaccccatccccgaaaaatccccctcccccctgtggaaaacctttattaaacgccctgaatacttggccgctggaaaacttttgttttccccccccccagcaaaagggttcccccccatattcaaaaaaaaaggggggaaaattcctttctttttagaaaccccttttgtttttaaccaaagcacattatttgggttccaattttggttttaacactttgggaacaagggcacgctctccctataatcaaaaccggggggatgtttgttacactgtaaatttcggggttattttgtgttggggc

SEQ ID NO: 83608 - DNA, 953 bp, Zea mays
  misc_feature: Ceres CLONE 1569566
  misc_feature: Encodes the peptide sequence at SEQ ID NO. 83609
  misc_feature (393)..(393): n is a, c, t, g, unknown, or other
  misc_feature (601)..(601): n is a, c, t, g, unknown, or other
acccgcggtggcggccgctctagaactagtggatcccccgggctgcaggaattcgtctcacccctagaaaaagctttctcctccccgtcgacctcgccaatctccctcccgctaaccctagtccagcacccgagatctactccgcgcaaacagccatggcggagacgctcgacatgaccctcgacgacatcatcaagaacaacaagaagagtaactcctcatctcgcggggcccgccgcagccgcggcggatccgcccctggcggcgggaccggcggggtcgggccgaccaggcgcccctttaaaagggctgggaacaggcaggcgccctaccagccgccgaaggcccccgacgctgcgtggcagcacgacatgtaccctgcggtcgccgcangaggcggcggcggcgggagggtctcggctctcgagacgggcgccaagctctacatctccaacctggactttggggtttcgaacgaggatattaaggagcttttctctgagctaggtgatttgaagcgtttttcgataaattatgatcgaagtgggaggtctaagggaacagctgaagttgtatttgcaaggcgttctgatgctgtagncgcggttaagaaatatgacaatgtccaaactgatggtaaagccatgaagatagagatagtgggtaccaatactccagctgcagcagctgctcatccagtcccctaatggtgggcatgctaggaatgctgcgaagagtgcaccaaaagatgctgctccagcaggtttgtcgcagcatagacccatcagaggggcgggagcctgctgctggatcgggggggggcctcgggcgaaaaaccgcacagccgagccgactggaaacccatgccgaattggaaaaattcatggctgagccatgcaggcaacaaatacattccaaattggatatcgaaatcaaattcaagggcttaggcc

SEQ ID NO: 83609 - protein, 183 aa, Zea mays
  misc_feature: Ceres CLONE 1569566
  misc_feature (96)..(166): Pfam Name: RRM_1 Pfam Description: RNA recognition motif. (a.k.a. RRM, RBD, or RNP domain)
  misc_feature (80)..(80): Xaa is any aa, unknown, or other
  misc_feature (149)..(149): Xaa is any aa, unknown, or other
MAETLDMTLDDIIKNNKKSNSSSRGARRSRGGSAPGGGTGGVGPTRRPFKRAGNRQAPYQPPKAPDAAWQHDMYPAVAAXGGGGGRVSALETGAKLYISNLDFGVSNEDIKELFSELGDLKRFSINYDRSGRSKGTAEVVFARRSDAVXAVKKYDNVQTDGKAMKIEIVGTNTPAAAAAHPVP

SEQ ID NO: 83610 - DNA, 856 bp, Zea mays
  misc_feature: Ceres CLONE 1569568
  misc_feature: Encodes the peptide sequence at SEQ ID NO. 83611
  misc_feature (373)..(373): n is a, c, t, g, unknown, or other
ctccccgcggtggcggccgctctagaactagtggatcccccgggctgcaggaattcgtctcacccctagaaaaaaaaaaaaaatctcccacaccacagctcccacacacagcaggcagcagctcgatcgctagctcctccgaaccggaaagccaagcccgctttggcgatcgtgcttgcttgcttggttccttcaattcctgccggagccagcgagagctagctgctgctgtcgcgtggtagacgtcgtcttgccagcgagagcctagctcgatcggtctctctggtacaacgtagggagaaagatcgagggggagaggacgacgacgatggccggcgcgaccgtgaccgtggaggaggtgaggaaggcccancgcgccaccggccccggcaccgtgctggcgatcgggaccggcacgcccggcaactgcccctacccagccgactacccgaactactacttccggatcaccaagagcgagcacctccccgacctcagggagaaattcaagaggatgggcgacaaggccaaggatccgggaaaggtttacttgccccttaacggaagaatttcccggggggaaaacccgaaattgggggcccgatattggggcccctcccttggaacccccgaaaggaaagggggggtgggggggagggccccaaacctggggaaagggggggggcgccaaaaggggattaagggggggggggggagcccaaaagtccgggaatcccccccctgggggttcctccccccccccccggggggggaaatttcggggggccccaaactcaacgtataaaaaggggggggggggtggggggccccccggaaaaaacccctcttagtttgc

SEQ ID NO: 83611 - protein, 158 aa, Zea mays
  misc_feature: Ceres CLONE 1569568
  misc_feature (6)..(154): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (15)..(15): Xaa is any aa, unknown, or other
MAGATVTVEEVRKAXRATGPGTVLAIGTGTPGNCPYPADYPNYYFRITKSEHLPDLREKFKRMGDKAKDPGKVYLPLNGRISRGENPKLGARYWGPSLGTPERKGGVGGRAPNLGKGGGRQKGIKGGGGSPKVRESPPWGFLPPPPGGEISGGPKLNV

SEQ ID NO: 83612 - DNA, 941 bp, Zea mays
  misc_feature: Ceres CLONE 1569569
  misc_feature: Encodes the peptide sequence at SEQ ID NO. 83613
  misc_feature (636)..(636): n is a, c, t, g, unknown, or other
  misc_feature (638)..(638): n is a, c, t, g, unknown, or other
  misc_feature (639)..(639): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (649)..(649): n is a, c, t, g, unknown, or other
  misc_feature (655)..(655): n is a, c, t, g, unknown, or other
  misc_feature (832)..(832): n is a, c, t, g, unknown, or other
ccgcggtggcggccgctctagaactagtggatcccccgggctgcaggaattcgtctcacccctagaaaaaagcctcctctttcgatagctggcgaaggcgcggcgcgcagggccagtagcaaccctcccatggcctacgctgcgcctcccatggcgtcgtccctcaccgcctcccacccccctctttccccgtcccacctcataacccatccgcatcgctgccctgcgcgccccaaccccaccaccggcctcctccgcctcaccccgtctcgccgccgcggtcgtccccccgtggccgtccgcctcgcaatatctgcctcgtccacctcagccccgcccccgtcggcggatcggtcggaggccgcgtcgtcgctggagagatacctctcggcgacggtgacgggagcggtgatgggaacgggggcggccccaccagcttcggccccgccgcgcgccccgccggcgatgaaggggggacggaagcagtatagcgcgttggggggctgtcacgctcgagaagccaagctcgatctctcccagcgccgcaagaatatcatgccccagttggcgacaggtggtggtggtggagatattggaaaaagatcggcatgggggggggggaaaggtgtggtgatntnntggtnnnaanttatanatatttggatgatttttatgaggggggagagaagggggggtttttaggaggggaaatggggtttaaaaggattgtaaatggggattagatgaaggttgggtgggaagaggtgaaaaagagatagttgtattagaggagaggggtggataagggagaggagggagagtggggagattntgttgggaggtatataaagtggggtaatgtggagaaaaaaaagggataggagtgtttagaaatggtgagagagatgaatttgtagagtggatagagaggaggagtggtg

SEQ ID NO: 83613 - protein, 78 aa, Zea mays
  misc_feature: Ceres CLONE 1569569
  misc_feature (57)..(57): Xaa is any aa, unknown, or other
  misc_feature (58)..(58): Xaa is any aa, unknown, or other
  misc_feature (60)..(60): Xaa is any aa, unknown, or other
  misc_feature (61)..(61): Xaa is any aa, unknown, or other
  misc_feature (62)..(62): Xaa is any aa, unknown, or other
  misc_feature (64)..(64): Xaa is any aa, unknown, or other
MKGGRKQYSALGGCHAREAKLDLSQRRKNIMPQLATGGGGGDIGKRSAWGGGKGVVXXWXXXIXIWMIFMRGERRGGF

SEQ ID NO: 83614 - DNA, 980 bp, Zea mays
  misc_feature: Ceres CLONE 1569571
  misc_feature: Encodes the peptide sequence at SEQ ID NO. 83615
  misc_feature (398)..(398): n is a, c, t, g, unknown, or other
agctccccgcggtggcggccgctctagaactagtggatcccccgggctgcaggaattcgtctcacccctagaaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgtgttctccgggtcggtgaacctcaagcacgtcaagctggggtaccagtacctggtgaaccacttcctgacgctgctgctggtgccggtgatggccgccacggcgctggagctggcgcgcctcggccccggcaanccgctctcgctgtggcgctccctggagctggacctggtccacatcctctgctccgcgttcctggtcgtcttcgtcggcaccgtgtacgtgatgtcccgccccaggccgggtgtacctggtgggactacgcctggctacaagccccccgccagtgcccgggtgcccctttcgcacctttcatggagcacacgcgccctcttcgcgaacaccaacaagaagggggcgcttcccaaaccaggatccctggaacccctcggggctccggcaaggacacctggcctccccgcccgcaaaccatttattccccgcccaacccccatattggtaggccccccggccccaagagcgaacttcttaattttttcccgcattaaaaacaacctcttccccccggaggggggtctaagccccaggaaaatgaaactcctcgccgggaaaaagggaagccttttttaaccaaagaccccttgtgttttcgggtgtggtttttccaaaaatgacaagccccgggggacaacaaccccggccttccaaccgttgctgggagtaggggaaaaacccccggggttcttttctcctcaa

SEQ ID NO: 83615 - protein, 201 aa, Zea mays
  misc_feature: Ceres CLONE 1569571
  misc_feature: SWISSPROT Homolog: EC 2.3.1.119 Icosanoyl-CoA synthase
  misc_feature (50)..(50): Xaa is any aa, unknown, or other
MPSGSVFSGSVNLKHVKLGYQYLVNHFLTLLLVPVMAATALELARLGPGXPLSLWRSLELDLVHILCSAFLVVFVGTVYVMSRPRPGVPGGTTPGYKPPASARVPLSHLSWSTRALFANTNKKGALPKPGSLEPLGAPARTPGLPARKPFIPRPTPILVGPPAPRANFLIFSRIKNNLFPPEGGLSPRKMKLLAGKKGSLF

SEQ ID NO: 83616 - DNA, 984 bp, Zea mays
  misc_feature: Ceres CLONE 1569573
  misc_feature (236)..(236): n is a, c, t, g, unknown, or other
agctccccgcggtggcggccgctctagaactagtggatcccccgggctgcaggaattcgtctcacccctagaaaaagacgccacgccacattcgcatctctggatccccctcccttcgccctctcccattacccgccgccgccgcctcgcgcccgcgacccacccggcctcccacttcgatcccgccccgttcgctgcccccgccccgattccgattcgtcactgttatcgcgcgncgcgcggggtgggtaagacatgcgatgggctcgtggcgggggcctctcgccccgccgcgggtgatctctcctctagcggggagccttcccgcgtgcccagcggaggtcccgtcgcagctggtgcctcaactatcccctctccttcgatctccgccgtggtcccccccgcaccccctcgaccctagggttgctctttcccctcccttcttcggcacccgattcgaattcccctccccccgggcccccgggttgggctgctcccgttccccccccccccatggttctccccacggggcggaatttcccccccaaaaacccccggggcccctctgggttataaaatagagggggggggctaaccctgtccccacccccgcttttggtgtgggggcccctattggggtggggaaaaaaagaggcttttccgtctaaaggggggcccccttcaccaagggggggcccagaaaaaattttggcgggaagggtcccccatacaaaagaggcgggccccccttgggtatttctaggggttttttgtcacccctcctcccccgggggtgttccccaaaacacaatatcttcttttttgtaaaagggaaaaagggggcctctaataacaccccccacccccccctcttggggggagggtggccaataataaaacactttttttggggggggggtaatacccataatacccctttttattccccgccccccctagagaagaaaaaaaagggggtttaaa

SEQ ID NO: 83617 - DNA, 924 bp, Zea mays
  misc_feature: Ceres CLONE 1569575
  misc_feature: Encodes the peptide sequence at SEQ ID NO. 83618
  misc_feature (453)..(453): n is a, c, t, g, unknown, or other
  misc_feature (712)..(712): n is a, c, t, g, unknown, or other
  misc_feature (757)..(757): n is a, c, t, g, unknown, or other
ctccccgcggtggcggccgctctagaactagtggatcccccgggctgcaggaattcgtctcacccctagaaaaaagctcaataaggactgcatgcacgcaaacgcagcagcagctaaagtcctattccggcaggaggggcagcacgcacaggcacagctagcagctgtctgctagcgcgcgagagaggagagcagcttggaaccgtacgtacgcggtgcgcccaccccaccggcggatgccatgacgacgtacagggtctgctgcttcctgcggcggttccgggcggcgtcgaacgagccgtcggaagcggtcggcgacgtgttccgggcgtacgccgacggcggcggcggcttgctcggagaggaagcgctgcggaggttcctgcgggaggtgcagcgggagaccgacgctggcgccgacgcggcggccaaggaggtggtgggcgtcgcggncgaacacatgctgctcagcaagggccgcggcctcaccgccgagggggtcctcgggtggctcttcagcgacgccaacgccgccctcgatcccgcgcgaggggtataccaggacatgggcttgccgctgtcgcactacttcatctacacggggccacactcgtacctgacgggggaccagctgagcagcgggtgcagcgaagagcccatcgtgaaggcctccacgacggcgtccgggtgatcgagctgggactctgggccnacgcgcccaggacgaagttgaggttctcacggcaggacctggacntcgcggtggaactgatcggtgcctggaggcataaggaagagccttcggacttcgcctacccgtatcctcacctggaaaccccccaccgggacctcagcaaagggccaaagctgaagaaacttcggaaatgcttcttgcgaatcgaaccggggagatccctcccgaaa

SEQ ID NO: 83618 - protein, 149 aa, Zea mays
  misc_feature: Ceres CLONE 1569575
  misc_feature (23)..(106): Pfam Name: efhand_like Pfam Description: Phosphoinositide-specific phospholipase C, efhand-like
  misc_feature: SWISSPROT Homolog: EC 3.1.4.11 Phosphoinositide phospholipase C
  misc_feature (71)..(71): Xaa is any aa, unknown, or other
MTTYRVCCFLRRFRAASNEPSEAVGDVFRAYADGGGGLLGEEALRRFLREVQRETDAGADAAAKEVVGVAXEHMLLSKGRGLTAEGVLGWLFSDANAALDPARGVYQDMGLPLSHYFIYTGPHSYLTGDQLSSGCSEEPIVKASTTASG

SEQ ID NO: 83619 - DNA, 941 bp, Zea mays
  misc_feature: Ceres CLONE 1569577
  misc_feature: Encodes the peptide sequence at SEQ ID NO. 83620
ctccccgcggtggcggccgctctagaactagtggatcccccgggctgcaggaattcgtctcacccctagaaaaagacgacgacgtacgccggccgtaagtgagccgagagcccccgatataccagctagctagataaccagccagcgcgagctatggaggcggcggcggcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggcgccggacctccgcggctactgcggcaccgccgcgccgcccgacgtcgcgtcctactccgccttccacgtcgtcggcgacgtcgtcgccctgctcgacgcgatcggcatccacaacaaggtgttcgtggtgggtcacgactggggcgccatcatcgcgtggtacctctgcctgttccggccggacggtgtggcggcgcttgtcaacaccagcgttcgcttcatgcgccaaatcttttgtcgcgcccgcgccgccgccgtcacgcccatcgactacttccaccgcaactacggggccaactactacatctggccgcttcagaacaaaaatttgtcgtcgggccggcggccttccggcgacaaccgatcgatcggtcactgcacggcgcaacaacccgttgggggttgtcgtcctttgaagcccccagggggcaggttgggccccttcctggccccaaggggaaattacctttaaacccgtcttcttcggaacttattggaaaaaaatgtggggggccccccggggcgggcccccacccttccccccccccctttatattataataggaatcgccccccgcccgataaaaaggccgg

SEQ ID NO: 83620 - protein, 221 aa, Zea mays
  misc_feature: Ceres CLONE 1569577
  misc_feature: SWISSPROT Homolog: EC 3.3.2.10 Soluble epoxide hydrolase
MEAAAAAVRHRTVEANGISMHVAESGPDGGDGAPAVVFLHGFPELWYSWRHQMAHLAARGYRCVAPDLRGYCGTAAPPDVASYSAFHVVGDVVALLDAIGIHNKVFVVGHDWGAIIAWYLCLFRPDGVAALVNTSVRFMRQIFCRARAAAVTPIDYFHRNYGANYYIWPLQNKNLSSGRRPSGDNRSIGHCTAQQPVGGCRPLKPPGGRLGPFLAPRGNYL

SEQ ID NO: 83621 - DNA, 964 bp, Zea mays
  misc_feature: Ceres CLONE 1569580
  misc_feature: Encodes the peptide sequence at SEQ ID NO. 83622
  misc_feature (466)..(466): n is a, c, t, g, unknown, or other
  misc_feature (757)..(757): n is a, c, t, g, unknown, or other
  misc_feature (831)..(831): n is a, c, t, g, unknown, or other
  misc_feature (838)..(838): n is a, c, t, g, unknown, or other
  misc_feature (884)..(884): n is a, c, t, g, unknown, or other
tccccgcggtggcggccgctctagaactagtggatcccccgggctgcaggaattcgtctcacccctagaaaaaatgtccaggtaaaaggaaaaatcgccccatcccctgactatcactggctcactgcccttccacctacaggttccagcggccatggtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaagcaggcagtcgctgcagcagctattgacgaggtcgcccctgtaggtgcaggcactggtgatggcgatgcatctgcatcagcggctttaccgcaaccatccgatgttgccgaggcattacttgtggtgcaaacgccaaagtcaaccacttttgctgaggcatcaccntgtggcacagacgcagaagccagccactgatgctgaaggattggtgcctgcaccaataccaaccactgctgtagcatcagcttcgttgacaaaagccaaaaccagctcaagctaatgctgatgctgcagctgcaattttctgcagcaaagggcaatgggggggggggctgataatagtaagggtgaatgggggaaatgaagaacaagaaagagagggccctgagtgacaaggggaaaggagttatggaggaaagaggaaattaggggaaagggggtaaggggtttaaggcncaattcccctctttcccaccacgagacaaatagggggaccccccaggtttcccgggtttataattccttgtcancggccgncaactttaaacggaggccctcctacgaactgccacgcactgggagnccgcctacaggaatagcaatatacggcccgcctagtagactggacgcgctcagccgttaactatacaactcacccgatag

SEQ ID NO: 83622 - protein, 113 aa, Zea mays
  misc_feature: Ceres CLONE 1569580
MVKKPNGVAKATATSADAAAQPSKENPSTPGLVKASKFKKRKVKANRAKQAVAAAAIDEVAPVGAGTGDGDASASAALPQPSDVAEALLVVQTPKSTTFAEASPCGTDAEASH

SEQ ID NO: 83623 - DNA, 1003 bp, Zea mays
  misc_feature: Ceres CLONE 1569581
  misc_feature: Translation starting site: 128
  misc_feature (394)..(394): n is a, c, t, g, unknown, or other
ccccgcggtggcggccgctctagaactagtggatcccccgggctgcaggaattcgtctcacccctagaaaaaggatgcaacgccttccacacttgaagcagccaagctaagtgaggtgagcttagccatgccgacggcttcctctgcccaccgctcactcctcctctgcctctgcctggctctgctctccaacccggtcgccgcctcgccctcgccccgcggcctccgcttctccgccaaggacatcgcggcggtggaggccgcgctgccgcgacacggcagcagggcgtcgtcgtcgtccaagaacaccttcttcgaggtcgaccgcccgctccgcccgcccagggggcagctcggggccctgctccacgctgctgctctcgcactccctccnccttcacgctcaccaagccggcccgtcaccgcggcctactcgccgccgccgtgcctgtccggctccgacgcgcccgccggtctcgctcgccgttgctcaagtggcgccgcctagtgcccccggcgccccaataccacccgcaacttttcggcgtgtggcttcgggcggcgccccaactcctgggccggcaagcaccgcggaagccgccgccccccggccggggtgggtcctgggtcaggtcccccaaaggacgtcccccccgcgaacggcgggcccctccctccgcgggcccgggaaaacccccccccctcccctggtctaccctcggggaaacctcattcgaacgaaacccctacaaaagggggttcttacaaggccaaaaccttaagggttctcaccttttatttttccgcccagggggggtgggggcggttctggccggccgccggccccccgaaaaaataccctgcgttcccgggtgttccaggaaccggccccctcaaaaaaacggggtttgtgttttcctcccccaaaaacaaaaacccaacagtgcagttcccccccccctttttcggtgccccccaaaaaacatttacccgccccctccct

SEQ ID NO: 83624 - DNA, 972 bp, Zea mays
  misc_feature: Ceres CLONE 1569584
  misc_feature: Encodes the peptide sequence at SEQ ID NO. 83625
ctccccgcggtggcggccgctctagaactagtggatcccccgggctgcaggaattcgtctcacccctagaaaaagccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtcccctggtgctcctgcaacatcttctccacgcaggaccacgccgccgccgccatcgcgcgcgactcgggcgccgtgttcgcctggaaggggggagacccttgaggagtactggtggtgcaccgagcgctgccttgactggggcgaggcggggcggccccgacctcatcgtcgacgacggcggcgacgccacgctggtcatccacaagggtgtcagggccgtaggaggattacaaaaagacccggcagatccccgaccccggagtccaccgacaacgcctgaattccagatcggggctccccatcatccccgaaggggttcagggctgacccccaagaattacccccaaaataaagaaaaagcttgtccggcctccctaaagaaaccaccccggggggtcaaaaggccctcccagaatgcagaagaccggggccctcctcttccctggcattaacttaaccaatctcctccccaaaagcaattttgacacccggtttggtttgccccccccccccccctattgttcttttaaggccccccccccttatatatccccggaaaggttgcccgtgtctccaaaa

SEQ ID NO: 83625 - protein, 114 aa, Zea mays
  misc_feature: Ceres CLONE 1569584
  misc_feature (12)..(114): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVPWCSCNIFSTQDHAAAAIARDSGAVFAWKGGDP

SEQ ID NO: 83626 - DNA, 1041 bp, Zea mays
  misc_feature: Ceres CLONE 1569585
tccccgcggtggcggccgctctagaactagtggatcccccgggctgcaggaattcgtctcacccctagaaaaaaacgcctcttctccccccccaaaaaatccagcagcagcagcaagccccacgcaacattagcagcaggagaccaccccaatcccccacggacattcgtcgcgaacccttatctgcacgccgcgccatggccgcagccgccgcggtcgcccacctctccatccacggccgcctccgccgctcaccggagcatcggccgtccatcaccaccaccaccacctcctcctcttcctcgtccgctcaccgcccgtccctcctgcggtgccgcgcgttcaagcaggaggccggcgacggcgacccggctgaggccgacgcgcggaaacccaagaagggcccgctgtacaagctcaagggggcgatccagggcctcgcgggatcccgctccgccgccgccgaggtgtacggggggagagtaccagtaccagcgcgcccccgagaaggcggaggagaatcttcttctcgggtggctactcagctaagcagatatgtttatccctatgatggagcagccggggtggtacttggggggtggattcccaactggttcggggggagaacagccaaattgaacgaacctaatttgggtaataacctggccttggggggggggggaattattcggccccaatggattgggggcaaaacaggggggcctaagaaggaaacacctgccaaagattgggaccctccccaagggtcgttcttaaaccgggaaaccccaagaagggttttaggaaaaaacccctttgcccccggagattttcttcctctcctggaaacccgggggttggaatttaccttcccgagaagtcctgaaatcagtccctctcaaaacattaaaaaaaacctttgagaataaccttcgcggagaggggttttccggtgtcccaaaaagaaacaaagaaaaattttctttccacatgcacagggtgttgggggacacaatttgtgatttctggtaacccggaaaa

SEQ ID NO: 83627 - DNA, 950 bp, Zea mays
  misc_feature: Ceres CLONE 1569586
  misc_feature: Encodes the peptide sequence at SEQ ID NO. 83628
gcggtggcggccgctctagaactagtggatcccccgggctgcaggaattcgtctcacccctagaaaatccccgaaaccccacttctcggatcgagactagggttagggttttgtcactcccgccccgattcgaaccaatccgcctaggcccccgccgcgccatggccgccggttccattgtggtggacttcccctccatgggcgccgccctctgcttccccaacctcgaatcactcctccgagactccgcctcgggtttcctctccgccgtctccgccgccccggcccccggcgccgccgacctcaccaacttccaccgcgtcttctcgcgcgtcctcagcacctactcagacccgccgctcgaggtcgtctggttcttctccgcgctccccttccacgcccgccctgacgacctccgctcactgctccagctcctctccgccttcgccgcttcctcgcctggggccgccaagccgctcgccctcctcgcccccgtcgtctccgagcttttccactcagataagccgcgcagggagaccgaggccgtcgtcgaggctgtcctcagctacatcagcatctgcagcagtcgccccgccccctcttcgactgaaagggacaccgccgacgctgtgagggtgctgccggctttcggcgatcttgtcaaagtgtggaacgtgcggcacctcagggagaggggccccgttccaggggtgttcccccccccctgggaacaagcccaggcgggagctcataaaggaaagctgcaccgttgactaccccccctggggggggggctggttaaagctttcccttccagggctttgccctcaaggggcaaaaggcaaaagggatggccccccctcttaacctgcaaaggagactcaaaatctgggggatcaactcccttcccgggtcttccaaaaccaccaatttcttccggggcccggtgt

SEQ ID NO: 83628 - protein, 203 aa, Zea mays
  misc_feature: Ceres CLONE 1569586
MAAGSIVVDFPSMGAALCFPNLESLLRDSASGFLSAVSAAPAPGAADLTNFHRVFSRVLSTYSDPPLEVVWFFSALPFHARPDDLRSLLQLLSAFAASSPGAAKPLALLAPVVSELFHSDKPRRETEAVVEAVLSYISICSSRPAPSSTERDTADAVRVLPAFGDLVKVWNVRHLRERGPVPGVFPPPWEQAQAGAHKGKLHR

SEQ ID NO: 83629 - DNA, 936 bp, Zea mays
  misc_feature: Ceres CLONE 1569594
  misc_feature: Translation starting site: 193
  misc_feature: SWISSPROT Homolog: EC 5.4.2.2 Phosphoglucomutase
  misc_feature (864)..(864): n is a, c, t, g, unknown, or other
cccgcggtggcggccgctctagaactagtggatcccccgggctgcaggaattcgtctcacccctagaaaaacaccaccactccttccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgttttgggttggacaaaacagtctcatgtctactcctgctgtatctgctgtcatccggggaaagagttggtgcagatggatcaaaggctactgggtgctttcttcttgacagcgaggcataaccccggggggtcctaaggaggactttcgggatcaaatacacatggggaaatgggggggccggtcccggaatctggtacccaaaagatttttctctaatacaacgaacaatctcggaataccccctccccggaaaacctcccgaatgtggaattttctggtggcgggggcccccgcttcaggggacccaaggcccctttggaggggaaggtttttaactccgggggggattcccccaggttagtgaaaacattttttggccttcagaaaaaaaaaaagcgggggacctccccnaagtttacatttgtgttttgatgccccccggggggttggcggagtttttgcacaacacttcttgggggaaag

SEQ ID NO: 83630 - DNA, 902 bp, Zea mays
  misc_feature: Ceres CLONE 1569595
  misc_feature: Encodes the peptide sequence at SEQ ID NO. 83631
ctccccgcggtggcggccgctctagaactagtggatcccccgggctgcaggaattcgtctcacccctagaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatagctctggtgaacaaggcagggcgctccgtaagcttgaggatggatgtatccagagcctacctcgtgggcttacgtagcagggcagcgctcgtgcctcctcagagatcaggccgcaagttctcgtcggcgatctggttactacgggggcccgtgggggaaaagttcgggctcctggcctcacgcgaccgcgggcccattcccaggggcatggaccgtgcttgttcccgggtacggcaacggggaagatccctggggtcccggcctggccaaacaaaaatctcaaaaaggccttcctgtccgttttccggttcccccggggaacccctccaaaaaaaactgtaggggggggcccccccccctcaaaataatggggggaaaccggggaccttcccttaattttagggggaaaataccccggtttttggaca

SEQ ID NO: 83631 - protein, 215 aa, Zea mays
  misc_feature: Ceres CLONE 1569595
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNIALVNKAGRSVSLRMDVSRAYLVGLRSRAALVPPQRSGRKFSSAIWLLRGPVGEKFGLLASRDRGPIPRGMDRACSRVRQRGRSLGSRPGQTKISKRPSCPFSGSPGEPLQKKL

SEQ ID NO: 83632 - DNA, 949 bp, Zea mays
  misc_feature: Ceres CLONE 1569596
  misc_feature: Encodes the peptide sequence at SEQ ID NO. 83633
  misc_feature (557)..(557): n is a, c, t, g, unknown, or other
acccgcggtggcggccgctctagaactagtggatcccccgggctgcaggaattcgtctcacccctagaaaaaaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccacggccacggcaagacgggcaaggtgatgcacctgctgctctggggacccaagtgaagcggcgagaggccaccgtaccgccgggctctcccgctggcgttgctcgttttgctctgcctgcattccgccccgcacggactgtactgtacctatatatacacctacatactacgacgtgcacctgtactacgacgtgctgctgtaccatactaaatactagtgcgctgctgctccctngccttcttgcttgcacaggcactccgcttttttgctcgaacgatcgactgctcgtgtcccgtcgggccaccgccggtcgtcagtttgggtgtgtccactccactgtaaagctccttttttgggtactccctggctgccaaagtagccgaagtgtaccaggggtgggttgggaacaacaggttgttttacttcccaccccctctgggatgaaaaacccccgggctaaattttcctggcgtaaccaattttgggctttggattgggataaaaaggggaaaaaattgataggttttggactcccaaaaaaaaacaccccctttcttgattgtttaaagcggtttttccttcctttccccgtgaaatacaacctttcttccccgcccgttaagaag

SEQ ID NO: 83633 - protein, 70 aa, Zea mays
  misc_feature: Ceres CLONE 1569596
MSSGSESTTASRWPELATLRALARDAAEQLRLPRAGTSASASSPWRGREDHLHGHGKTGKVMHLLLWGPK

SEQ ID NO: 83634 - DNA, 987 bp, Zea mays
  misc_feature: Ceres CLONE 1569597
  misc_feature: Encodes the peptide sequence at SEQ ID NO. 83635
ccccgcggtggcggccgctctagaatagtggatcccccgggctgcaggaattcgtctcacccctagaaaaagcctcccccacagcatcggagaacggagggaaccagggagctccggccgcctagaaccggagctcccaaatagatcgatccatccgtcgttgagcggacacggcaatggaagcccacgcctcgcggggccgccgcaccctggaggagatccggcagaagagagccgccgagaggatgcagcacgccctcccgatcgcggcgtctcacgtcgactctcacgggaaccaaagagccggagctgagcttcttgctcgagttcaagaacttgaaaatgggaacacggaattggtgagggaaaacaaaatgctcttgtccaagattgacccacaagggagttgagaaggatgcccttgtaaaccgtttgaatgatctcgtgagtcaagagtatatttgtataggtgctgagctcccgggtttgggttctctttttttttggcatgaattgttttccgcaggagcggaatgtagtttccctccttgaaaaaaaacttgaatgacattttcttttgaagaaagatgctgctggtatttgctaaaagaagaaggctccttgctccaactcgggaagcattgaagaaaccggctctagggaagccagaagaaagaacggtttaaagggagaaaaaaaaacccccccctcctttgaaaacacagcttaaaacaccctggccgccgcaagggaatggggaacccccttacaaggggaatttccaaaggggaataatcggggtgagggaacccgttggccctgggaaaagggagatacaaaatttcccgggcccgcttaaagaaagagccccgcctccaaacacgcgggggcccaaaatgtttttgaaaggtctcaccctgtggcgcccaggagcagaaaaccccccgaaaaaaaaatcccttttggctccgtggggggagaagaaaa

SEQ ID NO: 83635 - protein, 77 aa, Zea mays
  misc_feature: Ceres CLONE 1569597
MEAHASRGRRTLEEIRQKRAAERMQHALPIAASHVDSHGNQRAGAELLARVQELENGNTELVRENKMLLSKIDPQGS

SEQ ID NO: 83636 - DNA, 869 bp, Zea mays
  misc_feature: Ceres CLONE 1569600
  misc_feature: Encodes the peptide sequence at SEQ ID NO. 83637
ctcaccgcggtggcggccgctctagaactagtggatcccccgggctgcaggaattcgtctcacccctagaaaaaatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaaacaggcagggcgctccgtaagcttgaagatggatgtatccagagcctacttcgtggcttacgtagcagggcagcgctcgtgcctcctcaagagatcaggccgcacgttctcgtcggcgatctgttactacggtggcccgtggggaaacaagtcggctcctgtcgtcacgcgaccgcggttcactcgcaagggcagtgaccgtgctgctgccggcgacgcgaacgggaagaatctgggggtcccgcattgccagcaatatatttcaagagccctctcgtccctgttcctgttcccactggaaccctaccaaaagaccttaaggggggcctccccccctgccaactaatggggggaagcccgggaactttccgttagttaaggggcggaa

SEQ ID NO: 83637 - protein, 220 aa, Zea mays
  misc_feature: Ceres CLONE 1569600
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVKQAGRSVSLKMDVSRAYFVAYVAGQRSCLLKRSGRTFSSAICYYGGPWGNKSAPVVTRPRFTRKGSDRAAAGDANGKNLGVPHCQQYISRALSSLFLFPLEPYQKTLRGASPPAN

SEQ ID NO: 83638 - DNA, 948 bp, Zea mays
  misc_feature: Ceres CLONE 1569601
  misc_feature (590)..(590): n is a, c, t, g, unknown, or other
  misc_feature (591)..(591): n is a, c, t, g, unknown, or other
ggagctccccgcggtggcggccgctctagaactagtggatcccccgggctgcaggaattcgtctcaccccctagaaaaaaatggtcaactgggggtaaacaagcttgaaaaatgctgacagtggcacaaattagcatagatcactttgtatttttcaaaaagcagcttgtctgtagacagggattttctactgtatgtaggcttaattgggtaggcttgctggtgagtatagtatttatagttccttcagattagctatgaaagctatcactgctaccaaattttggttgtggagcaatcagcaaccttacacaatactaattgcatctctcaactcctagagtcgaagatccatcgattttgtgcataaggggtatacatcactcacttggtatttatcacctttctgttaacttcgttatcattctgtttgtttggaaaacgaaggctgaacaatttcaccgatggagggcaaactggtatagtatttagttctatcgtacaccctttcccttagtataaaatcccctggtaaggggatatccaatttatttcccaacgtatgccaaatcggcagacagcgctttccnntcaaactgtgtgatctgtgctggattcactcctcgtgtggagctctacatgtgcaaggttagcacggctgttttagggcttatgccctgtctgtcgtgcagcataaatatgctaaaaattaaagaacaaacccatttcaactaaaattttacatattcttaactgcaaggggactttcttaatggaaaattgttcattactaaaattgatctttccagggtcgccttggtactgaaaaaaatacaggtaaaccttagaggattgcctttctttgagttgggccccccccagaactgaaaaatgcctcaacaacccaatgggaaaaaagggacaaccggggggtttatttgagtttaa

SEQ ID NO: 83639 - DNA, 969 bp, Zea mays
  misc_feature: Ceres CLONE 1569603
  misc_feature: Encodes the peptide sequence at SEQ ID NO. 83640
ctccccgcggtggcggccgctctagaactagtggatcccccgggctgcaggaattcgtctcacccctagaaaaactccgggaccccgtcgccgccgacatcctcatgtcggccggcgccgactggtcgctgcagaacgccgacggctggtccgcgctccaggaggccgtctgcacgcgcgaggaggccatcgccaccatcatcgcgcgccactaccagccgctcgcctgggccaagtggtgccgccgcctcccgcgcatcctcgcctccatctcccgcatccgcgacttctacatggagatctccttccacttcgagtcctccgtcatcccgttcatcggccgcatcgcgccctccgacacctaccgcatctggaagcgcggcgccgcgctccggaccgacatgacgctcgctggcttcgacggcttccgcatccagcgctcggaccagacgttcctcttcctcggtgacggcgccaggcccgaggatgccgggggcaaggagctgcactcgggctcgctaatagtgctggcgcacaaggataaggagattacggatgcgctggagggggcgggggtgcagcccacagagtctgaggtgccgcatgaggtagcgctccatgtcaagaccaacatggaccgtccggggatcgaacgtccccaggcagaactcgtgccgcacttgaattggcgccccccagaagagaaaaaaagccgtcggggaatgaaaagccaaggtggatgaaatggctgaatggcctggtcacccggaaatcttaggccctggccgggggcgaaaaaaagacgagaagctgttgccctggagggggggggaaaaaaaatgggaggggggcccaacttggggctagattaaccaaatggttgacgccccaaggaaagaagcaacctgtgttctgcccttgggatgggagaccacaaaaaagattttagggagaagggcgccaaaaggt

SEQ ID NO: 83640 - protein, 246 aa, Zea mays
  misc_feature: Ceres CLONE 1569603
PRGGGRSRTSGSPGLQEFVSPLEKLRDPVAADILMSAGADWSLQNADGWSALQEAVCTREEAIATIIARHYQPLAWAKWCRRLPRILASISRIRDFYMEISFHFESSVIPFIGRIAPSDTYRIWKRGAALRTDMTLAGFDGFRIQRSDQTFLFLGDGARPEDAGGKELHSGSLIVLAHKDKEITDALEGAGVQPTESEVPHEVALHVKTNMDRPGIERPQAELVPHLNWRPPEEKKSRRGMKSQGG

SEQ ID NO: 83641 - DNA, 933 bp, Zea mays
  misc_feature: Ceres CLONE 1569604
  misc_feature: Encodes the peptide sequence at SEQ ID NO. 83642
ctcaccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccacctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccacgaccccgacctcatagacatcctcgccaccaacggggtcgacatctccgtctccgagggcgagtccgcgggcccgggcggcttcttcgccttcgtcggcaacttcttcttccctttttatcggttcgctgggctcttcttcctcttccccgccgcgaaggcgggccgggccccgggctggtggcctcggggggcccaggaatttcgcccgctcaaaacaagttcaggaagtgcctgaaacgggggcacccttcctgaaggtgccgggcggaaccagccaagctcagacgggggaagtcgtcatttccctagaacccccaaagaaaccgcgcctcgagaccaaatccc

SEQ ID NO: 83642 - protein, 151 aa, Zea mays
  misc_feature: Ceres CLONE 1569604
MAPPSVSASHLLITASLPKPKPSSLRPPRLPVAKPLPASAALLALAASPALAADAPAPAPAPIPAPAPELQAEAPTPTVNPFSTSLLTAPKPSAAASDLPEGAQWRYSEFLSAVKRGKVERVRFSKDGGLLQLTAVDGRRATVVVPTTPTS

SEQ ID NO: 83643 - DNA, 873 bp, Zea mays
  misc_feature: Ceres CLONE 1569605
  misc_feature: Encodes the peptide sequence at SEQ ID NO. 83644
  misc_feature (773)..(773): n is a, c, t, g, unknown, or other
  misc_feature (825)..(825): n is a, c, t, g, unknown, or other
tccccgcggtggcggccgctctagaactagtggatcccccgggctgcaggaattcgtctcacccctagaaaaagctttctcctccccgtcgacctcgccaatctccctcccgctaaccctagtccagcacccgagatctactccgcgcaaacagccatggcggagacgctcgacatgaccctcgacgacatcatcaagaacaacaagaagagtaactcctcatctcgcggggcccgccgcagccgcggcggatccgcccctggcggcgggaccggcggggtcgggccgaccaggcgcccctttaaaagggctgggaacaggcaggcgccctaccagccgccgaaggcccccgacgctgcgtggcagcacgacatgtaccctgcggtcgccgcaagaggcggcggcggcgggagggtctcggctctcgagacgggcgccaagctctacatctccaacctggactttgggggttcgaacgaggatattaaggagcttttctctgagctaggtgatttgaagcgtttttcgataaaatatgatcgaagtgggaggtctaagggaacagctgaagttgtatttgcaaggcgttctgatgctgtagcggcgggtaagaaatatgacaatgtccaacttgatggtaagcccatgaagatagagatagttgggtacaatactccagctgcagcagctgctcatccagtccctaatggtggtcatgctaagaatgctgcgaggagggcaccaaaggatgctgctccagcagtatgtcgcancatagacccatcaaaggggcgggaggcctgctgcctgaactggtggtggtcnccctggcaaagacgcacccagccaagccactgaagactccaggccgaa

SEQ ID NO: 83644 - protein, 233 aa, Zea mays
  misc_feature: Ceres CLONE 1569605
  misc_feature (96)..(166): Pfam Name: RRM_1 Pfam Description: RNA recognition motif. (a.k.a. RRM, RBD, or RNP domain)
  misc_feature (206)..(206): Xaa is any aa, unknown, or other
MAETLDMTLDDIIKNNKKSNSSSRGARRSRGGSAPGGGTGGVGPTRRPFKRAGNRQAPYQPPKAPDAAWQHDMYPAVAARGGGGGRVSALETGAKLYISNLDFGGSNEDIKELFSELGDLKRFSIKYDRSGRSKGTAEVVFARRSDAVAAGKKYDNVQLDGKPMKIEIVGYNTPAAAAAHPVPNGGHAKNAARRAPKDAAPAVCRXIDPSKGREACCLNWWWSPWQRRTQPSH

SEQ ID NO: 83645 - DNA, 891 bp, Zea mays
  misc_feature: Ceres CLONE 1569606
  misc_feature (645)..(645): n is a, c, t, g, unknown, or other
  misc_feature (845)..(845): n is a, c, t, g, unknown, or other
ctccccgcggtggcggccgctctagaactagtggatcccccgggctgcaggaattcgtctcacccctagaaaaacttggtggtagtagcaaatattcaaatgagaactttgaaggccgaagaggagaaaggttccatgtgaacggcacttgcacatgggtaagccgatcctaagggacgggggaaacccggcagatagcgtgatcacgcgcgtcacccgaaagggaatcgggttaagatttcccgagccgggacgtggcggcagacggcgacgttaggaagtccggagacgccggcgggggcctcgggaagagttatcttttctgcttaacggcccgccaaccctggaatcggttcagccggaggtagggtccagcggccggaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaacaatgtaggcaagggaagtcggcaaaacggatccgtaacttcgggaaaaggattggctctgagggttgggctcgggggtcccggccccgaacccgtcggctgctggcggaatgctcgagctgctcncgcggcgaaagcgggccgccccgtgccggccgggggacggaacgggaacggcccccctcgggggcttccccgggcgttcaacaaccgactcatatctggtacggacagggggaatccgactgtttaattaaaacaaatcgacctgggcgggacccagccgccccccgtcggccttctgtttctcctccccttccctttcngggcccccaggctcacttttccgctcggaatcttcaactgaaagaa

SEQ ID NO: 83646 - DNA, 959 bp, Zea mays
  misc_feature: Ceres CLONE 1569607
gcggtggcggccgctctagaactagtggatcccccgggctgcaggaattcgtctcacccctagaaaaaccccccccccccccccgcaccatcctggtctcaccgtcactacgaccgatcttgctcgccactcgcctccctggctctctccctacttcccatgctgatctcggcgtaaggcagactgatcccggcgcctgttctcagcgctctcctttttttttttcttcatccggttcatgcatgttctgcggttgttgtttacttataccctttgagatttcgctcttgcggattctccaacctgtgtttatgtccccctgcatttccttgtccggtgccacctcacgtctcctcacctagcaaagtagcggtcattttaatgggaccccctccacatcaagctctctaatctgcgcttctcttaattaatttattcgcccacaagcgggtgctggatcctttggggttccccatccggccaagaatcctgcaagaacctgcttgaagttggagccggccaaacctgctgccctcgacgtctcgggggaaggcaaccttcagcatcagtctccttgaccaagcaagcagggccatggatgagcttcaagggaacccaagggggttcggccaggggtcccggagcccgggatgaacccaggcctcccatgggggccgcccccggccgaaacccccctgcccgggggggggggggggcccacttcttgtccggggaaaccgggccccgtgtccccggaggaaggcccccgggacccccatttccagattgggccgggggccctccagggtcccccggatccacgccccccacggggaggacaccggagggccccaaaccctcggggtccaaggaaattggaaccggggggaaaagaaaaaaacccaaaaaaccttccccgggtgtcctcagtgccttgcagaaaaaaagggggtttgaaa

SEQ ID NO: 83647 - DNA, 755 bp, Zea mays
  misc_feature: Ceres CLONE 1569608
  misc_feature (414)..(414): n is a, c, t, g, unknown, or other
tccccgcggtggcggccgctctagaactagtggatcccccgggctgcaggattcgtctcacccctagaaaaagaaagagggaagccgcaggcagcatctgcatctctcgcccacctccgctccgcctactgctgctggtggtagggaggcggagaaggaggcccttgcgcccgcccgccggccggatcagagccgtagcaaccccacccatggcggacgtgcacgaacctttggtgcgccgtaagagaaagaaggttttggtggactactttggtgaagttccgatggatcctcgtgatcttcgtgggtccttcctatttcaacctctgatctactttcaacatccttccctggggcgaacttgtgggtcccgccctttaaaagccggaaaaaaaaaaagcccccccaaaaaanccagccacggaaccgaaaaaaccgtggccaaaaaagtggccccgtggaaaacccgggcccccataagctccaaaagggaaaacccccccaataaaaaaagggaaaccgggttctttttttttttttttcacccccgggccccccaagataaaatcccccccctgggggaaatatcccccttttttttttgggggccaattttcccccccacacaaaacgggggggggggcacccccccccccacatggacactcttttgtccccaaaaaagaagagaataattttttttttctccacgagaggggggggtgtctaaaaaacacaaccctctttgtttcttt

SEQ ID NO: 83648 - DNA, 962 bp, Zea mays
  misc_feature: Ceres CLONE 1569609
ctccccgcggtggcggccgctctagaactagtggatcccccgggctgcaggaattcgtctcacccctagaaaaactgcctgcccgcacccctttctcatcatttcttccacgatcccgttccatcctctctctctctcctcggcgcgggcgctatctttatccgtctcagccagggcgggtcagcactcagcaggcgcgagagatacaggagagaaaccgcagggccgccgccgccttccctgatcgaccgctcccgcgtgcggattcaggcgccgggctttccagccatggttcagtgagccgggaggaatccttgcgctgccggagaaggattatattcgtcggtggacaggaggtccctgcgtgcatcgatcgtctcccgggtttccgaaaacaccctccgcccccggattcactgcttcgattgattcgtcaagcaagcacagggatatcttcacgagaagtgtcatcatcaagattgacagccttcttcgtggatggcgaatggtaacaatgaagtgatgggtatatctcagccgcaaatcttgccccaaggttcacagctcaatgtgtagtgagctgacaatgatgttggataaggtctcttctattcttccatcaatagaggctgcacgaccagggttgtaaagcaggcctacaggaattatgccatccttacaatgttgtcgaagaaaggaagctcataatcataccctgcattggactgtagtaagctctatttggctattaccgaaaagacgattgtacgcagatgtgaaaaaataagaaccccctggagcgggaatttgttccttattcagaaatagggttcacccgccctacctaatcagatggctaaagtcacaatgatctccgggatgtaaatttcctcttggtcaaatgaaaaaaaggctggcaaacccttgttccaatctcccggagtctgaccaagtgaaaattt

SEQ ID NO: 83649 - DNA, 1057 bp, Zea mays
  misc_feature: Ceres CLONE 1569610
  misc_feature: Encodes the peptide sequence at SEQ ID NO. 83650
  misc_feature (441)..(441): n is a, c, t, g, unknown, or other
  misc_feature (800)..(800): n is a, c, t, g, unknown, or other
ctccccgcggtggcggccgctctagaactagtggatcccccgggctgcaggaattcgtctcacccctagaaaaaacgcgcctttccccactgcaccaggcaacccaccagcaggccgcagttcacgcttggctgacgaccgacccccattcgttctagccctccctccgacactccgatccattactcgctatggacgcggcgggcggcgaccagctaagcctggccgcggtgcgcgacgcgctggtgcggctggaggactccgtggtgttcgcgctcatcgagcgcgcccggcatccgcggaacgcgccagcctacgcgcccgccgccaccgctgacagacattcgctcgtggagttcttcgtccgggatgcagaggcccttcacgcaaaagccacccctctttctttttttcgtgcttttccttgttcctcccctcagnttccctctgttaattaagaacttggttttgccctggcctgggatggaggaaactacccgggaaggggggccaaaaccactggcccccccccaaagtttcttggggccggggaagaaaccctttcggttttggtttttttggaaaaacgggggcccagcctttacctttggaaattccaggggggtggaaaagaatttttttaaaaaccgccctaaaaacaccccccccgttgggggtgtgtgtgttttggggaaattcccgcccggagaacccgtgaaaaggggctccacggtttttcccccccttttggggaaaatttccccctactttttttgggtcgcggggggaaaaatgccccncccttcttgggggtttggttctaaaaaaaaaaatttttgggccccgagaaaaagaaaaaaaacacccccccccccggagattttatttttcttaaaaaataaatcctccaaaaactttttctccgggcggacaaaaaatattgtcgagacggtggggcgccccctcccatttgtaaaaacaacaacaacaaaggggggggggggggggggagaacaaaaaagaagggttttttttacaccacaaaaaaatttgcccc

SEQ ID NO: 83650 - protein, 88 aa, Zea mays
  misc_feature: Ceres CLONE 1569610
  misc_feature: SWISSPROT Homolog: EC 5.4.99.5 Chorismate mutase
  misc_feature (84)..(84): Xaa is any aa, unknown, or other
MDAAGGDQLSLAAVRDALVRLEDSVVFALIERARHPRNAPAYAPAATADRHSLVEFFVRDAEALHAKATPLSFFRAFPCSSPQXPSVN

SEQ ID NO: 83651 - DNA, 965 bp, Zea mays
  misc_feature: Ceres CLONE 1569613
  misc_feature: Encodes the peptide sequence at SEQ ID NO. 83652
  misc_feature (370)..(370): n is a, c, t, g, unknown, or other
ccccgcggtggcggccgctctagaactagtggatcccccgggctgcaggaattcgtctcacccctagaaaaaaaaaaaaaatctcccacaccacagctcccacacacagcaggcagcagctcgatcgctagctcctccgaaccggaaagccaagcccgctttggcgatcgtgcttgcttgcttggttccttcaattcctgccggagccagcgagagctagctgctgctgtcgcgtggtagacgtcgtcttgccagcgagagcctagctcgatcggtctctctggtacaacgtagggagaaagatcgagggggagaggacgacgacgatggccggcgcgaccgtgaccgtggaagaggtgaggaaggccancgcgccaccggccccgccaccgcgctggcgatcggcaccgccacgcccgccaactgcgtgtaccaggccgactacccggactactacttccggatcaccaagagcgagcacctcaccgacctcaaggagaaattcaagaggatgtgcgacaagtcgatgttccggaagcgttacttgcacctgacggaggagttcctggcggagaacccgagcatgtgggcctacatggcgcccgtccgctgggacccgccgcaggacttggtggtgggtggaagtgcccaaaactgggggaaaggcggcgggcccaaaaaggcgatcaaggaggggggggcacccaatgtcgcggaacacccccctggtggtctgccccccgtccgggggggaaattgcgggggccccaataccatttgaacaaggcccttggcccgggggccttccggaaccccctccgtttttccaaagggggggtttcccggggggacggggtttcccctggccaagacccccggaaaaaaaccccgcgcccggggggggggggtttccccaaaaaccgcccgtccgttcggggccccccaaatccctttattcggtgtgg

SEQ ID NO: 83652 - protein, 89 aa, Zea mays
  misc_feature: Ceres CLONE 1569613
  misc_feature: SWISSPROT Homolog: EC 2.3.1.74 Naringenin-chalcone synthase
MCDKSMFRKRYLHLTEEFLAENPSMWAYMAPVRWDPPQDLVVGGSAQNWGKGGGPKKAIKEGGAPNVAEHPPGGLPPVRGGNCGGPNTI

SEQ ID NO: 83653 - DNA, 1052 bp, Zea mays
  misc_feature: Ceres CLONE 1569614
  misc_feature: Encodes the peptide sequence at SEQ ID NO. 83654
gcggtggcggccgctctagaactagtggatcccccgggctgcaggaattcgtctcacccctagaaaaatcgccaccccaccctcctcctcctccctgtctttctcccccctctctctcccactcttgacaaattttcctccacccattcccttcctcccctcttcttcttctccacccactccaccgatccccctctttctctctgaattctctctcgtcgtgcccacccttcccatctgtctgctgcccctctctcgcaatcagtcactcggctcttgtttcttccgtctgctgggttgattctctctctttctctccgtggagaacaggaggagagagacggaagaagagaatcggaaccagcctgttctttttgcctggattgccgttcttgccaagttgttcaaaaaactcggggccagtttccgggccctttaaaactacgggaaagaagaaaccatcagagatgcccaaggcacccaaaaaaattgaatttccaaatggccccacccttgggaacctccataaaggggaagggaccaaaaggaaattcttttggggaacatttctcgcgggaaaggcttttggggatttccaacctttggccatcccagagtctcgagggaaaccccctggggtaggggattcccaaccgctccaaattttggggaaaataatatggtctctctgggggtcaccggtaaaaaacacccaactatatccccccccagaggggtttatcacaaatagcgcgcccccacatggtggtgccccgccccgctgccccctattgtggaaatagcgacacccccccacgagagtggggccacttttcctgtgggtgtctccgggggtaatcggcggagaaaaaaagttttcgggcgcccgctgcgacaaaataatggggggacctctttataatgttcagaaacaaaacccctctaatttgtgggggggggggagggcacctaaaatttgttaaaacacccatggttcaccaacaaaggccctctcccgggggggtgaacaccctccccgcccgccattgtcg

SEQ ID NO: 83654 - protein, 111 aa, Zea mays
  misc_feature: Ceres CLONE 1569614
MPKAPKKIEFPNGPTLGNLHKGEGTKRKFFWGTFLAGKAFGDFQPLAIPESRGKPPGVGDSQPLQILGKIIWSLWGSPVKNTQLYPPPEGFITNSAPPHGGAPPRCPLLWK

SEQ ID NO: 83655 - DNA, 1007 bp, Zea mays
  misc_feature: Ceres CLONE 1569616
  misc_feature: Encodes the peptide sequence at SEQ ID NO. 83656
acccgcggtggcggccgctctagaactagtggatcccccgggctgcaggaattcgtctcacccctagaaaaacgctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgcccgggggatccaccgctgaccttaccctcgaaatcgccaaccgtatgccagaacatggtgtgtgtggaaaccatgatgcacctgacatgtaccaaacatgcccagtagagaagattgaccatgcccttggaaaccatcaaatccaatgggattcaaaatgtttttggcccctcagaggggatccctccacatgggcaagacaaattttgtgcaagtttgaaagcgggatttgcttgtgctctttgattttgtggcagcatatttagagccaaagtaccggtgattattttgggcttaacttgtaggctggtttatccagaaggcaaacccccggagtgcaattacaagggtggagggagggtggctacttttggaaagcattttagccattgattcttggcgtactttaaaagagaaaagggttgaatgctgggtgcctaacccctttttgttaccccaacttttcttatgaatacccgacatctttcccccaaattttgggaaatgacctgccccccaaattgggttttaccttgtccccattggttccggggcattattgccaattaattacctcccaagggttcctggcccatgactggggttctccaaaactaaaaacccctcggagatccccgccgcgcctagaccctatcaaaagaaatggaggggctggtagcaaaatgggaatccccctggggacgggaa

SEQ ID NO: 83656 - protein, 60 aa, Zea mays
  misc_feature: Ceres CLONE 1569616
  misc_feature: SWISSPROT Homolog: EC 1.5.1.20 Methylenetetrahydrofolate reductase (NAD(P)H)
MKVIEKILEAAGDGRTAFSFEYFPPKTEEGVENLFERMDRMVAHGPSFCDITWGARGIHR

SEQ ID NO: 83657 - DNA, 972 bp, Zea mays
  misc_feature: Ceres CLONE 1569617
  misc_feature: Encodes the peptide sequence at SEQ ID NO. 83658
  misc_feature (62)..(62): n is a, c, t, g, unknown, or other
  misc_feature (71)..(71): n is a, c, t, g, unknown, or other
  misc_feature (72)..(72): n is a, c, t, g, unknown, or other
  misc_feature (74)..(74): n is a, c, t, g, unknown, or other
  misc_feature (75)..(75): n is a, c, t, g, unknown, or other
  misc_feature (82)..(82): n is a, c, t, g, unknown, or other
  misc_feature (83)..(83): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (148)..(148): n is a, c, t, g, unknown, or other
  misc_feature (879)..(879): n is a, c, t, g, unknown, or other
  misc_feature (880)..(880): n is a, c, t, g, unknown, or other
ttgtgttgtttgtgtttacctcttttctgccgaagtatatttttcccttcttttctcctttntctcccatnntnnccccctnnctnnngaaaactgggaactccacccccgggtggcggccgctctagaactagtggatcccccgggnctgcaggaattcgtctcacccctagaaaaagaggtgggtattcgaccgccaagcgccaactgcttagctcactcgtacatcgccacatcggtgaagtggtgtcgtggtgaccatagcgcctggcctcctcgctgccgccgccatgctggccgcggtggcggcgtccctcgcggcccacgtcgcgctcaaactgcccgtgcagccggggccgtcgaatcgcccgccgcccactccgccgcccaaaaacctactaacaggtaaacgaaccctccccgcgaaaaacctttgatcatttcttgccaagtaccttttcccttccccccccccccctgcctaaaattgaaccctggggggccttccggaaaaccaaattcaaaattggttaaaaggggcggggcccccccgtgcccaaaaagcccggaaaaaaaaactccccggggaaaaaaggggccccccttgaaaaacccccccccgaaaaaaaacactttttaaaattgggaaaaaacaccgcccctccaaagaaccccgggggcccccctctttaaaaacaggggcccccccaaaaaggaaaaacgggcctgggtgttttcccaaccgggaaaaaataaatctccccccccccaaaaaaaaaaaaaggcgcctcccctgaggaaaaacaacccgtttggccctctttttttctttttggaggggacacaaaaggggggcctcttctccccttggggagagannccccccccccccttttctcccccacaaaatggagggcccccccgggggcccctccccctcggggggaaaaaccaccccaaaaaaaagagggg

SEQ ID NO: 83658 - protein, 48 aa, Zea mays
  misc_feature: Ceres CLONE 1569617
MLAAVAASLAAHVALKLPVQPGPSNRPPPTPPPKNLLTGKRTLPAKNL

SEQ ID NO: 83659 - DNA, 1043 bp, Zea mays
  misc_feature: Ceres CLONE 1569618
  misc_feature: Encodes the peptide sequence at SEQ ID NO. 83660
  misc_feature (912)..(912): n is a, c, t, g, unknown, or other
  misc_feature (953)..(953): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (1043)..(1043): n is a, c, t, g, unknown, or other
tacccgcggtggcggccgctctagaactagtggatcccccgggctgcaggaattcgtctcacccctagaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggcctgagaagaggaggagaagatgaagaaaatgagcagctgcctctgccttccgaaaaaaaaaagaggggcccagcggaaggagaagccgtccacaaaatacccccaccttcgtcactcctttaagaaccaggaagccctccccaacactccaccttccttccctccaaaggctttcctccaaagggcattggaacccccaccgttcgaagcgccttggaaaaaacggggttccccaaagatttcaaagaaaccgagggccctattgaaaaaaaaaagccgggaaagccgggttccaaagacctcccttaaaggtgccggggcccagaaaacccccccgaggtaacactgggtggttttgggccctggtatcacaaaattcccccgggtggtggggcccccttccggtggacaaacttggggcccctgcccacccccccgcgaaagaggcattttctccccggttcccggaaaaaaccaccccccccactggtgtccccccccccctcctagagaagaaaatatatatgctgtgcgccggcgcccgcgggtgtcctccctctttnaaataatacccgccgagtggggggctctttatagggggaanannntcaatagggtgcgtataggacgccacaatgatcatcagggagagccatacagaggaggctctctcctccccccccaggaaacgcgn

SEQ ID NO: 83660 - protein, 51 aa, Zea mays; identical to SEQ ID NO: 82348
  misc_feature: Ceres CLONE 1569618

SEQ ID NO: 83661 - DNA, 986 bp, Zea mays
  misc_feature: Ceres CLONE 1569619
  misc_feature: Encodes the peptide sequence at SEQ ID NO. 83662
ctccccgcggtggcggccgctctagaactagtggatcccccgggctgcaggaattcgtctcacccctagaaaaattataacaatggcgaggcatttatggtggggcccagccttttagctcaaggaatatacgaagagggccagaaatcagtgtcggtctaccttcctgggaaggagtcatggtatgacttgagaaatggatctccatacaagggaagcgcgacacacaagctacaggttttagaagatagcattcccagcttccaaagggctggtacaattgtgccaagaaaggacagattcagacgcagttctactcagatggtgaatgatccatacactctggtgatagcactcaatagctcaggtgctggagaaggcgaactttatgtggatgacgggaaaagttatgagtaccagcaaggggcattcatccatcgccgatttgtctttgcagacaaatagctaacttcattcaatattgggcctgacgatttgggcaagaaatttagaagtgattgcgtgatttgaaagattattaatcctcggtttacgatcccggagtggagaaagctatttattgagccttggaaatcaagaactaggaaatggaatcagggccaattagttgtagggagtggttcccgcccagtttgcgccaacaattcgggaggcccaattgtttgcattgcaaaacagtttggactttaaggataagcctaaaagatgtatcggctttattgctgtcaaagactagaaaggattccggtccttccaaccattagtgttccctgattattggtttgaaccgattggaaagggagtgagggaaaattaccgggatggatgtttcggggtaacactacttttgcctatgggaaatagattgttaacaaatggcgggtaacgtttcaaaacctccggactggccccaaagggactgggaccacccctccctttaacccgtttttttgcccttccaccca

SEQ ID NO: 83662 - protein, 122 aa, Zea mays
  misc_feature: Ceres CLONE 1569619
  misc_feature: SWISSPROT Homolog: EC 3.2.1.84 Glucan 1,3-alpha-glucosidase
MVGPSLLAQGIYEEGQKSVSVYLPGKESWYDLRNGSPYKGSATHKLQVLEDSIPSFQRAGTIVPRKDRFRRSSTQMVNDPYTLVIALNSSGAGEGELYVDDGKSYEYQQGAFIHRRFVFADK

SEQ ID NO: 83663 - DNA, 1191 bp, Zea mays
  misc_feature: Ceres CLONE 1569620
  misc_feature (63)..(63): n is a, c, t, g, unknown, or other
tatcttttcctcgcgcgggtccgtgtggacggcggcacctctctaatgtgggtgtaacttttnctcacttttccccttctttttggtactccccgcggtggcggccgctctaaactagtggatcccccgggctgcaggattcgtctcacccctagaaaatatctcgcgactgctccccgacggacatcaagcttgctttccgccgcctcgcgctctcgctccaccccgacaagctgcccccgggttccgacctcgccgccgccaccgccgccttcaaggagcttcagcatgccccactctgtcctctctgaaccgcaggaacggggcctactacaactcccaccgctcccaaaacccccttctttgaaacaagctcccgccggggccaaaaccgtttccatttgcccccatattttttcccctcctttttttttttccccttttttccccgctttttctgaaaaggggcgcggggggtttcccaaagggtgcccccgccaagggtttgttggaaacggaaactcccccaaagaagttttgttctattctcccccggggaggggggggtccccccacccccccctgtggtcccccggggggttttgtgaatacccccccttcccccccccctttttggcggggggcacgcccccttttcaaaaatattaataagcccccgggggtttgcccccccccgccctttgttttctttagacaacagaggcgggcgtgtttgcgggggtgcccctccccctccgcgtgggggagaaacacccccccgccgttttttgcgggtgcactctccggggggggggtggtaccaacccacactcgcgcttgtgtttctccagtggaccaggccgggaggagagagaaaaaattaaaatgtcgtccgggtgggggtggcggcggccgcccgccttcttgtcttagatgaagggtggttagagaagtgggcggggggctctccttcttctcttttaaaaaaaatatccgcgcgggctggggtagatgaaaaaagctgccgcgtggtttttttggatccgccatcgtatgtgtgtgttggctctcttgcgtaacggaaatatcgcccgccccgcctccgtggtctttacacatacatacaattttgtcgcccggggtggaacggcaatatgtaagcaaccagctgttgtccgactgaagtaaaaa

SEQ ID NO: 83664 - DNA, 1068 bp, Zea mays
  misc_feature: Ceres CLONE 1569625
  misc_feature: Encodes the peptide sequence at SEQ ID NO. 83665
  misc_feature (10)..(10): n is a, c, t, g, unknown, or other
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gggggccttnnccnnnnnggggncnnaantannannnnnnnnnnnnnnnnnntttttttttttaaagctggagctccccgcggtggcggccgctctagaatagtggatcccccgggctgcaggaattcgtctcacccctagaaaaaactcccatggcatccgccgtcctgtgtgcccccgccacgcacctgcaagcgatcccacctggccaccagagtccagagacacagatacctaggtcccgagagcacgcaaccccgttcacaatcgcagccagccaccattatataaccccacgcctcccacctcccgctcggattccattccacctgtacggctgtaccccaccgccaccacccacggcacgctgcgcgcccaagcaaaccagggagcgcggccgaccgaccagccagacctgcgcaatcgaaaccgatcgactcccctattattggtccccatccccatggggcggcggctgagcgcgaccgccgccgccgcggcggcgtcggcggagccgctcctcccgccggcgctgaagcgcggggtgctgatcgagcggtgcgcgtcgcacgccgacgacgagctgcagtggttccgctcctgcctgcggtgggtgtgcatggaccactcgggcccgggccaggccgcgctgtcctggctcctcttcctcgtcctcgccgccatcgtcccggccgccgcgcacttcctccctcgcttccggggctcgcgccgccctttctcggccgtcgtgcagctctcgctctcgggcgccttcggccgcgggcttccttcttgctctccttcttcatccgccgggttgggcctccgccgcctgctccaactcgaaaagctccccaacaagagcgaccggctccggggccagctaaacggtggcgcctcgcctttttcttttcggcctcctttgcctcctttttgggggccttgctttcccgcccaaggcccgctataagagccgtgtgtttacgccacctcccgccaaccgtgtcccctttctttgccaaaagaagtccctagaggaagtctccgtttgtgccccccccaaagagg

SEQ ID NO: 83665 - protein, 168 aa, Zea mays
  misc_feature: Ceres CLONE 1569625
MGRRLSATAAAAAASAEPLLPPALKRGVLIERCASHADDELQWFRSCLRWVCMDHSGPGQAALSWLLFLVLAAIVPAAAHFLPRFRGSRRPFSAVVQLSLSGAFGRGLPSCSPSSSAGLGLRRLLQLEKLPNKSDRLRGQLNGGASPFSFRPPLPPFWGPCFPAQGPL

SEQ ID NO: 83666 - DNA, 906 bp, Zea mays
  misc_feature: Ceres CLONE 1569627
  misc_feature: Encodes the peptide sequence at SEQ ID NO. 83667
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (20)..(20): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
tgggcggtggttgnnntntntttcccttcccnngccnnaanngtctcccccccggtgccctttnnnnnnntcttnnnnnntaaaatgggactaccccggtggcggccgctctagactagtggatcccccgggctgcaggaattcgtctcacccctagaaaaactctcttttcccctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttagggaagctatgcatttctaaaaaggggggtctttcccacctttcaagccaaaaaaaaaaaaaggggggggaataggggaaaccccaaaacccttttccccccaaagggatttgggattcccccccaccaagaacccttttttatccaaaaaatttcggggggaaaattaagggcccccccccagagggaaggggggttaaaaaaaagcccctttttttataaaaaaaaaaaaaaagggggttttttttttttaaaaaaaaagaggggggggtgtaaaaaaaaaaaagggcccccccccacactatcttttttaaaaaaattttttttttaaaaaaaagggggggtgcgccccccccaaaaaagaagagagaggttccccccccaaacccgttggggggggggagggggcccccccccccccggttgattttgttgtaaaaaaaaaaaaaccccccccccccaaaaaaaggaagggggggggggccccccttttttttgttggttttaaaaaaaaaaaataaaccccccctttttttttttttcggggagagaaaaaaaaattttttttgggggggaaaaaa

SEQ ID NO: 83667 - protein, 42 aa, Zea mays
  misc_feature: Ceres CLONE 1569627
MPKHYRPAGKKKEGNAAKYITRTKAVNYLQVSLAIFREAMHF

SEQ ID NO: 83668 - DNA, 993 bp, Zea mays
  misc_feature: Ceres CLONE 1569628
  misc_feature: Encodes the peptide sequence at SEQ ID NO. 83669
tcttaactggtggatcccccgggctgcaggaattcgtctcacccctagaaaaaaaaccccaactcgcgatccatcgatttgcagaacaccacccaacagccaaaccatcactcgatcggtagacatggataaggcctacatcgccgccctctccgccgccgccctcttcttgctccactacctcctgggccggcgggccggcggcgagggcaaggccaaggccaagggctcgcgggggcggctcccgccgagccctccggcgaccccgttcctgggccacctccacctcgtcaaggccccgttccacggggggttgggcctcctcgcggcgcgcacgggccgggggttctccatggcccctgggaacccgccccccccccctctttccgctccccggattggcccgggaaatgctctccccgaacaccaacgtgaaatttttgtatcccccccccttttccccgtcgaatgacgggtggggtgcccttcaaaggggccgctggcgcctcctgtgggccagggggtggggccccctataaaggccgccacacgtggcgccccgcgacttcccccccacagggaaggagtcctttctcgggggacactcccccccgcggggggaagtgggcacccccccccccttccaaaaaaggctgaaagggtgggggggcccccgtgggtcggcggtaagaaactccacacccgactccctcccaccgacggaagggtgggaagaggtgggagattgtgagggtccgccaccccaccccacacccaccataaagcggttgttcgaccacgggtgtggctacgtccctaatgctgggtcgtgctggtgtaggacacaccggcccccaaccgacaacaacgatcgtcttgttgtggtggatgtatcaaactcccccacctccttctacgtgctcagtgatgcgggttgtgagcgctacaccgtgcgcggggaggtattggggtgttcccacgtagcacgccgtc

SEQ ID NO: 83669 - protein, 115 aa, Zea mays
  misc_feature: Ceres CLONE 1569628
MDKAYIAALSAAALFLLHYLLGRRAGGEGKAKAKGSRGRLPPSPPATPFLGHLHLVKAPFHGGLGLLAARTGRGFSMAPGNPPPPPLSAPRIGPGNALPEHQREIFVSPPLFPVE

SEQ ID NO: 83670 - DNA, 899 bp, Zea mays
  misc_feature: Ceres CLONE 1569629
  misc_feature: Encodes the peptide sequence at SEQ ID NO. 83671
gcggtggcggccgctctagaactagtggatcccccgggctgcaggaattcgtctcacccctagaaaaagaggccagggcatccacgaccacgacacggacacagggagccgcccgccatgccaccgcacggcggcatgctcgcgtacgccgccctcgcgctcgcggcgctgcggctgctgctgtcctacaagtcggcgctctacgcgctgcgccgcctgtggcggtgcgccgacgagtgggcgcaggcgtaccagtaccacgaggtgccgcgcttcgccggggcccagtgcgggtgcgacggcgcagagaacccgctgttccgcaaggtcgccgcgtacgtggcggcgctgccgtcgctggaggacgccgacgctgcgtgcgtggtgtcgtcggcgtcaaggaccaacggcgggctgtccctgcagctcggcccgggccacaccgcgagggacacgtaccttggcgcgcgcctcgcgtggaccagcgcgggcggcgagcgcctggtgctgcgcgtgcgccgccacgaccgctcccgcgtgctgcgaccttacctgcagcacgtggagtccgtggcagaggagatggagcagcgccgccgcgagctgcgcctcttcgcccacaccggcgtggacgcgaccacgggcgcgccgcgctgggcgtcggcgcccttcacccaccggccacgctcgacgccgtggccatggacccggactcaaagcccgcgtccgcgccgacctcgagagcttctcaaggccgcggctactacccacgctcgggcgcgtctggcgcgggactacctctctacggccgccggcacgggcagtcacgttccgggggcatggcaggtcctgggtagaagttagaatcaactgtttcggcaacgccccgggaaactccg

SEQ ID NO: 83671 - protein, 248 aa, Zea mays
  misc_feature: Ceres CLONE 1569629
MPPHGGMLAYAALALAALRLLLSYKSALYALRRLWRCADEWAQAYQYHEVPRFAGAQCGCDGAENPLFRKVAAYVAALPSLEDADAACVVSSASRTNGGLSLQLGPGHTARDTYLGARLAWTSAGGERLVLRVRRHDRSRVLRPYLQHVESVAEEMEQRRRELRLFAHTGVDATTGAPRWASAPFTHRPRSTPWPWTRTQSPRPRRPRELLKAAATTHARARLARDYLSTAAGTGSHVPGAWQVLGRS

SEQ ID NO: 83672 - DNA, 906 bp, Zea mays
  misc_feature: Ceres CLONE 1569630
  misc_feature: Encodes the peptide sequence at SEQ ID NO. 83673
  misc_feature (670)..(670): n is a, c, t, g, unknown, or other
ccccgcggtggcggccgctctagaactagtggatcccccgggctgcaggaattcgtctcacccctagaaaaaatttgcagcgaccgcgccggtccccgccacaaaatcagctacccaccaccgtccgtcagcggcggcggggagagcatggcggccatcgtggcggcgcgggcgtcggccccaggcagggcggccgtcagcaccatcgccgcgttccacagccacgcgtccccttcccgcgcgctcccgctcgcctcctcctccatcggcggcgccaggcggtaccaccacgcccccgcgtgctgcttcgccaccaagccccgcgccggccgctgccgagctcgtcgaccaggacttcgccacggccacgcaggaggccgccaagccacgccggatacgccggtctcggaaggcgaagaagtccgccaccgccgccaaggaggaggatgggacggacgacaagccggtggcggcggcagaggacgaggcgaaaaggaagaaggaggcggccggcgccgaggacagcgcccgggcattggtggccggcctcgacgacgtgatcgtcaaccccgtgggtctgggtcggcggtcgcggcaggtgttcgacgaggtgtggcgcaagttctcgcggctgggccagatttcgagcgcctcgtccaccgcgctggcngaagaggaacaagccgtgcttatccgtggaagacctatgtgcgagttcactgtgccaagggcgcatgacaccaccgtcctcgtcgtcggtgccaccagccgcatcggccgcatcgtcgtgcgcaagctcatgctccggcggatacatggccaggctttagtaagaagaaacgaccctgtagggaatgatatgcctcccaggccgggggaaatggttgttggggaaattttgggaac

SEQ ID NO: 83673 - protein, 66 aa, Zea mays
  misc_feature: Ceres CLONE 1569630
MCEFTVPRAHDTTVLVVGATSRIGRIVVRKLMLRRIHGQALVRRNDPVGNDMPPRPGEMVVGEILG

SEQ ID NO: 83674 - DNA, 1101 bp, Zea mays
  misc_feature: Ceres CLONE 1569633
  misc_feature: Encodes the peptide sequence at SEQ ID NO. 83675
  misc_feature (863)..(863): n is a, c, t, g, unknown, or other
  misc_feature (925)..(925): n is a, c, t, g, unknown, or other
  misc_feature (938)..(938): n is a, c, t, g, unknown, or other
  misc_feature (958)..(958): n is a, c, t, g, unknown, or other
  misc_feature (962)..(962): n is a, c, t, g, unknown, or other
ctggagctccccgcggtggcggccgctctagaatagtggatcccccgggctgcaggaattcgtctcacccctagaaaaacttctgcccaaccccaaccccaacccccctccatccatccaaacagctttgcctagcttattccttaccgacaaacaaaactgacacggatccgcacaggccacagctagcgcaacgaactcgcccagtccggctgctgctgcacaacggactcgatctcacgggcccgccggctagcagccatgcagacacagtcccgcctggccatgagcggcggcggcagcagcagcagcagctcggcctcggaggacaagcacgaggcggtgatccgcgagctgacgcgggggcacgagctgacggcgcagctgcgggtcgaccccctgcgcgcgctgagcgggcagggccagggccgaggccaccgcggcattcatccctgcaggaaggtgtccggcgccttcacccgtctggcctcttcattattgaagttggcccggcccggggcccccggccgccgaaaaaggtgaaattgggccgcgcctggccccttggccccccgcaaaggggggccgggaaaaaaaagccttcccaagaagaagcaaacgggaagggacgtccctcggccggcaaagagggacgggggaaccctgggggaaaggaaaattccggggcccaaaaagaaggaaacccccttaagttcccccctttttcccgaaagggggcccaccataccaaggggcgagtctttcacccccgcaaaggagactagatgtccgcggggccccccaaaagaagagggggaaacaaagtggcaaattgaaggggtgaaccgggcccacccccgccnacagagaggctgcggtatggtacctttcacacaagaacaaactttagcagaacggtgccttntttattatatatncctctccgcggggggggcgntggntttcgtctttctctctcggaggaacggggccagtggtgataatatgagtccgacgttgcccgtgacatggagtgtgttagtatttctaacacgtgtgagccgatgagaaggtgctctatcgcgctgttcaatagtggag

SEQ ID NO: 83675 - protein, 93 aa, Zea mays
  misc_feature: Ceres CLONE 1569633
MQTQSRLAMSGGGSSSSSSASEDKHEAVIRELTRGHELTAQLRVDPLRALSGQGQGRGHRGIHPCRKVSGAFTRLASSLLKLARPGAPGRRKR

SEQ ID NO: 83676 - DNA, 874 bp, Zea mays
  misc_feature: Ceres CLONE 1569634
  misc_feature: Encodes the peptide sequence at SEQ ID NO. 83677
  misc_feature (394)..(394): n is a, c, t, g, unknown, or other
  misc_feature (396)..(396): n is a, c, t, g, unknown, or other
  misc_feature (583)..(583): n is a, c, t, g, unknown, or other
acccgcggtggcggccgctctagaactagtggatcccccgggctgcaggaattcgtctcacccctagaaaaaaagccagctaggaagcaagcagctggaggcagagatgccaaccgcaatgtcctgtcacctttgctcatgagcaaatcggtcaaggtcgcccatggatggagatcacaacaggaggcaagccgccgccgcggtcaccgtcacgcaagtcagcccggcgcggcgcctgatcgcctggctgaggcttctcttccgggcgttcgttcatagatacggcaaggtcgcgagctggaacgcggcggggcgccctgtcttcgtcgtcctcgcggtcttcttcctccagaggagcctgcgccgccggtacctgtcatggaaggagtcgtcncntcttccgctgatggccgccgccgccgtcaccgtgcaggcgaccgtcagggcgatggcggcgcagcgcgagctctctgtccggtagcagaccagagctgccacacgcatccaggcgcgatggcgtgcgcacagggcggtgtggagctacctgacgacgaagagagccgccgtcatctgccaacgtgcntggaggcaaagcgttgcacgcaaggagctcaggaagctcagactgtgtgtgcaggagaatctgggaaaagaaatgctgggaggaggtgtgcaagctgcctgagatggtggacgtgctccaacaggctgtcatgaccccgaaaacaaggccgtcaacgagagggaagcggcgtaggatgccataacccatttggacccacctccgccatcaaaaaaccggggtgatggttaagaacctaaaaaagccagtcccttaatggccaaatttacccccccaaggaattgctgggag

SEQ ID NO: 83677 - protein, 105 aa, Zea mays
  misc_feature: Ceres CLONE 1569634
  misc_feature (78)..(78): Xaa is any aa, unknown, or other
MDGDHNRRQAAAAVTVTQVSPARRLIAWLRLLFRAFVHRYGKVASWNAAGRPVFVVLAVFFLQRSLRRRYLSWKESSXLPLMAAAAVTVQATVRAMAAQRELSVR

SEQ ID NO: 83678 - DNA, 925 bp, Zea mays
  misc_feature: Ceres CLONE 1569635
  misc_feature: Encodes the peptide sequence at SEQ ID NO. 83679
acccgcggtggcggccgctctagaactagtggatcccccgggctgcaggaattcgtctcacccctagaaaaacgcagtaccgcaccaccaccaagcaccgcaaccggagccggagccagaggagggcgagaggccgaggggagaggagcgaaggaggccgccgaccgaccgtgcgtccggccccgcggcggcgtcggcaggtgcgctagctctgtcttcttcttcttcttctctccctccgatcccgatcctcacggtacctcacggggacatgcatgccgatgatgcgggcacgccagcctccgatccgtttccaccgccgcgcgcgccgcccggccgctccctctcgttcgtcttgtcctctccgcctgtctcgcgtgtcctcacgcttcctccgtcctccgtcgtccccttttctttaatgacaaatcggctgcgagccaagtggggcgtgcactcaaacccctcatccccatgagaccgcacgagttggagcaaggctcagtgcccgcctgcccccgcgtgccgtgcgatgccatggaggcgcgagtccctgggcgtcgtcacgtcctcactcccttgtcgtctgcctgtcgccttgtctcgccttgcaggtcgtagacgacagacgagcagtagcagcagcagcagcacgaggcggccgggcccggggcacgccatggccgataaggaggcgcaggccgccgcgttctgcggcgtaggcgtgatcgccaagttcgagtccctcacgcgggaccccgccgccgtgcagcgcgacacgctgcgccggatccgggcagacacgccttgcccgagtactcccctgccggggcctccggggccccacgaccccgcaggttccgggctggggtgcgttcccacccagccgaattgagccttattgggcggttgccgaagggaaccc

SEQ ID NO: 83679 - protein, 120 aa, Zea mays
  misc_feature: Ceres CLONE 1569635
MPWRRESLGVVTSSLPCRLPVALSRLAGRRRQTSSSSSSSTRRPGPGHAMADKEAQAAAFCGVGVIAKFESLTRDPAAVQRDTLRRIRADTPCPSTPLPGPPGPHDPAGSGLGCVPTQPN

SEQ ID NO: 83680 - DNA, 895 bp, Zea mays
  misc_feature: Ceres CLONE 1569636
  misc_feature: Encodes the peptide sequence at SEQ ID NO. 83681
  misc_feature (720)..(720): n is a, c, t, g, unknown, or other
  misc_feature (721)..(721): n is a, c, t, g, unknown, or other
  misc_feature (749)..(749): n is a, c, t, g, unknown, or other
acccgcggtggcggccgctctagaactagtggatcccccgggctgcaggaattcgtctcacccctagaaaaatccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtccgttgcagcccacgtgccgtcgtcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcagagaaactttgaggcaactctggcatcagaagcacttctaaatgaagaggcggtagtagcagcggcagccgcagaggcagttgctcttgccagagcagctgccgaagctgcccaagaagttgttcagatagtacaaaagaaacagcccctcaggcgggttatttaaaccaaaaaaaaggggggggggaacaaaattttctcttggggaaaaaaaaaaccccccccccaaaaaagtggactcaacccctccccgaaaaagggtggggcaaaaaaaacccccttggagggaggaaatccgggggaccccctcttgggggtccccggggggggggcgcggaaaaaaaaaaaaaatttgnntctttgtttttgtctctctgtgatgtgnttagtattttatcagggctatcctattttttttgttttagccgccaagataagccccgtgttcgcattcgtcacttcccggcggccttttttcccggtggatctctggccccggttgctgctcctctatcggggtgtggttgtgtt

SEQ ID NO: 83681 - protein, 118 aa, Zea mays
  misc_feature: Ceres CLONE 1569636
MACLAPQFKWAPSVAAHVPSSSSSYSRCSALRVHCAVTSAAVVEDRTNGSAAQLRLAYAAPAIQRNFEATLASEALLNEEAVVAAAAAEAVALARAAAEAAQEVVQIVQKKQPLRRVI

SEQ ID NO: 83682 - DNA, 937 bp, Zea mays
  misc_feature: Ceres CLONE 1569638
  misc_feature: Encodes the peptide sequence at SEQ ID NO. 83683
  misc_feature (580)..(580): n is a, c, t, g, unknown, or other
acccgcggtggcggccgctctagaactagtggatcccccgggctgcaggaattcgtctcacccctagaaaaactctctcgcgcttccgctttcccttctcctggtcctggccatggcccacgaacgggagccgctcctgcagcaacgacagaccggcgtcggcaatgcctgcggtgccaagggctcgtcctcggcgccggcgccgtcggctgccgcgctgccgtcgctggctaggaccgtgctcaagttcctgatgtgggcggtgttcctcacctgggccgcggggatcttcctctacccgaccaagcccgtgcaggccgtgttcaggaagtgggtcgggctcaccagggactccatgttcggcatcgtcgggggtattttcctgaccttcagcgcgccaattctgatcattgcgcttctcgcatatgtgtacatctccttcttcccgagtgagcatgtggtggagaaaaggaagctgcgctcactgagtttcaagctctggactttccctgttctggtagacggccccttttggagttgtctctgcagttgagttcattcggaattggtctggtttatnagtttttggtgcctactcaatgacctattatgccgggggacgctgtgaagccttgtctcgtaattttgacatcccttcaatgacctgaaaggaaattgataccgggaatgtctttgggcctccttttaggggccgtttgggttgttctgaattgctcttctccttctgccaggcgcccgaggctcgggtctcttacgggttatccaattcccatttgagcatgctacaagaacccacgtcgggttggggctcccacaagtgctccctttaattggatggcttggtccatggagacccggggccatgaagggccgcccccggaaaaacgaacatggaaggaaatggattgcacaccgc

SEQ ID NO: 83683 - protein, 146 aa, Zea mays
  misc_feature: Ceres CLONE 1569638
MAHEREPLLQQRQTGVGNACGAKGSSSAPAPSAAALPSLARTVLKFLMWAVFLTWAAGIFLYPTKPVQAVFRKWVGLTRDSMFGIVGGIFLTFSAPILIIALLAYVYISFFPSEHVVEKRKLRSLSFKLWTFPVLVDGPFWSCLCS

SEQ ID NO: 83684 - DNA, 988 bp, Zea mays
  misc_feature: Ceres CLONE 1569641
  misc_feature: Encodes the peptide sequence at SEQ ID NO. 83685
  misc_feature (988)..(988): n is a, c, t, g, unknown, or other
ccccgcggtggcggccgctctagaactagtggatcccccgggctgcaggaattcgtctcacccctagaaaaaggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgaagacgcgtagctcgctagggttcgtgatttctcgccgatcggttcggggactggtaagctatggatctctcgcggcccgcatcgtcagacctctcgctcgggctgcaccctcatgcccacgcccacgctcgggtgcatgcggcagccgcgccgctgcgcctgttcgacgacgcgaagccggaagcgcctcggggccggggaggcccacgccggagagggacaacgggggaacggtggcaaccagcaactttctccctccttcggggcactcccttctggggttaaagggccccgggcccgggcctgttaaacagccgttgggggggccgggggtttgaaaaaaaacttttttctctggctccgtccccccgggggccttgcgcccccccccaaagggggcaaggggttcggggagagaaaatatagcggcgccggaatttgggagaaccccgccccgccgcggggcccttttccctgggggaaaccagtttcctggggcggaggccccaacccggaatttccctcccccgtatatgaaacggagtctttccccccccggggcggggcattcagtctaatggcccgggaaatatttcttctgccggggggggtcttaagctgttgggaacaccctcacaaaaaatatcctgaagaggccccgggggtccctttaaggggggagatagcactggtggcn

SEQ ID NO: 83685 - protein, 74 aa, Zea mays
  misc_feature: Ceres CLONE 1569641
MDLSRPASSDLSLGLHPHAHAHARVHAAAAPLRLFDDAKPEAPRGRGGPRRRGTTGERWQPATFSLLRGTPFWG

SEQ ID NO: 83686 - DNA, 1032 bp, Zea mays
  misc_feature: Ceres CLONE 1569642
  misc_feature: Encodes the peptide sequence at SEQ ID NO. 83687
  misc_feature (395)..(395): n is a, c, t, g, unknown, or other
tcggtggcggccgctctagaactagtggatcccccgggctgcaggaattcgtctcacccctagaaaaaaagtccccacagtgcccgcgccaagagtgtccacttcaaccctagctccacctgcatctcccctcccctcccatcccctcccgcccgcctcccttcgtccactcggatccggaaaaccctaaccctagacgtcgcccggccgccgccatggaccccgacggcgacccggccttccaccgcaacgaggccatctccgcggtccaggatgtcgaccagtactatggcgacgacgacgacttcgacgacctctacaacgacgtcaacgtcggggacgggttcctccacgcctcccaccaggcgccgccgccgctgccgccgccacctccnactcaacaggccccaccgccgcagaagcaccagctccctcggccgtcccaggaggctgcccgccgcccccagcggcatccacctggcccacggtcctccggccacccgccgacgggagggccccatccggcggcaaccagtaggttatggcttccccggggggggggccgtccccggccccctgggggggaaccttcgccgccccaataaataacctgccccttccaaccggcccaaaagccaagggggggcggatacccgggggcgcttccgggcgggccggcctcttaaaaacctggcgcttggtttcagtgcaggtatggggggttccacccgcgcccggggggaggggaaaataaccccccggggggggcccccccccgggggtgtcgggaggaaagtggggggccccccccctcaccacgggggcggaaggggccccgggagggatacgcgaaccgtggttgcgtggggaggaaacacccacggggggggagatacggacacacgctatcgtggaatcctgttttccgtcagatgtttggcgccgcgcaccaagggaggttagctggtttgccaatgaaaaaaggccttgggccaagtgaagaggtgcctatggcgcggggggtgtttataa

SEQ ID NO: 83687 - protein, 129 aa, Zea mays
  misc_feature: Ceres CLONE 1569642
MDPDGDPAFHRNEAISAVQDVDQYYGDDDDFDDLYNDVNVGDGFLHASHQAPPPLPPPPPTQQAPPPQKHQLPRPSQEAARRPQRHPPGPRSSGHPPTGGPHPAATSRLWLPRGGGRPRPPGGEPSPPQ

SEQ ID NO: 83688 - DNA, 1065 bp, Zea mays
  misc_feature: Ceres CLONE 1569643
  misc_feature: Encodes the peptide sequence at SEQ ID NO. 83689
  misc_feature (394)..(394): n is a, c, t, g, unknown, or other
ctccccgcggtggcggccgctctagaactagtggatcccccgggctgcaggaattcgtctcacccctagaaaaactcacacgggcgcgacccaaaaccccattcatcccctcctccggtctcgactgccatggccgccgggcgggccttccttggcgcgccgtgctcctccctcgccgccggcgcccgttgccttgccttcgcttcccctttgccccggaacctcacccccgcgctccgctgcggcgttcgcggtcgctgcatcgcctccgcctcctcgtcccctgactcgccccccttgccggagccctacgtgctcaccactcctctctactacgtcaacgctccgccgcatatgggaagcgcctacaccaccatcgcagcggacgccatcncccgcttccagaggttgctagagaagaatgttatatttattaccggaacagatgaaacacggtgagaaaatatctgcttcccgcagaggccagtgggttgaaaacccaaaggagcattggggatggcaatttcaaagttcatataaggacgctcctggggctgaccttaaacataaaatatggacaaagtttatttccccccaacggaattgtaaagcattgagggcttgttgtggaacaaattccttattcccaaagtggtttaaacaaagggcgaacatattataagagcctgaatttatggagaggaaccttttttgtgttgagccttgtgaaaaagtccaaagggatgaaaaaagaacccttttgggaaaaaaaatttgtttgcccccttggcaatcttagaaacccttggtggttgaaaagaaaaaaaagaaataactaattttccttggcccttggccacagttacccaacattaaatttggaaaaagcctcccgacaaaaaatacccggattttggtaaaggcgcatctaatcccctcttaaaaagagcgccagggtgtgattaaataacgggaataaagagaacttttctttttcctccgggccctcggagaaagagggcatttcccgtggccaaataaaccaggcgaaaataataggtgtgg

SEQ ID NO: 83689 - protein, 109 aa, Zea mays
  misc_feature: Ceres CLONE 1569643
  misc_feature: SWISSPROT Homolog: EC 6.1.1.10 Methionine--tRNA ligase
  misc_feature (89)..(89): Xaa is any aa, unknown, or other
MAAGRAFLGAPCSSLAAGARCLAFASPLPRNLTPALRCGVRGRCIASASSSPDSPPLPEPYVLTTPLYYVNAPPHMGSAYTTIAADAIXRFQRLLEKNVIFITGTDETR

SEQ ID NO: 83690 - DNA, 954 bp, Zea mays
  misc_feature: Ceres CLONE 1569644
  misc_feature: Encodes the peptide sequence at SEQ ID NO. 83691
  misc_feature (388)..(388): n is a, c, t, g, unknown, or other
  misc_feature (389)..(389): n is a, c, t, g, unknown, or other
  misc_feature (604)..(604): n is a, c, t, g, unknown, or other
gcggtggcggccgctctagaatagtggatcccccgggctgcaggaattcgtctcacccctagaaaaaaaacatgtgtcactcaccagcgctttccgtcccgtactcccgtgtaccctgtcccgtcctcctagctcgcattccgatttccgagttccagccagcgagcgagccaaccaactgaaccaaccaaccaccgctccttcttccttccttccttccttccccagttcccctcgtctcaccagtcaccaaggttccgagagcagaccgagataaaaaaaaggtaatccgacggaaacgacaagggcgcggcgagggcggggacagggtcggggaggccctgggcgcgggggcgccaagcgcatggcatcgtcgagggtgatgccnnccccctcgccgtcgcacacggcctctgatctcgcgcgcctagcgcaagccgccagcaggcccggcgggcgggggcagcggggctgggctccatgaacgtggaggagctcctccgcgggcatctacagcgacatgccccaccccggggccgccccgcgttctgaccccgaacgccccgaaggtcgccggcccccgggcgccgggaggtcgcccacnccgaagaacggccgaaagaaggtgtggaaaggaaatcacccggcgggagggtggaaatgggggaaacccggggccccccggtggggggttcaaggcggccgtccccctcttgggggggggtgggccccggcggccccggaatgaacccgtgaggacttcctggcccgggaagaaaggcccggggaaggagaagggggtttaaggtttttgggcccctttggcccggccatggggttccttgggcgaccaaaaggctggggtgccctgccgcgcaaagcgaaagggaaaaaaaccccctcttggttcaggggaccgcgccttttggtcgtaaaaagtgtataaaaccgggg

SEQ ID NO: 83691 - protein, 31 aa, Zea mays
  misc_feature: Ceres CLONE 1569644
MGETRGPPVGGSRRPSPSWGGVGPGGPGMNP

SEQ ID NO: 83692 - DNA, 978 bp, Zea mays
  misc_feature: Ceres CLONE 1569645
  misc_feature: Encodes the peptide sequence at SEQ ID NO. 83693
ctccccgcggtggcggccgctctagaactagtggatcccccgggctgcaggaattcgtctcacccctagaaaagccgagttcagcagcactctcctccgccctcttccaggtctagcagagattggggacgcgtgggcatcggagattgcctcgggagcgcgtttcctggtcaactaaggccggcatgaagggctgctcagagcgcttgctgtttctgctgctgctgctgctggcatcgtcgtcgttactgtcccgctgtgattgccgcgcagcagacttgccccgccgacctcgacagcaaatgcgatggtggcgcgtctgatgatgattgggagggggattcttccccggcgtcccgaaatcaagtatgagggtccacaagcaagaaccccctgcttttaaggggataacaggaggaagtgattctcggtaagaagatgaaggattggatgcccttcagtgtgcgttccggcacacgttccccggtactggggctgatccctttcgggggccctacaaaaacttggccttggggaggattgcaccaattccgttggcccatggcttaaaaaagaaaggaaaacccccctttaagtccctgggaaaaggtgggggatttgaaaaattggtgccttcccatgacaggggatttttggcccccggatagggaaaaacctcttgaaagaaaacaatattctaaccttgggagaaaaaaagcccaacctgggcaaaaccccccccccgtatggagccccattttaaagcccttttgggggggtaccccccaacctttttttccccccccctttcatggcgggggcccttctcccacccccaaggggtaaaagttttgcctttgcggggtcgccaatttaaaaagagttttggggccgccaccctacccggggggggaaaaacttgttttctcggggggaaaaagggttccaacctctttctaaactgtgtggaagaaaccc

SEQ ID NO: 83693 - protein, 43 aa, Zea mays
  misc_feature: Ceres CLONE 1569645
  misc_feature (1)..(32): SWISSPROT Homolog: EC 5.3.1.5 Xylose isomerase
  misc_feature (19)..(41): SWISSPROT Homolog: EC 3.5.1.97
MKDWMPFSVRSGTRSPVLGLIPFGGPTKTWPWGGLHQFRWPMA

SEQ ID NO: 83694 - DNA, 1279 bp, Zea mays
  misc_feature: Ceres CLONE 1569647
  misc_feature: Encodes the peptide sequence at SEQ ID NO. 83695
  misc_feature (325)..(325): n is a, c, t, g, unknown, or other
cccattgggctgtttcttagcctatcgggcaaattccgcaaactttgttttttttctctccacaaaaacggaactcacgggggaggcggtcgcttttccatagtggatcccccgggctgctttattcgtctcacccctagaaaaattctccctgcaccgtttcgtcgtctcatttcagcagctactagaagtagtagctggctcgctcctgctgccggtttcttgccgtcttcttcttcaccgacgacggtcgcgcgttcctacaccaggtggtccgaattgttttactagggtgcaacggattcgtatccaggagacgtttganatcgtccttcagcgcttatcatacatacatcaagcagatcaacaagggcttaattcacaagacaagagaggatgggtttcttctctctatttctggtggcgtctatgccgatcatccaagtcctgctcataggtgtcattgggagccacctgggctctgggttcagcaacgtttctgacgacgagtgctcgaagggatattaaccaacgttggttttttactgggttcacccccagccttggatgtttccccagcctcccggaaaaaccgggcaccccttggcaaaacgtcattgtgctggggggggttttttggccagtttaacattagcgggttccccctttcattgaatccgggggggacacccttggggcctggggataagcgtggtgcaaacaatcccttggaaaaacccaatccgggagaacaacttttttatgggggggcgtttaaaagctctgtgggggcctcttcttttgcgtttcagccggatggtggaataactcctttgcgtgggaaaaaccctctggcacccgccgtgggtaataaattatggttgcccccggcagtctgtgttttcgcccgctaactcggataaaacaccgcgtggataacccccgctcttctttggtgggtgtacagatatctgagataggccccttggggccgctgtcgtatatacgcaaagatgtcgctaacgccgctagatctgggcgacttgtagaggatcaaagggtggtgtatggggggggaggtgccctttgtgttgttttttgtgagatgctgacttactgtcacgcacgcttgtgagtgtgaagagaacactctggtgaaggaccattttacaccccaaaattgcgtgggctccgcttaggttaattcttgattggcgccgtccctgcaagagcgtagttgagagacacattgtacagttgggcacataagatagtgtag

SEQ ID NO: 83695 - protein, 43 aa, Zea mays
  misc_feature: Ceres CLONE 1569647
MGFFSLFLVASMPIIQVLLIGVIGSHLGSGFSNVSDDECSKGY

SEQ ID NO: 83696 - DNA, 1056 bp, Zea mays
  misc_feature: Ceres CLONE 1569649
  misc_feature: Encodes the peptide sequence at SEQ ID NO. 83697
cggccgctctagaactagaggatcccccgggctgcaggaattcgtctcacccctagaaaaaactttcgcaagcccccttccgaccttgcccctgcggtctcccgagtcccgaagcatccccttccaaaaccctcgccgcgccgcagccacccttgcttccgcacgctatcgcccgggaccagctatctatggcggcgtccctgctcctccgcgccgtgcgccgaagggagcttgcgtcccctctcggatccctgggtgccagcatacagtcaacatgtgttgccaacatatgctcaaaatggggaaggtttgcgagacctttcagtgcaaaagctgctggaaatgaggttattgggattgatttggggacaacttacccacccccttccgttatgggaggaaagaaacccaaaattattgagaatgctgaaagtgcgagaacaacaccctccggtgtcgcattttacccagaaaggggaaaagacttgttgggaaccccccgccaagccgccagggcagttacccaaccccccaaaataacttttcttttggaaacaaaaagggttaatatgggccgaacccttttttttgatcccccaggacccccggaaaagaaaatgaaagaatgggggcccattaccacaaatccggggaaaagggcccccaaataggggggaatcctttgggtgttccaaaacaaccaggagtggggaaggcgggtccctccccccaaagtccggggcccggggacattcttggggctgtgcccacgaattgaggaggaaaaaagcctggaatccttaaccttgtgggaagggcttttccctcaaagaggcggaggatttacctggtcccccgctttattttcaattggaccctccaccgccacggccccaaaaggtaatgctagggccccatttgcggggccctgtgaaggtgaaaaggaatcatctatggaaaccccccccggccgcccctgtgctttttggaaaagtaacaaaaaaggagaggcttggaagcgggattttttacctggtggagaggaactctgttatt

SEQ ID NO: 83697 - protein, 160 aa, Zea mays
  misc_feature: Ceres CLONE 1569649
MAASLLLRAVRRRELASPLGSLGASIQSTCVANICSKWGRFARPFSAKAAGNEVIGIDLGTTYPPPSVMGGKKPKIIENAESARTTPSGVAFYPERGKDLLGTPRQAARAVTQPPKITFLLETKRVNMGRTLFFDPPGPPEKKMKEWGPITTNPGKRAPK

SEQ ID NO: 83698 - DNA, 1089 bp, Zea mays
  misc_feature: Ceres CLONE 1569650
  misc_feature: Encodes the peptide sequence at SEQ ID NO. 83699
  misc_feature (1089)..(1089): n is a, c, t, g, unknown, or other
tccccgcggtggcggccgctctagaactagtggatcccccgggctgcaggaattcgtctcacccctagaaaaagaatggcgacctcctccactccgccacctgctgcttcccacgcctccctctccccccgtctctaggttcgttcgttccacgtcgccggccacccctgtccacagccgcgacaaactcttcctcagacccacgccacgtacgatgcctctccccccttccctttcccctccgcccaacgccaccgccgccgccgccctgcccctcctcctgctgctcgtctgcgccagcagcattgccgcgcagccgctggcgtcgtcgcaagccaaggcgctcctcccggtgcgccgcctgctgttctacccgccggcgctcgagccccccccctgtgcagcagacccctgcgcgctgccgcccgcgccggccctcgccggtcgcttgcgagggcggccaaggcacgggggctcttccggcctgggggaacgcgaacccctgacgccgccctggcgcgccgcggctgcccgggcagtttttcctttcccaagggcgcttgttcaccaccgccttaaccaggggttcccggggggcttggggcggcctcttcggttcctttgggccctctggggccttgggtggccccgcttctccgggggggccccaagtttccccgcccgggcttccaaaggggtctgggcgaaaaaggattctaaaacctcccagatttcgcaaacaaaaaatttcttaacggggaggcccgtttcccccggaatggtatctttgacccgggggattaataactcagaatggtaaaaaaccccacgtggcgcgtttcctcgggaaaaatggggcttcaaaaggggaccccggtgcccgtccaccggtgtccgagggtcccaattttctccgagtagaagttttattcggtgttaaaaaacaagggtccgcgacccgagggttccccgaaaattgggggaaggtctcgcgccacccacggttgctcctgtgacaaaaaattatattctccggggggtatcccgccgcggggagaaaagctaccggggcgttgctatgtgatctgn

SEQ ID NO: 83699 - protein, 201 aa, Zea mays
  misc_feature: Ceres CLONE 1569650
MPLPPSLSPPPNATAAAALPLLLLLVCASSIAAQPLASSQAKALLPVRRLLFYPPALEPPPCAADPCALPPAPALAGRLRGRPRHGGSSGLGEREPLTPPWRAAAARAVFPFPRALVHHRLNQGFPGGLGRPLRFLWALWGLGWPRFSGGAPSFPARASKGVWAKKDSKTSQISQTKNFLTGRPVSPGMVSLTRGINNSEW

SEQ ID NO: 83700 - DNA, 952 bp, Zea mays
  misc_feature: Ceres CLONE 1569651
  misc_feature (396)..(396): n is a, c, t, g, unknown, or other
ctccccgcggtggcggccgctctagaactagtggatcccccgggctgcaggaattcgtctcacccctagaaaaaaccgagactccacccctcttccgatggactgaatatgatagacggtaactagctagcctccgcaagcgcgcacgagtagtcgacctagaatactctctcgttcaaaacaaacaaacagcgtggtgctgcttgatctctgaccgcgtcgacctctatccgcatctcctagcagcttatggccgccaccatatcttcgtgcctgagcctcgtccccaccgtgcaccaccgaggccgggtggttccccgacaatgagaaactgacaaactctcttcacctccttcgtgcttctcaggaatatcttgtgctcgcctctgcgacganatccgatatagaggcacggcccttgtgactatcgatgacttggacctcatctctcatcacgccgctgccgacgaactgagagctctccactccttggcatgagtccacagctgcaacatctgcgatggtctgctggaccccatcgtcagcttgatcctaaagcatctatgccctacttcgagttcgttccatgcacctaccactgttaaagtactgacatttctccactactgctgtcgctgaaattaccccaggaaaacatattcgtaacccttgcctaagtgcttagggtactaagtacacggtaccactatgacgttgaatgaacaattattacccctctggggctcaatacagccgcaaaaggcagatgaggtaccaagtccggtcctcaaaaagttcctggccgagttcaaccatagtaacaaagcttttctttcgaacaggaattggcggtgaattgggaaggttcattccccaccctccaagtggtgggctgatcttattggaaaccatatccctctcaaaataaaggaagtccctggaacgtaaccca

SEQ ID NO: 83701 - DNA, 935 bp, Zea mays
  misc_feature: Ceres CLONE 1569652
  misc_feature: Encodes the peptide sequence at SEQ ID NO. 83702
  misc_feature (689)..(689): n is a, c, t, g, unknown, or other
  misc_feature (783)..(783): n is a, c, t, g, unknown, or other
  misc_feature (839)..(839): n is a, c, t, g, unknown, or other
ctccccgcggtggcggccgctctagaactagtggatcccccgggctgcaggaattcgtctcacccctagaaaaagggcatgggccactactgctagtgctagtgctagtagcagcggcacagcgcggagaggcagagaagtagccaaagccaagtaggaggaggaggaggaggcagggcgcggggcgagagcttgacgcggcaaccaccgctgcactgcactgcacccctcgctcctccgagctcagcagcagcagcagcagcagctcgctcgcggcatgtcgccatccatgtcaggaaagatttatctggtcggccgatcgagctcctctcctccgaagcactgaagctccagcggctgccctgcctgacagccactccgcacgacaaaattaaaaagcgcagggcgctcggggagaaggacgtggcggtgcccgggatgacgcgcggggacacgcccaggctcagggtgctcgaccagtgcatccgccagcacaaggcgctcacccaggccgccggcatgatggagagccacccgtggcgcccgcagcgcggactccccgagcgcgccgtcaccatcctccgggcgtggctcttcgagcacttcctgcacccgtatccaagcgacgtcgacaagcatatcctggactcgccagacgggcctctcacggagccaggtgtcctactgcntcatcaatgcgcgggtcaagctctggaaagcaatggtggaggagatgtacgtggaggagatgaaggcccagggccagacggcgggggccaccancaggtaggcgtccccgtctccaacacccctaccttagcgcgcccggcacgcctccnaagcggcttgagacaatggccccggggacagcggcggcgggcccttcttcaacggataccaaccgggggccaattcttgaactaaaccgggtcccc

SEQ ID NO: 83702 - protein, 161 aa, Zea mays
  misc_feature: Ceres CLONE 1569652
  misc_feature (84)..(84): Xaa is any aa, unknown, or other
  misc_feature (115)..(115): Xaa is any aa, unknown, or other
  misc_feature (134)..(134): Xaa is any aa, unknown, or other
MTRGDTPRLRVLDQCIRQHKALTQAAGMMESHPWRPQRGLPERAVTILRAWLFEHFLHPYPSDVDKHILDSPDGPLTEPGVLLXHQCAGQALESNGGGDVRGGDEGPGPDGGGHXQVGVPVSNTPTLARPARLXSGLRQWPRGQRRRALLQRIPTGGQFLN

SEQ ID NO: 83703 - DNA, 974 bp, Zea mays
  misc_feature: Ceres CLONE 1569655
  misc_feature: Encodes the peptide sequence at SEQ ID NO. 83704
  misc_feature (394)..(394): n is a, c, t, g, unknown, or other
  misc_feature (461)..(461): n is a, c, t, g, unknown, or other
acccgcggtggcggccgctctagaactagtggatcccccgggctgcaggaattcgtctcacccctagaaaaatccgttccgagccgaaccaaggcgccatgagctccccgggcgtgcgccgcgtcgtactcctctcgtcactcctctgcgccggagcgctcggtttcttgtcatgctcccatggcgccgcggtggcgcccggctacgtcgccgtctccgccgccagcttcgtgccgtcctcaacgtgcagctcccccgaccgagttccgccgcagcggcggaacggcacgtccgccgtgctgcggctgacgcacaggcacgggccgtgcgccccctcgcgggcgtcctcgctagcggccccgtcggtggctgacacgctgcgctctcaccaccnccgagcggagtacatactgaggaaggtgtcggggcgcgcgcctcagctgtgggactccaaggcggcntgcgacggtgccggcgagctgggggtacgacatcggcacgctcaactacgtggtgacggcgagcctcggcaccccgggcggtggcgcagacccatggaggtgggcaccggcagcgatctgtcgtgggtgcagtgcaagccgtgctccgcgggggcgttcgtgcttcaccagaaaagaccggttcttcgaccccggccaagtcttcgttcctactccgccttgcccttgcggggggccccttgttgcccgggggttgggaattttaccccgccggcccccttggtcgggggggccaagggggggtactggggtcagctaccgggaaaggggtcacaaacccccggggggtgttaagatctccaaaaacgttcccccttttgggaaaaaaacccgggggcagggctttttttctccgggtggcgggacaccccaaagggggcctgtgtttaagggttcaacagggctcttggggcctcgccccaaaacacaccccccccggtgaagaaacggggg

SEQ ID NO: 83704 - protein, 238 aa, Zea mays
  misc_feature: Ceres CLONE 1569655
  misc_feature (99)..(99): Xaa is any aa, unknown, or other
MSSPGVRRVVLLSSLLCAGALGFLSCSHGAAVAPGYVAVSAASFVPSSTCSSPDRVPPQRRNGTSAVLRLTHRHGPCAPSRASSLAAPSVADTLRSHHXRAEYILRKVSGRAPQLWDSKAACDGAGELGVRHRHAQLRGDGEPRHPGRWRRPMEVGTGSDLSWVQCKPCSAGAFVLHQKRPVLRPRPSLRSYSALPLRGAPCCPGVGNFTPPAPLVGGAKGGYWGQLPGKGSQTPGGC

SEQ ID NO: 83705 - DNA, 959 bp, Zea mays
  misc_feature: Ceres CLONE 1569656
  misc_feature: Translation starting site: 218
  misc_feature: SWISSPROT Homolog: EC 2.3.1.15 Glycerol-3-phosphate O-acyltransferase
ctccccgcggtggcggccgctctagaactagtggatcccccgggctgcaggaattcgtctcacccctagaaaaagcaaaaacttgcttccttcgacggccgcatcagtcttccacgtacgtcccggcacgtcgatcacggcaaaagctagccagcgcacaggacctgcggaggagctcggttttcgatcagggtcaataatcaccacgccgacgctgatgacgccggcgtcccaggcggcaccgccgcgcgcgcggcggtctgtggtggcggagctggagggtgcgctgcttcggagcgcggacacgctcccgtacttcatgctcgtggcgttcgaggcgtccgggctgccgcgcttcgcgctgctgctggcgctgtgcccgctgctgcggccaccacagctggcgggccgtcgcggcctggcgctgcgcgccgccgcgttcgtggccaccgcgggggtgacacgcgccgagctggatgccgtgtcccgcgccgtgctgcccaagttcatggccgacgacgtcgaaccccgcggcctgggcggccttcgggagctgcaaggggaagcgcgtcttcgtcacgcggatgccccgcgtcatggtcgagcgcttccccaaggagcacctcggcgccccccccgtggtcgggtctgaactcaagtaaagccgggtcaggcgctccccggggctcctcaaaggcgcctgccacgagaacgtcctccagcgttgtccgcgcgcttgttccccgggaacaactgccggacctcgcgaattcccggttcaaaaaggcgcgctccttccaattctgcgagaagaagccccacccccctttcactgggaacccgggtagaaaccccccccccggttcgggccggtattcttcaaaaaggtgcccccggtgtgcggccccccattaaggttcctcgacttcccccccggggggcccctcggggggggggcc

SEQ ID NO: 83706 - DNA, 1076 bp, Zea mays
  misc_feature: Ceres CLONE 1569657
  misc_feature: Encodes the peptide sequence at SEQ ID NO. 83707
  misc_feature (392)..(392): n is a, c, t, g, unknown, or other
  misc_feature (457)..(457): n is a, c, t, g, unknown, or other
  misc_feature (648)..(648): n is a, c, t, g, unknown, or other
ccgcggtggcggccgctctagaactagtggatcccccgggctgcaggaattcgtctcacccctagaaaaaacagtacagcagcatccagcgggcggctggctgcctaatctctccagctctttcgtcccctcgccacgccgcccaccgctgccgcatcatccgcccgttgcccgccgtcgtcgcctggccagcggcttccgcccccattcgccgtcgcagcgcgccgagccccgtcccagatcgccgctgcgcttcctgccgccgtcggcgcggcgcagggttgaaatctatttgaccactcagttataaccatttctggtctgaagatgcttcgtcaatgacatctggaaactgtaatagtatgcgctgatcttctatgcttcaccacccnactatcaatggagctcttttcctgtggaaacagcccagctacctccttcattttgataaatcttncaccttggtggctcatgaaggcaagaaaccctgaagttcaaaatggtgaaaacaccttcttgcccttcaagaaaggcaggtcaccaaattccaaatgggagccctttccaaaaattggcgggggagcacaaaatgcaaaaccccccggcaattgggaaagggggggttaaaaaggggaaaaaccccaaagnaaaaaaaagggggattgggacccgggatttcctggggatacaccacaaaataattaggttgtgggccccatacaccccccccaaattggtggaaaaggttaaaaaacgggtggggaaaaccctttgggacccgtggaggggggaaacaatttttggttggggtcaccccccccccccacaaaatggggagaatttttccccacacccggccaacaattgtttctctccaaaggaaaatattttggggggggaacccccccccccaaaaattggggggacgtgggagaaaaacgggaggtggggattttcgccaataaaaataaggggggaggtggccacctcctccctgaagagtggcccaacaacacaattcttttgtttctcaaaaacccgcggagggaaccaaccctcggtggaagtaaaaataa

SEQ ID NO: 83707 - protein, 75 aa, Zea mays
  misc_feature: Ceres CLONE 1569657
  misc_feature (20)..(20): Xaa is any aa, unknown, or other
MELFSCGNSPATSFILINLXPWWLMKARNPEVQNGENTFLPFKKGRSPNSKWEPFPKIGGGAQNAKPPGNWERGG

SEQ ID NO: 83708 - DNA, 913 bp, Zea mays
  misc_feature: Ceres CLONE 1569659
  misc_feature: Encodes the peptide sequence at SEQ ID NO. 83709
  misc_feature (489)..(489): n is a, c, t, g, unknown, or other
  misc_feature (645)..(645): n is a, c, t, g, unknown, or other
ctccccgcggtggcggccgctctagaactagtggatcccccgggctgcaggaattcgtctcacccctagaaaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccacctggncgaggaagtgcagatcgcgcaccgcccgccgcacagcaaacttcagaaaagtggcttcgcccgacaaaggctcccccacccaccgagtccgacctccgaggagaccctcaagcgcctcggggccaaggtcggcaagtccccccaggaaggggttcnaggggctcaaaaaaccaaacggcgaaactcgttttaaccgggaatcccacgaattccgcccgccgcttcgctcctgccaaaaaccccgggaaccccgaaattttctgaccccgttgaaggccaaggaactccttgggaacaaaaaggggggccccctttgaggcctcccaaaaaaaaaaccaagccgcccttaaacaggttgaaatacgggggggcccaccccccccccccgagagaaaaaggcctctggggaggagcccactccccg

SEQ ID NO: 83709 - protein, 216 aa, Zea mays
  misc_feature: Ceres CLONE 1569659
  misc_feature: SWISSPROT Homolog: EC 4.1.1.31 Phosphoenolpyruvate carboxylase
  misc_feature (112)..(112): Xaa is any aa, unknown, or other
  misc_feature (164)..(164): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLATWXRKCRSRTARRTANFRKVASPDKGSPTHRVRPPRRPSSASGPRSASPPRKGFXGLKKPNGETRFNRESHEFRPPLRSCQKPREPRNFLTPLKAKELLGNKKGGPL

SEQ ID NO: 83710 - DNA, 921 bp, Zea mays
  misc_feature: Ceres CLONE 1569660
  misc_feature: Translation starting site: 241
  misc_feature: SWISSPROT Homolog: EC 1.1.1.22 UDP-glucose 6-dehydrogenase
acccgcggtggcggccgctctagaactagtggatcccccgggctgcaggaattcgtctcacccctagaaaaagcacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatctttgtctcggtgaacacccccaccaagaccccgtgggcttggagctgggcaagctgccgacctcacctactgggagagcgctgcccgcatgattgcggatgtctccaagtctgacaagatttgtgttgagaagtccactgtccctgttcagaccgctgaggctattgaaaaaatcttgacccccaacagcaggggctccacttaccgaacccttcccaaccaaaaattccttggggaaaggcccgccctttgagaccttttcaagccggaaaaatggtttttggggggccgggaaaccccgtggggaggagaggcgcccggcctccagagggttgtccccccccggggttcccggaaaaggtctccccccccaccttggggcggggtgaacccccaaacgcgggcaaaagttttgtggaaaaaataccctttttt

SEQ ID NO: 83711 - DNA, 947 bp, Zea mays
  misc_feature: Ceres CLONE 1569661
  misc_feature: Encodes the peptide sequence at SEQ ID NO. 83712
  misc_feature (891)..(891): n is a, c, t, g, unknown, or other
ccccgcggtggcggccgctctagaactagtggatcccccgggctgcaggaattcgtctcacccctagaaaaaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaacaatgtaggcaagggaagtcggcaaaacggatccgtaacttcgggaaaaggattggctctgagggttgggctcgggggtcccggccccgaacccgtcggctgctggcggaatgctcgagctgctcgcgcggcgagagcgggccgccgcgtgccggccgggggacggtactggaacggccccctcgggtgccttccccgggcgtcgaacaaccgactcagaactggtacggacaaggggaatccgactgtttaatttaaaacaaagcattgcgacggtcctcgaggatgctgacgcaatgtgatttctgcccagtgctctgattgtcaaagtgaagaaattcaaccaagcgcgggtaaacggcggggagtactatgactctcttaaggtaccaaatgcctcgtcatctaattagtgacgcgcatgaatggattaacgagatcccactgtccctgtctactttccagcgaaaacccagccaagggaaccggcttgggcggatcaacggggaaaaaaaacccggttgagcctgaccctaggtccaactttgggaaaagactggagaagggaaggattaaggggaaccccccggggccaatgaaaatccactactcttaaactttttttacttttccccgtgggccggaagcggggccaccccctcctttttggccccagggccggncctcccggggccgataccgggggaaaaaattttcacggggggaaattttcctgggc

SEQ ID NO: 83712 - protein, 87 aa, Zea mays
  misc_feature: Ceres CLONE 1569661
MEQCRQGKSAKRIRNFGKRIGSEGWARGSRPRTRRLLAECSSCSRGESGPPRAGRGTVLERPPRVPSPGVEQPTQNWYGQGESDCLI

SEQ ID NO: 83713 - DNA, 967 bp, Zea mays
  misc_feature: Ceres CLONE 1569662
  misc_feature: Translation starting site: 266
  misc_feature: SWISSPROT Homolog: EC 2.2.1.7 1-deoxy-D-xylulose-5-phosphate synthase
  misc_feature (397)..(397): n is a, c, t, g, unknown, or other
  misc_feature (424)..(424): n is a, c, t, g, unknown, or other
  misc_feature (840)..(840): n is a, c, t, g, unknown, or other
acccgcggtggcggccgctctagaactagtggatcccccgggctgcaggaattcgtctcacccctagaaaaaccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccatttcgcttcggcggtcgagctccatgtcaacaagctgctccaggccaggcctatcaatctcaagcccccncggaagccggcatgcgtgtcggcgtcnctgtcgtcggagcgcgaggcggagtactactcgcagaggccgcccacgccgctgctggacaccatcaactaccccgttcacatgaaagaacctgtctgtgaaagaactgcggcagctgggccgactagctccggtccgacgtcatccttcacgttctcaagaccggcggccacctcgggtcagccctcgggttggtggagctcaacgtcgcgcttgactacgtctttaaagggccccaagaacggattcctcggggacgtcggccaccaatcgtacccgaaaaaaacctggaaggggggggccacaaatagccaactattcggaaaaccacgggccggggggtttcccaagggggcccaagaaggaaaaaaaaggtttcgggaggggcgcaatgtcccaccccattttccgcgggntttaggataggggtggggcccgggaccccaagggggggaaaaaaaactgggcctccggtatatgggaaagggcccttttaaggccggggggggtttaagagccttaaaaaccgggggttttgtatcc

SEQ ID NO: 83714 - DNA, 958 bp, Zea mays
  misc_feature: Ceres CLONE 1569665
  misc_feature (783)..(783): n is a, c, t, g, unknown, or other
  misc_feature (898)..(898): n is a, c, t, g, unknown, or other
ctccccgcggtggcggccgctctagaactagtggatcccccgggctgcaggaattcgtctcacccctagaaaaatcgcctgggcgactggactccgtgtgcgcctcctccttcatccactgcgccatctcctccagctgcagcaggccggcgcggcgttgcctccgcttgctcccccctcgcgctcgccgccggcattccggcagttccagctccggacgttccagagtgtagcgccgcgatgggtgacccgagcgcctccgccgaccccgccgccgcgcgccaccacctctcgccacagctcgcggggcagccgccggtgccgcgctcgccggccccgctcgacctggcctccgccgccgcggcgtccgggcaccgccgcctctcgccgtcgctcccgccgccggcgcacccgcaggcgcgcctcccgtcgccctacggccagatctcttcggcagggggcgccgcgcaccacgcgctctcgctctcccaggcgctcttcttcttgctcgaatcggtcccggcgccgccgccgccgttagctgatctggggcgcgcggcccgccgtggcgggggccctccccggcggcggtcaacctcggaaaccgccgcccgcgctttgggcctggccgcccaggagggccggcccaccgcccgctcgcaaaaggaaatcccccttcggcctcgcggaaattaaaccccgccgctgccccccgccgggacggggcaaaacgccaaggtccccaactgccggccaaagggcggcgaaaggaaataacacccnccttttttcaacctggtaaagcccaaaatgggacctggaaggtgctggaccgcctcaaaccctcctgaggaaccgcccaaaaaacccggaaaagccgcgccaggtgggaccaccnccgcccggggagcgggccggaaaaacaccaaaaacaaggcggaaaaccctccccaccccg

SEQ ID NO: 83715 - DNA, 1251 bp, Zea mays
  misc_feature: Ceres CLONE 1569667
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1150)..(1150): n is a, c, t, g, unknown, or other
aaacgttgtcgcaagacggttacgtgttgcgcgttaccacacaacactttcttgggggggcttcnnnnnnccaaaaatggtactccccgcggtggcggccgctctagaactagtggatcccccgggctgcaggaattcgtctcacccctagaaaaatagagaactatggaattaaagttgctggatttcatgctgatacaatgcatcttgcacgactttgggattcttcaagaagaacagatggaggatattctcttgagggacttacaaatgatcatagggtcatgggtgttgttccaaaggaattgcaaaagattgggaagagatcaatgaaaaccatctttggtcggaaaaaaataaagaaggatgggtcagaagggaagattactgcaattgagcctgttgaaattttacaaagagagacagagaattgtggatctgctattcttccttagattccatgagtaccttgaccccccaccaagagcttgaaaacaaagcttgaaaggaagcccctggacttttgaacggttaccccaaaacccgggaggttccattggtaccaattttcttatgaaagaagtattggggcgtccctttccgggtggcttattcctttggaaaaaaatggaaaaccggcttggaaattgccttgttttaaacccgtgccttttttcctttcaaaaaaaatattgaaaaagagggttgtcttgttttgccccaaccccgcaagaaatcacagccttcgccaaataaaaaatttttccgggagaagtgtgggggccaatctctatatgtttctgttgcgccccctgggagtggcaataaaaatatacctggggaaatgggtgttataatagctgtgaaccacccccgctatattctccgaaaaaaacctcttttttcttttcgcggggtggggttatttgaagaaatacttattctcccatcaccctctggggtgaatattttcttccccccggaagaatgataaaaggtctttcttaagagtgcgccctaaaaaaattaaaaaccgtccctgtttctacaaaaagcaataaaaagggtgccacaaaattgctcccaaaatattgaaaccttttcctgcgctgtgggggaaaaccccaaaaaacttatttttatttctctncataatgaggtccgcccttccctctgtgggggcccctattaaacatattcggccggggaaagtccactagaattctgttttccaacaaaaaagttaaagaa

SEQ ID NO: 83716 - DNA, 1039 bp, Zea mays
  misc_feature: Ceres CLONE 1569668
  misc_feature: Translation starting site: 194
  misc_feature (792)..(792): n is a, c, t, g, unknown, or other
ctccccgcggtggcggccgctctagaactagtggatcccccgggctgcaggaattcgtctcacccctagaaaaacttttccaaatccgtctacgccctcacgcacgcggcccaactagcctaacaaaccctagctagatttagaaaaaaagtttgtccccaatccgaaccgacgaggagctcgccgccgtgagatgtccgagtacgacgagcgctaccagggcaacgccgacatgcccgctcctcccagcaccagcatgagacacaatcacatgacagtggttcctcgaaatctcgagaaagggaccgagaacgcgataagggcaaggatagggagcgtgacaggtatcgtggccgagaaaaggggagggaccgagacaggtataaggatcgtcacaacaatgacagagacagagatcgcgatcgcccccccagggaaccatcgagagcgcagcgagaaaaagggaacaccgtgatcgttcctgatgatcggtgacccgtcaccgttgatggtcgtgaaccgccaccggggatgaatccgggattctgagaaggaaaagaagatcgggaacagagaaggggcattgggaagggtatcggctcccccctccccctttctaaaaattcgtggacccgggaccccgccaaatcctagaattcctccgttccccccctctcccgatcaaaagaagcaaagccgccgtggagggggtttttttgaccaaaagccccctcccccaaacaggggacctttccctttggtgtggccggggtggggggctatccccggggncagagcttctccggggatcacccgggcccctatttccccgggggggtgggggggcctccccaaaactttttataattttggggcggggggggaaatttccaccccccccgttttttttttcgccacaagcggttaaaaaaaaggggcccccccgggttgcgccccccggtttttttgggggggggaaccccccccccaacaaaaaagaaaaaacccggggccctattttttgtgggggggtgggggg

SEQ ID NO: 83717 - DNA, 1117 bp, Zea mays
  misc_feature: Ceres CLONE 1569669
  misc_feature: Encodes the peptide sequence at SEQ ID NO. 83718
  misc_feature (755)..(755): n is a, c, t, g, unknown, or other
  misc_feature (794)..(794): n is a, c, t, g, unknown, or other
  misc_feature (989)..(989): n is a, c, t, g, unknown, or other
gcggtggcggccgctctagaactagtggatcccccgggctgcaggaattcgtctcaccccctagaaaaatcggcgcgacgacctctcccccaggagagcctaccccctccctcattccccgcgcgacgaggccgcttaatggcgggtcgcggccggcctcggccgggctcgcaccaggctctcgtcgtcgccgccgtcatcctactcctggccgccgcgtccggtgccggcgctggatcccccgatcggcccgcgccggggccgccgctgttcctcccgctcacgcgctcgtcccccaacgccagccggctcgccgcctcgctggcggcgcggcctctgcgacggggtccccccgacgcgcgcatgcgcctccacaaaaatctccccccccaccgggtactacacgacaaagggttgtacttcgggacccccccccccaggaagttcgcccctgtatccttttgacccccgggggagcccccgtcccccctaagggggccccgggccccccccttggtataataggtgggtggaaacccccccatgggatccccccgcatttttctcgaaccccgggacacccctttccctggtgttctcttaatttttctccccccgccgggtgaaaatgggtgtccacccgcgcttgatattggtgcggccccttgcgggtggaaccgacggcggagaaaccataagaagaatacactgggtggggcgcgcctcttttttgttaaaaaaggagggcgccccgnctcttctcgcctcccccagaaacaattgtgggggccccnccccgcacggcacccagtgtgggggtggcgcgccccctcccgcgcggtgttggaaaggacatatattaggcggggctgccctctccttttttgcgccaccccaaaaaatacagagggttgaagcaattatttgttcctttccgcctcacgtggtgacacgcgccggttttttttctgctcgtcgtcgggctgtgntagtctgtagactcctctccccctaccgcagtgcgtggtcggggctggatttttattcttctgtcctccgtcgctcgccctgttgcttgtggttgttgtgtcccctggcgtggcgcgtgggcgtcctt

SEQ ID NO: 83718 - protein, 108 aa, Zea mays
  misc_feature: Ceres CLONE 1569669
MAGRGRPRPGSHQALVVAAVILLLAAASGAGAGSPDRPAPGPPLFLPLTRSSPNASRLAASLAARPLRRGPPDARMRLHKNLPPHRVLHDKGLYFGTPPPRKFAPVSF

SEQ ID NO: 83719 - DNA, 887 bp, Zea mays
  misc_feature: Ceres CLONE 1569673
  misc_feature: Translation starting site: 291
  misc_feature: SWISSPROT Homolog: EC 3.2.1.4 Cellulase
  misc_feature (760)..(760): n is a, c, t, g, unknown, or other
  misc_feature (848)..(848): n is a, c, t, g, unknown, or other
ctccccgcggtggcggccgctctagaactagtggatcccccgggctgcaggaattcgtctcacccctagaaaaagactgcgccacacccacaccgcactccgcaccaaccaaccccggccggccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccgggggccgccacatcaagccgctgccggtgccggggccgccgggggccatcgactccaagtacggcgacgcgctcggggtcgcgctccagttcttccaggtccagaaggcggggaagctggagaacaccagatcccgtggcgtgtggactcggcgttgaccgacgggaaggaagcggggctggatctttccagggtatgtatgatgctggggatcacatgaaagtcaccttcccgatggcattcacggcgacggtgctctcgtggtcggtgctggagtacggggatcagatgagcgcggcaaagcaactggacctgccctcgatgcactgaagtggattacagattttcttattgctgcacatcntcctgacattgtgctgtatatccagggtcggtgaccctgatctgggaccacattggtgggaaaagccagaaacaatgacccgagaaangacctctccacagatccacaaggaaacaccccggatccg

SEQ ID NO: 83720 - DNA, 965 bp, Zea mays
  misc_feature: Ceres CLONE 1569675
  misc_feature: Translation starting site: 304
  misc_feature (513)..(513): n is a, c, t, g, unknown, or other
  misc_feature (514)..(514): n is a, c, t, g, unknown, or other
ctccccgcggtggcggccgctctagaactagtggatcccccgggctgcaggaattcgtctcacccctagaaaaattggttgcagtagcagccagccagtcacgctgttcgagcagagccccatccccgtgccaggccgctcggccctcgacgccgtgagtcaggcaggcaggcgcctctttctgtccctccacccgggtctccacgccgccgccgccgccgcctcgaccgcccccacgcatccgccgctcctctacccatcctcggcccgcggcccaggtagaagaccgcacgggcgggcgagatggaaaaccataatccattacattctcagattgctgaagtgaaaatggacatctcagcatcagcttctgttgcatcaaggaaacaattctgcaagggtggtgcctgtgatttctctgattccagtaactcctcgaaagatgccaaggagagatccacgtccatgaggaagcttataatcgcagtgatcctttgcatcatattcatgacnngtggaagtggtcgggggcatcaaagcaaacagtcttggcaatcttactgatgcggcgcacctttctttctgatggtgcagcatttgccataatcgtattctctctctgggctgctggatgggaagcacaccgcagcagccatatgggtccttcccgaatgagattcttggtggcttgggctccattcaactcatatggctacttgctgggatactggtaatagagggtattggtaagctccattaacaaaagggcaatatgacaggcctccctcaatgttgccttggtcggcctttggaacgttttccaaaattttaaaggcttgttttggtaggccatgaccccggggcccggcctgggaaccccccttggaactccaatgaacctgggtcttggtgaattcaaaaagaggccttctcccccggaaaaacaaaaagagggcctgtttctt

SEQ ID NO: 83721 - DNA, 950 bp, Zea mays
  misc_feature: Ceres CLONE 1569676
  misc_feature: Encodes the peptide sequence at SEQ ID NO. 83722
tccccgcggtggcggccgctctagaactagtggatcccccgggctgcaggaattcgtctcacccctagaaaaataaagggtagaacgtctccactctcccgtacgccgatacccactgacgccaccgcccgaagcctccccgagaaacaggagccggcgcggggatgtcgtccatctcgcggaatctccggcgatccctcgccccggaccgcctgcgccgcctctcccagcacccgcgagagtatgtgacgtcggagtgccaccgccccgtcgtcctccacaagcgcggccccgacatcctccacgacccctggttcaaccggggcacggcgttctcgatgaccgagagggaccgcctcggcctccgcggcctgctcccgcccaacgtcgtctcctcgcagcagcagatcgacagattcatgcttgatctgaaacggctgcagagatatgcaagagatggcccgtctgatacttatccattggcaaaatggcgcatccttaacagattgcatgacagaaatgaaacgatgtactacaaggtactaatagataacattgaggagtatgcacctatcgtttacacaccaaccgttggacttgtttgccaaaactacagtggtctgtttcgacgccctaggggaatgtactttagtgcagaagattcgtgggggagatgatggtcatggttgtacaattgggcagctgatcaggttgacatgatagtggtgactgatggaagcaggatattgggtcttggtgatcttgggggtgcatggaattggcatggcctattgaaaaatgggatttaattgttgccgccggccggaataaatcctcaaagggttctccctttatggattgatggcggaacaacaacgaaaacctctttagggacctctttatttgggctacaaaacacctcttgggggaatgaattagtttcatttttg

SEQ ID NO: 83722 - protein, 170 aa, Zea mays
  misc_feature: Ceres CLONE 1569676
  misc_feature (116)..(171): Pfam Name: malic Pfam Description: Malic enzyme, N-terminal domain
  misc_feature: SWISSPROT Homolog: EC 1.1.1.39 Malate dehydrogenase (decarboxylating)
MSSISRNLRRSLAPDRLRRLSQHPREYVTSECHRPVVLHKRGPDILHDPWFNRGTAFSMTERDRLGLRGLLPPNVVSSQQQIDRFMLDLKRLQRYARDGPSDTYPLAKWRILNRLHDRNETMYYKVLIDNIEEYAPIVYTPTVGLVCQNYSGLFRRPRGMYFSAEDSWGR

SEQ ID NO: 83723 - DNA, 937 bp, Zea mays
  misc_feature: Ceres CLONE 1569677
  misc_feature: Encodes the peptide sequence at SEQ ID NO. 83724
  misc_feature (608)..(608): n is a, c, t, g, unknown, or other
ccccgcggtggcggccgctctagaactagtggatcccccgggctgcaggaattcgtctcacccctagaaaaaacctcacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagccgccaaatgcgccggcgagcagccttaccgcctcgcgggcttcctggccgtctgcgccgtggccttcgtcgtgacatgcctcctccactggtgcttcccgggaggcccggcgtgggggaggtggtggtggacgcggcggctcggtgccggtgccggtggcggcgcgacggcggtggcggcggccctgccggggccgaggggcctgcccgtggtcgggagcatgtggctcatgacgggcctggcgcaccgcaagctcgcggcggcggcggggagcctcggcgccaggcgcctgatggccttctccctcgggggcacgagggtggtggtggcctcgcacccggacgtggcgcgcgagatcctcagcagcccgggcgtcgcggaccggcccatcanggagtccgcgtacgggctcctggttccacgcgccatcggcttcgcgccctacggcgcctactggcgcgcgctgcgccgcgtggcgtccacgcacctctttctcccgcggcagggccgccgccgtcggccgcccagcgcgccgttatctggggcccaaatggcccgccccctccaaggaattgtcggccgccctccccgggggggcccggcgggcttcaagttcccccccctcctgggccgggggttcctgacaaggttaatgggggccggtttccgcccgggggtacaacctggagctggaaccggccagggaagacccccaaaaccgg

SEQ ID NO: 83724 - protein, 257 aa, Zea mays
  misc_feature: Ceres CLONE 1569677
  misc_feature: SWISSPROT Homolog: EC 1.14.13.68 4-hydroxyphenylacetaldehyde oxime monooxygenase
  misc_feature (148)..(148): Xaa is any aa, unknown, or other
MATPDDRGSWLLYLSLAAKCAGEQPYRLAGFLAVCAVAFVVTCLLHWCFPGGPAWGRWWWTRRLGAGAGGGATAVAAALPGPRGLPVVGSMWLMTGLAHRKLAAAAGSLGARRLMAFSLGGTRVVVASHPDVAREILSSPGVADRPIXESAYGLLVPRAIGFAPYGAYWRALRRVASTHLFLPRQGRRRRPPSAPLSGAQMARPLQGIVGRPPRGGPAGFKFPPLLGRGFLTRLMGAGFRPGVQPGAGTGQGRPPKP

SEQ ID NO: 83725 - DNA, 948 bp, Zea mays
  misc_feature: Ceres CLONE 1569678
  misc_feature: Encodes the peptide sequence at SEQ ID NO. 83726
tccccgcggtggcggccgctctagaactagtggatcccccgggctgcaggaattcgtctcacccctagaaaaagtcgccctctctctcctatcagtcctcccagctccagctaccacagcagccctctcgcttaaaggaggagggagaagagggcggggcgagcaatgtcggagcagcagcagccattgccgcagcctcggagcagcatgcgggaggctctggagaaggaggacaaggagaaggcggcggctgctgcggcggccaaggagaaggcggccgtccccaagaacggcaacggcaacggcggcaagaatggcggcggcgccggcagcggcaacggcggagcgcccccgcagtccggggaggagacggcccgcgagatccaggtggtcagggaggcgtaccgccgcgagacggccgcgccggcctacgtcatacccgaggagccgccggccgtggtcgagctcgtcggctggtacatctacggcttctgctcctacttcatcacccacctgctgctgccggtcctcttcccggccatcatcacgcaggtcgccttccccaactccgacttcacgcccgaccccaagtacaccctcaagggcgtcacctgctccgtccaccagaatgtccatggttccaaaggcttaccaaccactccctttgtgatccatgggatccccggatgtcccccttgggccggaaatggaacggctggggccaatcgggatcctcttcgggggggcccctcctcaacccaaacccctcacctttctcgaacgggggccggtaccagtgcgccgaatccctattggcccccccgtccctttgggggtccctcttctcggcggcttaaagggtttcttccaaaacgcgcgcgggggtggtcccgtgtccacaaccctctctccaaccgcgggggtcgaacaatcgcgcccgggagggcg

SEQ ID NO: 83726 - protein, 261 aa, Zea mays
  misc_feature: Ceres CLONE 1569678
MSEQQQPLPQPRSSMREALEKEDKEKAAAAAAAKEKAAVPKNGNGNGGKNGGGAGSGNGGAPPQSGEETAREIQVVREAYRRETAAPAYVIPEEPPAVVELVGWYIYGFCSYFITHLLLPVLFPAIITQVAFPNSDFTPDPKYTLKGVTCSVHQNVHGSKGLPTTPFVIHGIPGCPPWAGNGTAGANRDPLRGGPSSTQTPHLSRTGAGTSAPNPYWPPRPFGGPSSRRLKGFLPKRARGWSRVHNPLSNRGGRTIAPGRA

SEQ ID NO: 83727 - DNA, 947 bp, Zea mays
  misc_feature: Ceres CLONE 1569680
  misc_feature: Translation starting site: 112
  misc_feature (397)..(397): n is a, c, t, g, unknown, or other
ccccgcggtggcggccgctctagaactagtggatcccccgggctgcaggaattcgtctcacccctagaaaaagtctagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggaacaccgggatcgggataaggatgacgggaaggagaaggagaggagccgcgatagccgcgggaaggacagagacagggaagggagagaacgtggagaacganaggggggacaggcaccggcccagagagagggaggtggaacgggagcggaggagcctgagccgttcggagcggcgccgtatcgaggaagaggagatggtgagggagctggagatggagcgcgagcgcatcgagcgacaccactatcgcgaccgtgacctcaggcgtaggaaagatgacggggcagagccataatttgatccataaagggaccagaggactgtattttgctttccgctatctctgaaggcagaccaaagagatgtttatgaatcctttcaaagggcggggaaggtccgtgatgttcgtcttatcatgaaccaaaaccaagacgtcctaaaggatttggattcaccccggaattttataagttggcccacatgccggggatttccgcaatttccaggaagaggaaatttgacctttcggagtcagccacagttgaggacattttgatccgtgtttttgaaaaacactggggcggttctaggattaagggggccccaaaaaccaggccaaacctccaattttgtacaaaggccggattttcggg

SEQ ID NO: 83728 - DNA, 935 bp, Zea mays
  misc_feature: Ceres CLONE 1569684
  misc_feature: Translation starting site: 217
  misc_feature: SWISSPROT Homolog: EC 2.5.1.47 Cysteine synthase
ctccccgcggtggcggccgctctagaactagtggatcccccgggctgcaggaattcgtctcacccctagaaaaaaccagtggcagtggctggccacccaatcgtctgtctcgttcgtcatctacctctccctcctccaacccaagctaagctaaacagcttacagctcgctccgccatcaccgtatcgagagagacagagacaggctagcgagggaatggagaggatgctggccaggctgatgcggcggcggagctccgtgcccctgtccggcctcctccaccacggaggagcgcccgccccgctgcaggccgccggcgccactggggcctccccgctgatcttctcgcaccagcagcagcagcagcacacggccgccgccgccgtcctgccggggctcaagatcagggactccgcgtcccagctgatcgggaggaccccgatggtgtacctgaacaaggtgaccgaggggtgcggcgcccgggtggctgccaagctcgagtttctgcagccgtccttcagcgtcaaaacagaccggcgatctcgatgctggaagacgctgaaaagagggggctcatcactccgggaaagaacacggtgatcgagcccacgtcggggaactggggcatcgggttggggttcatggcggcgctcaagggggaccaactcgtgctccccatggcgttcctaaccagcctggaaaaggagggggacaatgcgggcgttccgggcccaacctggggcggacccaccccgccaaagggatgggcgggaacgtggaagaaggccaacggacctttaccaaagaacatcccgggcgccaattgttccaacagtttccaaaacccggccaagggtaaagggggcctttaacacccaccggggccggggaaattcgggagaggaaccctttggggccgggcgtaatattttttg

SEQ ID NO: 83729 - DNA, 911 bp, Zea mays
  misc_feature: Ceres CLONE 1569685
  misc_feature: Encodes the peptide sequence at SEQ ID NO. 83730
  misc_feature (396)..(396): n is a, c, t, g, unknown, or other
acccgcggtggcggccgctctagaactagtggatcccccgggctgcaggaattcgtctcacccctagaaaaaatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctccccncgctccacatcgccgccgcgaatggccgcctcgaggtgctgtcaatggtcttggatcacggggtgccgccggacgtggtgaatcggcacaagcagacgccgctgatgctcgcggggatgcacggcaagaccgactgcgtgctgaagctcctgcaagccggggccaatatcctcatgttcgactcccagaacgggcggacctgcctgcaccacgcttcctaattcgggcacgttggggtgcttgcaggccatcctcacgggggggcgaaccacgccggggaaaaactcatggggtttcgctcgggtccgccaacgagaaaaaagaacacggggccacgtgccgtcctctcgacccaagggaagggtcgccccggggggtgttaagggtgctgttggaaaaaacggttcccaccgtcgcggcgctttaaccgggctcatgaggggtttctctgggaacacaggttcctgtcacccacgctgtttttagaagcccgtgtgccggtgtattgtttcgtg

SEQ ID NO: 83730 - protein, 122 aa, Zea mays
  misc_feature: Ceres CLONE 1569685
  misc_feature (79)..(111): Pfam Name: Ank Pfam Description: Ankyrin repeat
  misc_feature: SWISSPROT Homolog: EC 2.7.11.1 Non-specific serine/threonine protein kinase
  misc_feature (50)..(50): Xaa is any aa, unknown, or other
MGHGVSCARTGDEHDYFRAAQVGDLEALEALLDADPSLARRATLYDRLPXLHIAAANGRLEVLSMVLDHGVPPDVVNRHKQTPLMLAGMHGKTDCVLKLLQAGANILMFDSQNGRTCLHHAS

SEQ ID NO: 83731 - DNA, 924 bp, Zea mays
  misc_feature: Ceres CLONE 1569686
  misc_feature: Encodes the peptide sequence at SEQ ID NO. 83732
ccgcggtggcggccgctctagaactagtggatcccccgggctgcaggaattcgtctcacccctagaaaaatgtccaggtaaaaggaaaaatcgccccatcccctgactatcactggctcactgcccttccacctacaggttccagcggccatggtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaagcaggcagtcgctgcagcagctattgacgaggtcgcccctgtaggtgcaggcactggtgatggcgatgcatctgcatcagcggctttaccgcaaccatccgatgttgccgaggcattacttgtggtgcaaacgccaaaagtcaaccacttttgctgaggcatcacctgtggcacagacgcagaagccagccactgatgctgtaaggattggtgcctgcaccaataccaaccactgctgtagcatcagcttcgttgccaaaacaaaaaccagctcaagctaatgctgatgctgcagctgcaatttctgccagcaagggcaatggtgtgggtgctaataatagtaggggtgatgggtgagatgaagaacagaaagagagggccatgagtgacaagggaaaggaggtatggaggaaggagaaagtaggggaaaaggggtaggggtttagggtccctcccccccttttcttattggaataaaggtggaacgatgggtgtggtggggccagttcgtttccttggggccctccaccgggtggtgtcccatgtgtggccgtgcggccgcccgcgggtgtatgatgaggtggtaaatggagggagtgtgttaaacttctttaacgtttttatttgg

SEQ ID NO: 83732 - protein, 100 aa, Zea mays
  misc_feature: Ceres CLONE 1569686
MVKKPNGVAKATATSADAAAQPSKENPSTPGLVKASKFKKRKVKANRAKQAVAAAAIDEVAPVGAGTGDGDASASAALPQPSDVAEALLVVQTPKVNHFC

SEQ ID NO: 83733 - DNA, 1022 bp, Zea mays
  misc_feature: Ceres CLONE 1569687
  misc_feature: Encodes the peptide sequence at SEQ ID NO. 83734
  misc_feature (643)..(643): n is a, c, t, g, unknown, or other
ctccccgcggtggcggccgctctagaactagtggatcccccgggctgcaggaattcgtctcacccctagaaaaagccacccattcctccgctcttccttaattcctcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgtttcggagaagctcgtcggggacgccccccagaacccaggtcgcccttgaaccccccccacacccctctttcaacgcgaaaacggttcatccgggcggggcctttttctgaaacgttcggtggcaaaagggacccccaagcttattggccttttccaaaagggatccccgggggatgccggggaaaaaagcccccatttatccggggggggcgccttttccagggggggcgaaaggaaagaaaaacaattttttctggggggcccagaaggaaaaaaccaaccctccccccggggaaaccctcggnaaactcaaaaatttttaaagggggatgaaccggggccgccaaagaggtttttttcccccccggggggggcaccaccccccttttttaaagaaaaaagacgcgtgtgtttttttaatccggtgttccccggcggggcgtttatttttttaaaaaaaatacaccttctcccgcagcggcccgaagagagggctccatctataggggtgaaccccccggcgggaggtttatttttttcccggggcggggccccaataagaatttggtgggctcgtccgcccacttttttatattacaaaggatagagtgaacgggtgaggtactgccgcggggttgcccctgtgaatagtatgggtgggggcgaccaagaaaaaataagaag

SEQ ID NO: 83734 - protein, 64 aa, Zea mays
  misc_feature: Ceres CLONE 1569687
MAGKGDGPAIGIDLGTTYSCVGVWQHDRVEIIANDQGNRTTPSYVAFTVSEKLVGDAPQNPGRP

SEQ ID NO: 83735 - DNA, 1011 bp, Zea mays
  misc_feature: Ceres CLONE 1569688
  misc_feature: Encodes the peptide sequence at SEQ ID NO. 83736
cggccgctctagaactagtggatcccccgggctgcaggaattcgtctcacccctagaaaaaatttccgagcgatttcctcgtcatttctctcatccgctgcgctccctctcccactcggcgaagaagggggggaaagctcgaaagcgggagccggcgagcgagatgggcgcagggagcagccgcgcggacgcgccgtcgcggcgccgggcgcgcctcagcctcggcgggtgcttcggggccggatcctcctcgtccgcgcacgacggcgggagcttcgccgctgccggggccctcctcctcgcgcgccttcgaggtacaatcacgacagtcagggcgacaagtgagtgccctgaattttcaggcttctctagctggctaggaccccaacgtttccccgtgagttaaaatccgaggctggatttcttctttcaaggcccttaaggccctccttctcaaattttcatccccctcccatttccctggaaaaaccagggaaaatatggccctgggggctctaaaaaacaccccgaaaaaaaagggggggccttctaaagggccctcctttggggaaaaaccctttccctttggggttaagggggggaaaatctctccctcttatataaaaaaacaccttcttttttttgggggggaaccatctttttcgggggggagaggaaggaaaaaaaaagtctccctgtgggggggacccacaagagcgcggggagaaaaatgtgttctctctaaaacaaaaactccccccacacaaaaaaaaaaatttgggggggggcccccccccctttcttaaaaactcgggggggtggtgggccccccccctcccggggggaaactctttttataaaaagtctctctctctcaccccaagagaaaagataatttttcccccggggggggccccccccccccttttggtaaagaaaggagaaaaaaaaatgtcctcccatcctggaaaaacgggggtttgctccccccccccccacccgctggggggg

SEQ ID NO: 83736 - protein, 80 aa, Zea mays
  misc_feature: Ceres CLONE 1569688
MGAGSSRADAPSRRRARLSLGGCFGAGSSSSAHDGGSFAAAGALLLARLRGTITTVRATSECPEFSGFSSWLGPQRFPVS

SEQ ID NO: 83737 - DNA, 1000 bp, Zea mays
  misc_feature: Ceres CLONE 1569689
  misc_feature: Encodes the peptide sequence at SEQ ID NO. 83738
ctccccgcggtggcggccgctctagaactagtggatcccccgggctgcaggaattcgtctcacccctagaaaaatgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggaccgccgcaacatcaccgtccacgaggcccagttcccccgcggccctggaagcggcggccgtgggtaccggtggtggcccttgaaggccggcggctacggcggttgccgggccgccttgattggcggccggcggcttaccgccggtggggggggggccgggctaccgggggcggcgggcgggctaccgggggggggtgggcggggggcttacggggggggggcaaaccgttgggggggggggtatcggggaacctccccaagggggaaacctggagggaaacctgtacccggggggggccccccccccgggcccaaatttttcctggttctccctacccggggttgtttttccccttggtcccaaagaggttttttccttccctcccgcccacaggttttggttgtgggcccctccggggttttttgatttgcaagggccccctttgggcccatttgttagggggtggtttataccccggggtcccgggaaaccttgtatttacccactttggaatgcggatatcatggggtgtcttttccccccctagggcttttcccaattattctccaggaaaaaaaaaacccgagcccggcttttttctta

SEQ ID NO: 83738 - protein, 216 aa, Zea mays
  misc_feature: Ceres CLONE 1569689
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDRRNITVHEAQFPRGPGSGGRGYRWWPLKAGGYGGCRAALIGGRRLTAGGGGAGLPGAAGGLPGGGGRGAYGGGANRWGGGYRGTSPRGKPGGKPVPGGGPPPGPKFFLVLPTRGCFSPWSQRGFFLPSRPQVLVVGPSGVF

SEQ ID NO: 83739 - DNA, 914 bp, Zea mays
  misc_feature: Ceres CLONE 1569690
  misc_feature: Encodes the peptide sequence at SEQ ID NO. 83740
  misc_feature (485)..(485): n is a, c, t, g, unknown, or other
  misc_feature (875)..(875): n is a, c, t, g, unknown, or other
gcggtggcggccgctctagaactagtggatcccccgggctgcaggaattcgtctcacccctagaaaaaccccacgccttgtctctgaactctgatcagagatcaaagaggtagccgttaagttaacgatggcttccgccgacctcgcagaggccatggagcccgggaagaagagcaacgtcaagtatgcttccgtctgtgccatcatggcctccatggcctgcgtcatccttggctacgacattggtgtgatgagtggggcggcgatttacatcaagaaggacctgaagatcacggacgtgcagctggagatcctgataggcatcatcagtctctactcgctcttcggatccttcgctggcgcgcggacgtccgacaggatcggccgccgcttgaccgtcgtcttcgccgcggtcatctttttcgtgggcgcgttgctcatgggcttctccgtcaactacggcatgctcatggtggggcgcttcntggccggagtttgcgtgggctacgggggcatgatcggcccccgtgtacaccgccgagatctcggcgggcggcgtcccgcggcttcctcacgtcccttccctgaagtcttcatcaacctcggcatccctgctcggctacctgtcgaactacgcatttgcggggctccccgctcacctcgggttggcgggttatgctcgggatcggggcgggggccgtccgccctgctccgcgcctctggtgttctgcatgcccaaatcccctcggggggctgtcattaagggcgccccgcggcaccccgggggggtgctaaaaaaaccctcgcctcccccaaagaggccccaaaacggctggcttgaattcaggttgcccggggtattccaaaggaccccnacgggaaactgggtcccgctacccaaggagcaaaacagg

SEQ ID NO: 83740 - protein, 202 aa, Zea mays
  misc_feature: Ceres CLONE 1569690
  misc_feature (111)..(111): Xaa is any aa, unknown, or other
MEPGKKSNVKYASVCAIMASMACVILGYDIGVMSGAAIYIKKDLKITDVQLEILIGIISLYSLFGSFAGARTSDRIGRRLTVVFAAVIFFVGALLMGFSVNYGMLMVGRFXAGVCVGYGGMIGPRVHRRDLGGRRPAASSRPFPEVFINLGIPARLPVELRICGAPRSPRVGGLCSGSGRGPSALLRASGVLHAQIPSGGCH

SEQ ID NO: 83741 - DNA, 983 bp, Zea mays
  misc_feature: Ceres CLONE 1569692
  misc_feature: Encodes the peptide sequence at SEQ ID NO. 83742
  misc_feature (397)..(397): n is a, c, t, g, unknown, or other
ggccgctctagaactagtggatcccccgggctgcaggaattcgtctcacccctagaaaaacttctcgtccccgctccagtggatgccccatccctccattcaaggttggtggcgggtgcgccggtgtctctctcagcccctcgtcaaccggatggtcacactgccacgccatcgctacacgcagtagtaactgcactggcatagcgacacggcaggcacacgcttcttccccgtgcttgcagtcgcagtgcagctgttcccacactacaccccgtcagtctcggccactgcatagtctcaagaagcagatatggagttgccaagatccatggccgttcttgtgctcgtgttcgtcgtcttgtgccgagtgggggaggccccaactttcacgttcgtngaaccgtgcacggacacggtgtggcctggcgtcctgtccaacgccgggagcccaatgtctggatcccacggggttcgagctcccgcccgggcgcggcgcccgcggttgccggcgcccgccgggctggtaaggcccaaatgtgggccccccacgggctgctcccaagaatggcgggaccgggggcggtccttcttgggccacggggggaactggggcttccggctcaaccctattgctccgggccccgggcccggcgcccccccggccacattggccaaatttcacgccccaacgggaaggggggggggtggaaatttaaaaaatgcaagcctcgtggaaagggtaaaacccccccgtggggtggtggaaacccccggggggggaaaggctccaggggggccacccctttggccccggggcggggtggcgccggggaaactaaaacctattggccccccccaaagccccacaacgggggggggggggccctttcaaaaaaacactttaaaccatttgggcgcgcccatatattgtgtaaagagggcccctctcttcccccggggtgggtgcgggccaaaggtgtata

SEQ ID NO: 83742 - protein, 224 aa, Zea mays
  misc_feature: Ceres CLONE 1569692
MELPRSMAVLVLVFVVLCRVGEAPTFTFVEPCTDTVWPGVLSNAGSPMSGSHGVRAPARARRPRLPAPAGLVRPKCGPPTGCSQEWRDRGRSFLGHGGNWGFRLNPIAPGPGPGAPPATLAKFHAPTGRGGGGNLKNASLVERVKPPRGVVETPGGGKAPGGPPLWPRGGVAPGKLKPIGPPQSPTTGGGGPFQKNTLNHLGAPIYCVKRAPLFPRGGCGPKVY

SEQ ID NO: 83743 - DNA, 1112 bp, Zea mays
  misc_feature: Ceres CLONE 1569693
  misc_feature: Encodes the peptide sequence at SEQ ID NO. 83744
ctcaccgcggtggcggccgctctagaactagtggatcccccgggctgcaggaattcgtctcacccctagaaaaatcgtttcaccgctattcctcctgccccatctcctcccgatccatccgagcccaaaccctagtccagccagatctccgccgccgccggcgagagcacggcatcagatccgccgcgatggcgttccgccgcatcttatccacagcggtgcgccgccgctcggccatcgccgcggcagcggccggggacgcgcgcgaggcctccacggccgtcgccgcggcgcccggcgtgctagcccccgacgcgaccccggtgcgcgctcccgtgatgccgtacgatcgcatcggcgaagccgttaacgccaggttccgggggttaaacccccaaaaccgcggctttcctccgtttggaaaccccggggccgttccccggccggaccaaagggccatccttgtgggcgccggagaacccggggtcaccacgcctgcccaaagggccttggcggtgggcccccggagttttcccctccccgggggggaagggataaggggggggggtgtggtatttattgccggggcatgtggtgacaaaaaaacgagggagggggggccgggggctccggccattttttggccaaagaaaacagttggtgttttccagggggggcccggggggaaaagccggtttcccccccgcgcccacacctcggtggggccggcgggaattattttaggggaacctggggtgggtggggcccacccatcacagccctttattaacctgcccgggggggtggcgtacaaaaaacacattttgtttcgcgcttagggggggtcgtttataaaaaaggaaggttctccctccctcggtgggaaataggggtagtggccctctctcgggaggaagatgcctcgcgggagaatagaggtgtctatcattctccttaattcacctgctcctccgtctgtttgatagagtagattggcctgacggagcagcgcgtatagctctccgtcttcttcatactatggttccgcaccatggtaagagcgtatgggtgtgtgtggttgccgtccatacgattaggcgctcgtgttgtgt

SEQ ID NO: 83744 - protein, 216 aa, Zea mays
  misc_feature: Ceres CLONE 1569693
MAFRRILSTAVRRRSAIAAAAAGDAREASTAVAAAPGVLAPDATPVRAPVMPYDRIGEAVNARFRGLNPQNRGFPPFGNPGAVPRPDQRAILVGAGEPGVTTPAQRALAVGPRSFPLPGGEGIRGGGVVFIAGACGDKKTREGGPGAPAIFWPKKTVGVFQGGPGGKSRFPPRAHTSVGPAGIILGEPGVGGAHPSQPFINLPGGVAYKKHILFRA

SEQ ID NO: 83745 - DNA, 976 bp, Zea mays
  misc_feature: Ceres CLONE 1569694
ctccccgcggtggcggccgctctagaactagtggatcccccgggctgcaggaattcgtctcacccctagaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcggcgttgtgaatttgatgtactaatggagcctaagggtgggcaagaagtctagcagtagtcgttccatggatgtatgaaacccccccttgggctacaggatttgaggaacgttccaacctgcccggaggcccacgaaaaagttccaggtcttgttggcttttctcccaactggggggaaaaaaaagccccccccggagatccccctttttggggcctcccccccgggtctaagaagggttggagggaaattttctctttttttgggaccccctcttatttgttgttgtcagcagaaccccccccccaccggggggccggggcggagttttttttttttctgccaaacaaaaaaaaacggaggggtgtctcccccccacccctcccgtgggcccccccccccccgcctaatccgaatttgtcgccgcccctcccttccttgctctttttcctctcaagcaccggtgtgtgttgtttttttttctctctttcccacccagacccccgaaccagggggagcggggggttgttcttttcttttctctccgcggaagggggggtgccgcccccgccctccgcccaaggccaattacccaaaaatatttatttgtttcccgtcttcgtgcctttggttgcgcgtttattatatcttacaccactcc

SEQ ID NO: 83746 - DNA, 925 bp, Zea mays
  misc_feature: Ceres CLONE 1569695
  misc_feature (70)..(70): n is a, c, t, g, unknown, or other
ccgcggtggcggccgctctagaactagtggatcccccgggctgcaggaattcgtctcacccctagaaaanagagacatctgcacatagcgtgacgggtcttttagggtgggaacgcactcgccttcctgggttccccgcgtatagtggagggtctggtcgccagcatgaccatgctactctcgctcagaccccaggtgtgaatacgccatcatgtgcggcatcctctctgtcctcggcgtcgctgaggtgtgctcgtgtagggctccaacatctctgaggtctcacgcacgttacggggccgagggactgattgcagtgacttcctctgccatgaggatgatggcctcgcacaccacgaggtggtctattatcgatcctacatccggacaccaacctccgtacgatgaggatcaaactctttgtcgtgacggcgaacagggagatctcttaccgtgcatacttgacagctgagatcgatcactctcgatggcccagctggagggtgtctgtgaaaatatacccccatcgttcctatgactaggacaaatactgcgaggatacgctggacagaacgctctcccagagtgtgtcctgacacacgtggaaaaagctccctcccggctccccgatctctttggcatgtaccctgtaactttggcaagggcgctacatgcatcgaaccggtgtacggcgtagacaaggcttttatcgcgattgtcgacccggagtaaattgggcctcgggccttcctcaccgggattagggtggtgtaaagaaactgtacagcctccagggttttcagggaaggacctggagcccttttaggttctttccgccaggaactttgaagaagctctttaccagttgaaaattggtgcatctttcccattgtttggaggatggcctttttggtgaaagctgaga

SEQ ID NO: 83747 - DNA, 1229 bp, Zea mays
  misc_feature: Ceres CLONE 1569696
  misc_feature (31)..(31): n is a, c, t, g, unknown, or other
  misc_feature (32)..(32): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (71)..(71): n is a, c, t, g, unknown, or other
  misc_feature (72)..(72): n is a, c, t, g, unknown, or other
ctttcttcggtgcgcggccttttcttctttnncctcttttnnnnnnnnnnnnggggggtnnnnnnacactnnagctcacgcggtggcggccgctctagaatagtggatcccccgggctgcaggaattcgtctcacccctagaaaactctcatcttgagaaagaactcctcgtcctcgctccctccccaaccatcaagagcgcacacgcacacgcacacgccgcgcgcaagccggccgacgtacggcatggaaaagagcgctacaactggcggcggcggttcaagcggcggcggagaggcggcggaaggatcccaaggtgcctctgccgcaacccagggctgcccccgccgcggcgggcaaggaggacctcgccagatgatgtggataccaccggaagggcggtttttgttgtttttccctcccccccgcgaggggggggggggggggggggttttttttttctttttccaaaccccccccccccccccacccatgagggcgcattccgccgcgcccgggcgcgcgcaccttccgccgcttttgtgccggcgcttcgggggccggcggcgtcctgcgcgtggtccgcgcctcggcgcccccgggtcccctgctccgttggcacgttgtgttaggagcggaccatcctccccccccccgttatccgggggtgcccgcagggcgtgtcccggaggggacacggtggggggccttcccgtgaggcccgcagtttaccgctcgtacgggttgcccggtctgcccggatgagctctggtcatggctctgcctgggatcagcgccgcgtcgggtgtcgggcacctgggatgttgaccgatccttcgggcggctgtgtgcccgttgtgtccctcccgtagacgttgtggcccggccgggtggcagtcagcgctcgacctcggccggacggcgccggtcgtgctccccccaccggatgttcgataggtccgcccgcctcctgcctccgcaccccgcggcctctatactcgtgaatggcccgcgcgctctctcagcgtggtcgccctcatagagtccctatgtgcgtgctagactgtgtgtcggggcgtctggctgcgtttgcggagttgctctttttatagctgccttgggcgcgcgcgtgcgtttgtggagtatgtcggccaccgccggcgcacctctgtttgtacttgacgacccagccaccatcgccgatgtgtgcccgcactgggtgctctgcg

SEQ ID NO: 83748 - DNA, 953 bp, Zea mays
  misc_feature: Ceres CLONE 1569698
  misc_feature: Translation starting site: 200
  misc_feature: SWISSPROT Homolog: EC 5.3.1.9 Glucose-6-phosphate isomerase
  misc_feature (395)..(395): n is a, c, t, g, unknown, or other
ctccccgcggtggcggccgctctagaactagtggatcccccgggctgcaggaattcgtctcacccctagaaaaaacctcgtggactccttcccccaaaactaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcggctgcgccggcaccttctgctccggccctcccacctccgcctccgcgcgccccactccatcgccgacctctcccgctcctccaattccgccccgagcccggcccgcccagcgctgggctccggcccggagaacggcaccngcggcgtccgcgcggtggagaatgacccgatcaagctgtgggagcgctacgtcgagtggctctaccagcacaaggagctcggcatcttcgtcgacgtcagccggatgggtgtcacggtaggagttcctgcggcagatggagccgcggatgcagcatgccttcgtcgacatgcgggagctcgagaagggcgccatcgccaaccccgacgagggtcgcatggtgggccactactggctccgcgaaccggccctcgctcccaatcccttctcccggaacagatcgagaccgccctcgacaaaatcctcgcccttctccaagaagtcatctctgggaaaaatcttttcccctcggggcgtttcccttcaattctcccaataggaaccggaaggtcagctttggggcccctcaattttttgccaaaggcctttgaccctgataaaccctccctggaaaatagaatttttggacaaaccacaaccgcgcggggattgatcaccaaattgcccaactagggaccggaaccgggaaccaccccttgtatttggcatttcacaaaag

SEQ ID NO: 83749 - DNA, 958 bp, Zea mays
  misc_feature: Ceres CLONE 1569700
  misc_feature (397)..(397): n is a, c, t, g, unknown, or other
  misc_feature (421)..(421): n is a, c, t, g, unknown, or other
  misc_feature (455)..(455): n is a, c, t, g, unknown, or other
ctccccgcggtggcggccgctctagaactagtggatcccccgggctgcaggaattcgtctcacccctagaaaaacccactctcccccaccccccgcacccgccgtcttcccctccctcccccgtcagatactcagatcttccccatatctctgtgttgcatcactcgccgcaatccactcccaatcctaaacccgaaagctctcagctccgcctccctgttcgttcgtccgccttttgactcccccctagctagcagctgttgcggagcaaccccgcaattccaagaaaagcaactggtcaagaaagagtggaagaaaggaggatggtggtgatgatggcgttaagtcaccccatgattcgccccatcattccgtcgcctccagggcctgcgtgccncttaaagggtctcgccgtccgtcntggtggtggtgtgcctgggcgggggggatcctcnctgcccgccacaatgccgcagtaccaggagctgccctgccggcggcaggggctcgacatcgacaccgggctcaagaagggatcctccggggcccccctggaaccccaagaagcgccggcgggggacccccgggaaacaccctgtggaactccccaaaaataatgaacaaccttgaacccggccggggaacggcggggggaaaaaagggggggccggggggttttatttggcccaatttccctgaaacccatgggtgggatccggggacacctcccgccggggggaaaaaattaaaaaggcgccaaaatttccgggggggtcccccccttggggccccggaaactcgcccaaaacccaaaataagaagaaccccgggggataaaaacccctcccccccaaaaagaaccttttcccaaaaagtatttttttgcccgccgggttttccctcccgcggggcaaagaggtgttttaaagaaccgcccgcgggatatatcctcggcggc

SEQ ID NO: 83750 - DNA, 969 bp, Zea mays
  misc_feature: Ceres CLONE 1569703
  misc_feature: Encodes the peptide sequence at SEQ ID NO. 83751
  misc_feature (522)..(522): n is a, c, t, g, unknown, or other
ctccccgcggtggcggccgctctagaactagtggatcccccgggctgcaggaattcgtctcacccctagaaaaaattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtggcgcccgaggtgggcaggggtcgtcgtcggcgaccacaatgctcagcaggcggngcagctccctccgccgcccgccgctgccgcggtggtccctcgcaacgaggcgcccgccgtcgtaccgagaactgtggtggctcctgcggcgcccgaagacgagcagctggcggtgaccacccgtgacttgatgcacctctggcggctcgtccaagaaaaggacagtggcccgtcctggatccacatgatggaccgcaccttgccgaccatggaggtaccagcctggcggatagacccacccaattggccaccaccagtccgccagtacacttcctttgaggaggcccacaaaagggggggaaaattccttctgggaccacaagttccggtgaaaaaaacctgggaaaaatgctttttctatcaagaacctggaaattggcccaaaacgggaacctgggttgccgggggggtcaagaatatcccctccctccccagcaaaggggataa

SEQ ID NO: 83751 - protein, 211 aa, Zea mays
  misc_feature: Ceres CLONE 1569703
  misc_feature (63)..(63): Xaa is any aa, unknown, or other
MSALLDLLMGIFRQQTLGGAALELAALAAPLWLAALVGLLIGWAWRPRWAGVVVGDHNAQQAXQLPPPPAAAAVVPRNEAPAVVPRTVVAPAAPEDEQLAVTTRDLMHLWRLVQEKDSGPSWIHMMDRTLPTMEVPAWRIDPPNWPPPVRQYTSFEEAHKRGGKFLLGPQVPVKKTWEKCFFYQEPGNWPKTGTWVAGGVKNIPSLPSKGD

SEQ ID NO: 83752 - DNA, 1117 bp, Zea mays
  misc_feature: Ceres CLONE 1569706
  misc_feature: Encodes the peptide sequence at SEQ ID NO. 83753
  misc_feature (315)..(315): n is a, c, t, g, unknown, or other
  misc_feature (318)..(318): n is a, c, t, g, unknown, or other
  misc_feature (1063)..(1063): n is a, c, t, g, unknown, or other
acccgcggtggcggccgctctagaactagtggatcccccgggctgcaggaattcgtctcacccctagaaaaactctcctctcgccccgcctcgtcatgtcacgtctcccaaagtcccatctcgccttcgcttaaacataaaccacacccatcgcacccagccagccctcgccatccatggccaccaccgccgccatccacctgcgcccgctccgttccgtcgccgtctcctccgcgaggtcacgctcgctcctccacctcctcgcccggcccctctcctcttccaatcgtcctacgcctaccgcccttcccctanagngcccgccggccgcgcccccaaacatgtgcaccaccctccccatcaccaccagtcggggcctccccacagaacccccccctgaggggtgcgggcagggaacatccggctccgccggccccggggggtttggggccccccaccgcgcgaagaaaccagaatgtggccgccctccccgcaccacggggggttaggggaccctcccccaacgcgccttcaaaaaagggccaatgaatactttggcggggcctcgcgcccgggataaaaggggccaagggggccccccccaccccccgggggccgaaaaatgtatatgggggcccccgccggtgtaattcacgggggggcccggggaaaactcccccccccccggggggggcgaacgaaaattgttccaccgccgcccacaaaggtggtccccgtgggggggctccctcacacaagaaggggggcgagcaaatggcgtgataaacaggccgcccctgcccgacggagacaataagaggtggacgaggggcccccccacacccacgccagggggggaataaaataatagaggcgccgcgctccgccactacagaaggagcgagggagaggctccgccacccccacatcatagagaagggctaccgcccccccctctacattttgtcgtgagcgtcccgcaagatagaaaataagcaccacccgcctggagtgggctggaaaaaaaaggacccggatattctccttcatggggggggcgagncgcgtcaagaaatataaaatgaggggggccgcgggtccaccaatatgtgggggg

SEQ ID NO: 83753 - protein, 182 aa, Zea mays
  misc_feature: Ceres CLONE 1569706
  misc_feature (105)..(105): Xaa is any aa, unknown, or other
  misc_feature (106)..(106): Xaa is any aa, unknown, or other
TRGGGRSRTSGSPGLQEFVSPLEKLSSRPASSCHVSQSPISPSLKHKPHPSHPASPRHPWPPPPPSTCARSVPSPSPPRGHARSSTSSPGPSPLPIVLRLPPFPXXARRPRPQTCAPPSPSPPVGASPQNPPLRGAGREHPAPPAPGGLGPPTARRNQNVAALPAPRGVRGPSPNAPSKKGQ

SEQ ID NO: 83754 - DNA, 1008 bp, Zea mays
  misc_feature: Ceres CLONE 1569707
  misc_feature: Encodes the peptide sequence at SEQ ID NO. 83755
  misc_feature (402)..(402): n is a, c, t, g, unknown, or other
acccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggtccacngatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatggcgggagattgctgaagcctaccttgggtgccacggatcaagaaatggtgggggcccagcccccggcctacttcaatgagctccagaaggcaggccacaaagggatgctggggtggattgcctggcctttaatgggggttgcgtatcattcaaggagagccaacggggtgcgggcttttcgccttgtggccttggacaagaaaggctaccccgggtccggggaaaaagaaaggcccccatcctttggaagtgtgggagggggggcccttggagtggcccccccgccggcccattggggggaaggagactttttggggcaagggccccaggggtgggaaaccccgctcttggggggtggagggatcttgtaaaccagggagggtgtcacgcccttctgtcgcggtgtttctagggggaagatcagtggggggtgtttcgtgtgtccgcgggggtgtgccg

SEQ ID NO: 83755 - protein, 135 aa, Zea mays
  misc_feature: Ceres CLONE 1569707
MAGKGDGPAIGIDLGTTYSCVGVWQHDRVEIIANDQGNRTTPSYVAFTDSERLIGDAAKNQVAMNPINTVFDAKRLIGRRSTDASVQSDIKLWPFKVISGPGEKPMIVVQHKGEEKQFAAEEISSMVLIKMAGDC

SEQ ID NO: 83756 - DNA, 903 bp, Zea mays
  misc_feature: Ceres CLONE 1569708
  misc_feature: Encodes the peptide sequence at SEQ ID NO. 83757
acccgcggtggcggccgctctagaactagtggatcccccgggctgcaggaattcgtctcacccctagaaaacagccaaatcattcacgtattcatcttcaagccagccgtctccttatcctgcgatgccgctcacctgggctcatcttccagccgccctctccgcccagcagcagagcacaccatcctctcaactcggatccccaagccctcgcctccagctcttgccacggcatccatcccctgctcggacctccacccggccgcgtcctcgccggtggccagcgccgctgcatcgcccttcctagcgtcggccttggcaccgcttccccgagcgccccagtcgagctcgcccatcctctgctctagccctttctccacgccgtcgctgagctcgcccctcccctcagccatggacacgacgacctgcagcccttcttggtggccaagcccatcttcctgctcgcgccccctcttttccacctctgcgcgtatcagctcgtccaacccccatggtgtttcctccctctcggctcccttgctccctccccatggcgttccccctggatggtggtgatctgttccccacggtgcaggcaaatgttctttccctccctgcagcagcaccttggtggttgtcgagcaacacgtcgcgcctgcgcagcctcggtcacgacgttgttcaccccgcctaccattggtgtcatacctcacgtgtcatgggttcgccgaaatgcctaacatggagtccggcgtcgtcctatccacagtcaattttagtcatgggggaccttggtacagcatcccatggatcagaatagaaccgggaaggaaaaggggaactggttaaagttcagaagccctctccgggaaacccggccccggaatggctgctttatttttt

SEQ ID NO: 83757 - protein, 54 aa, Zea mays
  misc_feature: Ceres CLONE 1569708
MDTTTCSPSWWPSPSSCSRPLFSTSARISSSNPHGVSSLSAPLLPPHGVPPGWW

SEQ ID NO: 83758 - DNA, 969 bp, Zea mays
  misc_feature: Ceres CLONE 1569709
  misc_feature: Translation starting site: 138
  misc_feature: Pfam Name: MTHFR Pfam Description: Methylenetetrahydrofolate reductase
  misc_feature: SWISSPROT Homolog: EC 1.5.1.20 Methylenetetrahydrofolate reductase (NAD(P)H)
ctccccgcggtggcggccgctctagaactagtggatcccccgggctgcaggaattcgtctcacccctagaaaaacgctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgccgggggatccaccgctgaccttaccctcgaaatcgccaaccgtatgcagaacatggtgtgtgtggaaaccatgatgcacctgacatgtacaaacatgccagtagagaagattgaccatgccttggaaaccatcaaatccaatgggattcaaaatgttttgggccctcagaggggatcctccacatgggcaagacaaatttgtgcaagttgaaggcggatttgcttgtgctcttgatttggtgcagcatattagacccaagtacggtgattattttggcataactgtagctgggtaatccagaagcccaccctgatgcgatacaaggtgaaggaggtgctcctttggagccttttgcatggatcttgcttacttgaaaaaaaaggttgatgctggggctaaccttatgttacccaacttttctttgaaaccaacaccttctccaatttgtgaatgactgcccccaatatggttttccttgcccctttgttcctgggcataatgccaataataacccaaagggtttcccgccctgaatgggttctcaaaaactaaaaacccttcgaaaaaccgggcggccctatacccctcaaagaaaaggaggaggcttttaaaaatatggataccccctggggaacgggatgggccaaaaaatcctggccgcggatta

SEQ ID NO: 83759 - DNA, 1284 bp, Zea mays
  misc_feature: Ceres CLONE 1569710
  misc_feature (10)..(10): n is a, c, t, g, unknown, or other
  misc_feature (41)..(41): n is a, c, t, g, unknown, or other
  misc_feature (64)..(64): n is a, c, t, g, unknown, or other
  misc_feature (318)..(318): n is a, c, t, g, unknown, or other
agggggtgcnaaccacccccctctctacacactactaaccnatcgaaacacatcattcttttanatatttctgggactccacgcggtggcggccgctctagactagtggtcccccgggctgcaggattcgtctcacccctagaaaacagaaccagctccaacccatccagaaccagctcgccccggccgccgcgaccgtcccccctcatcgactcgaggcaacgaagcggccggatggggagcagcagcctggaccctggacccgattgagcccgcccgccatgctgctgcccgtttggctccgccgcgtccaggtgntcccccctctggcctgtgacgggcctccacgtcctcccgcgggtggctcggaagggtggacgtcgggccccccgctcagggcctacggcaaactcgttcgtcgcgcaggtggccccaaacgagcgggggttcgccgaattcctccttatcgctcccccccctttgtgggcccctgtgaaaaaaacccccccccccccttttgccccccccaatatttccaaaatttgggggggggtccccccggggggcgttatggccccccccgtgggggatttgttggggggcgggccccccgtcgtgagccccccggggcgtgtggagttgcaccacacctttgagcccgggagattgccccgtgggggccatatgggggggttccgcaggcggatcgtccgcccaaaaacggtgggccccatgtggtgtggaaacccgcgccgtttacaccacctattatagtgtggcccaggtgttttaaaactatatctcgcataaaccactactgagagacggcgaccaaggtagcctatcatgtggtgtttgctacttcttcggcgtgcctctaggccaatggcacgggtcgcctttgttccagcgtggtttaatataataaatgaggatgttgatccctaccaggcgcgcgtcgattctccttactcattgtggtagggatggtacctcctcctttgtgagttaggaactgtgttgtgctggtgtccccatgaagaaagtgaggatgctcggtgctttccccctactccacacaatgatagttgtggtggtatgagagctctatcaggctagatcgtcccgtcgagtcttcgagataagtagtggcgccctcatatcgaagaggaatgagatgtctgggatgatatcttcctcgcgacactcgtggccgtgctcatataatgtggggtggtggtgttaccgcaggcatatctcgaccggtgttttctatatcttcgt

SEQ ID NO: 83760 - DNA, 1034 bp, Zea mays
  misc_feature: Ceres CLONE 1569711
  misc_feature: Encodes the peptide sequence at SEQ ID NO. 83761
ctctagaacttgtggatcccccgggctgcaggaattcgtctcacccctagaaaaagcaagcccttccggtcctgcattttgttgtcccctcccctctccgtagcggagacgttcgttcactttctctctctcgcctcccgtttgccccgcgtgcgctctgtgtcgctccctctcttgtgaggagtgaggacgactggggcgaccgccgccgccgccgccgccctacgccagatgcccagttgctgatgcaaggctttcaaaagtttaacagtctcacttgatgcaaaagcaacacaatcactctaaaggtttggatcagtcatttcagagcatcggttcgcggtttccatcccatcagctaagcaatgggttgtacgcccccggcccacctgagcaacctaaatagaagggcccagtcttttgctcctcggctatgccgtacacttggcgggggacttaaagaaattctggagaacttggaaaggatgtttgattctccgtaagaaaattctgggtccctttggggaatttccccctttcaagggaatatctttccctttgggtggggggctggcccccccaatccttgggacccaggttttcccaatgggtggttcggggcggcttccaaatatcatctggggttctctattttccgctcttccaggttccctctgggcaacttggtggaggattttctgctgggggataaattacttgttaccgcgtggggtccctcttcttcataggggtgtggtgtgtgccctctagaagtgtaggggccttcttggggccccccaaagttttttggttgtttttaccccctattgggccccgtgctagtaattttggtggcgcgccctgcctcgcggtgtatttcctttaaatcgtgggccgtatattatcgcctggggccttgtcctcgtccgggggcgtggatgtgctgttttggagtgccagagaggagattttccgcgcccccttgtggattgcggctttattggttttgagttgtctctgtctctctttttttg

SEQ ID NO: 83761 - protein, 41 aa, Zea mays
  misc_feature: Ceres CLONE 1569711
MQKQHNHSKGLDQSFQSIGSRFPSHQLSNGLYAPGPPEQPK

SEQ ID NO: 83762 - DNA, 985 bp, Zea mays
  misc_feature: Ceres CLONE 1569712
  misc_feature: Encodes the peptide sequence at SEQ ID NO. 83763
  misc_feature (386)..(386): n is a, c, t, g, unknown, or other
  misc_feature (401)..(401): n is a, c, t, g, unknown, or other
ctcaccgcggtggcggccgctctagaactagtggatcccccgggctgcaggaattcgtctcacccctagaaaaagcgacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaagacgcttcctgaagtaagcgaagcaagggtgagatnatcaagggaaaaaanccacttccctccggtaccccttttgaacagaggaagtgggctcagaaggcccccaaatttcaacgagaagggccggttccacctgaatcaagtttcctggggaaccttccccgcaaaactggcccgaaatttgcccgtggggcacaaaaaaaaataccccctttttaggccccgggaaaaaaaaaaccccttgggggggaaaaatttcccaaccccactctttttttttggccttggggggaaacccacagccctcgaaagaaatttgggggacttgaaaaaaaaaccccccccccgggaaaacccgggggaaaaaattttctcggttggggcggggggtgttttttaaaaaaaaaaatttttgaaagaggggttttaaaaaaaccgggggaaaaaaaaaaaatagggggcccccacacggggggggggggggagggggcccccctcacaaagaagatgtttttttttccctccgagacgcctttttttataaaaaaaaaatattttttttttgtgtgcaaaaacaacaggaaaaaatttggggggccccccttttacaaaacaagggggggggtgttttttat

SEQ ID NO: 83763 - protein, 189 aa, Zea mays
  misc_feature: Ceres CLONE 1569712
  misc_feature (69)..(69): Xaa is any aa, unknown, or other
  misc_feature (74)..(74): Xaa is any aa, unknown, or other
MSGAIGGAEVHGFRGAAAQLPRSRVLGRPIRVAPPAAARPGGASAGSIRAVSAPAKKTLPEVSEARVRXSREKXHFPPVPLLNRGSGLRRPPNFNEKGRFHLNQVSWGTFPAKLARNLPVGHKKKYPLFRPREKKNPLGGKNFPTPLFFFGLGGKPTALERNLGDLKKKPPPRENPGEKIFSVGAGGVF

SEQ ID NO: 83764 - DNA, 1118 bp, Zea mays
  misc_feature: Ceres CLONE 1569713
  misc_feature: Encodes the peptide sequence at SEQ ID NO. 83765
  misc_feature (308)..(308): n is a, c, t, g, unknown, or other
  misc_feature (636)..(636): n is a, c, t, g, unknown, or other
  misc_feature (702)..(702): n is a, c, t, g, unknown, or other
  misc_feature (756)..(756): n is a, c, t, g, unknown, or other
  misc_feature (945)..(945): n is a, c, t, g, unknown, or other
  misc_feature (1051)..(1051): n is a, c, t, g, unknown, or other
ccgcggtggcggccgctctagaactagtggatcccccgggctgcaggaattcgtctcacccctagaaaaaaaccgcgcccccacaccccgctcctctcgctcctcgctcccttttcaccttccccttcgcaagctccccctcccgtgccgtgctctctcaacaagggagaaggggaaaccaccaccaccaccacacttgataagaaaggggccgcacgcgcctgcccgctcccgccgctacgccatggacgcctgggaggccaccaagggggggttcaaccgggtgcgggcgctggacccggaaaacncctccaagataatgggcctgctgctcatccgggacaacaccaacaaggagctcattcggcgtgggcttgggggcggaccagcggctcccccccttctgtttccggggggggcgccaaccttgaccgccaaaggccgccgtgcccaggcgtatgcactgtgtgggggcgcgccctgccaccagagacctaggataagcctccgccccgtcgccgaaggcccttggccggttgggtttcggaacgcaccgaaagaccgaaggccccgccctttcgggggaccggagaccgccgaagagctggtgggaaacgaattgtcttgtaaaggggntgggcgggagaccggtgggtcgttaaaaaaggtggtggattgcccccgccgagtaagagttgggcnagaactggggtgagttgtggaccctggagacagtgagcggcaagaatccacgcnaccgccgagaaagtttgtttgcccgcttcgcaggcggaaggcgtctaaatgtgcggtctctggcgtgctacaccgaccgagcgggaggcgctgtgctgtggtaaggcccagtggaagagaagattttcggcgccctcgggttcgttgaaagaaaaaaacgtgccggtgtgtggcagcttgcagacaagnggttgttccgcgggaggaaaaagaaaccacccccgtggagtcgccaaaaatgttgtttttgtctcgcctaaggaactttgggggcgcgcgggggggggcggaaggntgaagggaagtgtggggggacggtgtgtgctgttgggcggtcgcacgaggggcaaagtgttgtgtgg

SEQ ID NO: 83765 - protein, 156 aa, Zea mays
  misc_feature: Ceres CLONE 1569713
  misc_feature (22)..(22): Xaa is any aa, unknown, or other
  misc_feature (131)..(131): Xaa is any aa, unknown, or other
  misc_feature (153)..(153): Xaa is any aa, unknown, or other
MDAWEATKGGFNRVRALDPENXSKIMGLLLIRDNTNKELIRRGLGGGPAAPPLLFPGGAPTLTAKGRRAQAYALCGGAPCHQRPRISLRPVAEGPWPVGFRNAPKDRRPRPFGGPETAEELVGNELSCKGXGRETGGSLKKVVDCPRRVRVGXELG

SEQ ID NO: 83766 - DNA, 930 bp, Zea mays
  misc_feature: Ceres CLONE 1569714
  misc_feature: Encodes the peptide sequence at SEQ ID NO. 83767
  misc_feature (340)..(340): n is a, c, t, g, unknown, or other
  misc_feature (852)..(852): n is a, c, t, g, unknown, or other
  misc_feature (878)..(878): n is a, c, t, g, unknown, or other
ctcaccgcggtggcggccgctctagaactagtggatcccccgggctgcaggaattcgtctcacccctagaaaaaattacgcacctccacggctccccagtccccacgcaggccgctctgttctgccagcagttggcacaagcagcttgggcgcaaaagaacaactgcgatcgagcaagggacaatggcccgcaccgcggcgccggccgcgggctacggagaggacggagtgtaccactccgccaccggccaatccctcaccttcgccgcctttcgctccgccgtcctcaccacggccgtcgccctctcctcgcgcgcgggcgtccggcgcggcgacgtcntcctcttcttcgcccccaactgcttcctctaccccgtctgcttcttcgccgtcaccgccctcggcgccgtcgctaccacggccaaccccctctacacccctcgggaggtcgctaaacaggccaccgactcgcgggccaagctcgcaatcacggtctctgaactcttccccaaatcgtggacctcggcttcccccacatcctgctcgacggcggcggcgacggcgacgcggccagtgccgccgccctcaaagctcaaggagccagcgtgaccctttactcaaaccctcgtttcgggggcgcgggaaaaggattaaccgccccccgccaactaaacaaagcaacccgacggcccttatgtactcctccggcccaacggggggcaaaaaagggggtaatcctggaaccaccgaaactttattttggggggggggccttaataaacacggaaccacgaacccctctggaaaagggcccaaaagttttccctttgtttctggcccatgtttccaaancttttgggggtgggccgcataacacnttcccccgaaaaagcacacgggggaaattcccccccccccccggtagtccgg

SEQ ID NO: 83767 - protein, 141 aa, Zea mays
  misc_feature: Ceres CLONE 1569714
  misc_feature: SWISSPROT Homolog: EC 6.2.1.12 4-coumarate--CoA ligase
  misc_feature (53)..(53): Xaa is any aa, unknown, or other
MARTAAPAAGYGEDGVYHSATGQSLTFAAFRSAVLTTAVALSSRAGVRRGDVXLFFAPNCFLYPVCFFAVTALGAVATTANPLYTPREVAKQATDSRAKLAITVSELFPKSWTSASPTSCSTAAATATRPVPPPSKLKEPA

SEQ ID NO: 83768 - DNA, 1025 bp, Zea mays
  misc_feature: Ceres CLONE 1569716
  misc_feature: Encodes the peptide sequence at SEQ ID NO. 83769
tcggtggcggccgctctagaactagtggatcccccgggctgcaggaattcgtctcacccctagaaaaagtctcacccctccggacgaaatctgacctgggccacactccgctgctccgccatggcgatccgctccaaggcctggatctcgctgctgctcgcgctggccgtcgcgctctccgcccgggcggaggaggagcccgcctcctcggcggatggcgaggccgtgctcaccctcgacgtcgacagcttcgacgaggccgtcgccaagcaccccttcatggtcgtcgagttctacgcccccctggtgtgggcactggcagaacctgctccaaattattagattgcgggcaaggcccttggcagcatgaccccccgattcccccccccctaagttgatgctaaccagggagaagaaacaggcgctttgctaccaagtacgagatccaagggttccccacccttcaagatctttcggggaacagggggatgtacctttccgggaatacaagggccccctaggggaggctgaatgggcattttggggattaccttgaaagaaagcaaggttgggccctggcctcccaagggagattctaggtccccccgaaggatgcccgaccggccccttttccgatggacaagaaagaattcctccctttgggttgggtatccttccccgcggattttcccccgggccccccaaatttttccaaacctttccttggaagggcccccaaaaaaaacccggagggccctgaactccgaactttgtggcccccacttttgcatggccacccccccccccccacgtgggtgtattccaccatgtggaaccggccctttggtgcaggccggccttacaccctttgtaaggacctgttttgttacaaacaaggatttttatttccgcccccccgagtgaatttttttgagcccgcccaccccccccaaggtgttgccttttttaaaaaaacccgaaacaccccttccctttgattttcctccaagcccccccccagggtt

SEQ ID NO: 83769 - protein, 73 aa, Zea mays
  misc_feature: Ceres CLONE 1569716
  misc_feature: SWISSPROT Homolog: EC 5.3.4.1 Protein disulfide-isomerase
MAIRSKAWISLLLALAVALSARAEEEPASSADGEAVLTLDVDSFDEAVAKHPFMVVEFYAPLVWALAEPAPNY

SEQ ID NO: 83770 - DNA, 920 bp, Zea mays
  misc_feature: Ceres CLONE 1569717
  misc_feature (321)..(321): n is a, c, t, g, unknown, or other
  misc_feature (850)..(850): n is a, c, t, g, unknown, or other
ctccccgcggtggcggccgctctagaactagtggatcccccgggctgcaggaattcgtctcacccctagaaaaatcaccgcccccctcctcgccgtccactggtgccgagccggcgcgggtggagatccgttcgctttggatcgacttcttcgtgtttgggttgaagccgctcgatttgctcaccagaaattcagattttcgagtggaattcgcttaatatagcaatgcactagggtttactgtgcaccactaggctactgcctctgctattaggaagccgacatctgttgtttccgaagtctttcaagtctctgttgggntggcgttgctatttgtgggtgtgataacatgataaaagcaattttctttggacgttctccccaaggaagccattcccaaatcctggagataaaggatccctattggccggccccggccccctcgggtgtccgcaccagcccattggggtccgaagagcctggagacaggggccacccaacttggaggtaggccctccccccgggttattcccccccctcctggggccccagtttttttggggagttggcgattggccttgttccgggcaattggcctttcccccgaaaaggcgccccccggttgaaaccggggggaattttccgggcccccctttataagacatttttttcgggtgccgttttggcccaaaagcttttttaaaagggaagacggtggcccccctacccccgggaggaaaaacccgaaaccttttggttttttattggagggaaaaggtttggaaacacttttgggggccgggcccccccacaattttttttattctttctccccgcgttcccccacccnaaagagaaatctttttatggggggagaagggggggtattttatagggggggcgccaaactctttgtgggg

SEQ ID NO: 83771 - DNA, 949 bp, Zea mays
  misc_feature: Ceres CLONE 1569718
  misc_feature: Encodes the peptide sequence at SEQ ID NO. 83772
  misc_feature (405)..(405): n is a, c, t, g, unknown, or other
  misc_feature (408)..(408): n is a, c, t, g, unknown, or other
ctccccgcggtggcggccgctctagaactagtggatcccccgggctgcaggaattcgtctcacccctagaaaaactctcctctcgccccgcctcgtcatgtcacgtctcccaaagtcccatctcgccttcgcttaaacataaaccacacccatcgcacccagccagccctcgccatccatggccaccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgccgccgcccccaaccatgtccaccaccctccccatcaccaccagtcggtgcctccccccaggaggccccccccaantgncccccgaagggaaattccgcctcccgccgccccgggggctatggggctccacccgccgcaagcaccagcatggggccggcctcccccacaaagggggttacgggactctcaccaccgccttcaaaaggggcatggttacttccccccgccttctctcggaaaaaggggcccggggccccccccccccggggggaaaattttaaatgtgcgccccccggtttaccaaaaaagggccgggaaactcccggcccccgggggggcaaaaaaaattgcccccccctgcataaggggccccgggggccccccccccccagggggccagaggggtatcaccggggctccccccgcccccaaaaagggcaaaggggtctccctccccccggggggagggaaacatattggcggcccttccacaaccgataaatggggaaggggtgtctctcccccccccgaaaaagagggagaaccccccccccccgtgcaataaacagtgtaggacggggcccgggtggagatcaaattgagaggcacttctcccacg

SEQ ID NO: 83772 - protein, 238 aa, Zea mays
  misc_feature: Ceres CLONE 1569718
  misc_feature (76)..(76): Xaa is any aa, unknown, or other
  misc_feature (77)..(77): Xaa is any aa, unknown, or other
MATTAAIHLRPLRSVAVSSARSRSLLHLLARPLSSSQSSYAYRPSPTAPAAAAPNHVHHPPHHHQSVPPPRRPPPXXPRREIPPPAAPGAMGLHPPQAPAWGRPPPQRGLRDSHHRLQKGHGYFPPPSLGKRGPGPPPPGGKILNVRPPVYQKRAGKLPAPGGAKKIAPPCIRGPGGPPPPGGQRGITGAPPAPKKGKGVSLPPGGGKHIGGPSTTDKWGRGVSPPPEKEGEPPPPVQ

SEQ ID NO: 83773 - DNA, 878 bp, Zea mays
  misc_feature: Ceres CLONE 1569721
  misc_feature: Encodes the peptide sequence at SEQ ID NO. 83774
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (746)..(746): n is a, c, t, g, unknown, or other
  misc_feature (747)..(747): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (758)..(758): n is a, c, t, g, unknown, or other
ccccgcggtggcggccgctctagaactagtggatcccccgggctgcaggaattcgtctcacccctagaaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagatcggattcaagggcaggaccgaagactacttcgagaagtgaagcggttaagatcctatccatcatccctggtgctgcgctgcattgcgttgcgtgcgtgctcgccgcaatcgaacctttgctgtataagggtccgatttcgtcgaatgtaatgtatgatgctacttttgagcttcatgtaaaatctagccgtccggccccaaaaannnnnnnnnnnnntatnnnnnntnntnnnnnatttntacgcctgctccgtcccggcaccaattcacccaagaacccctcccccgggaggctgccccaagaacacccttgctctcccgtgcgggaactttcccctccccgccccataatttgcccaa

SEQ ID NO: 83774 - protein, 144 aa, Zea mays
  misc_feature: Ceres CLONE 1569721
MAASASTVSGLAGASLASRPAFSTSFTRGSRVSARNPLMSRNLERNGRITCMTFPRDWLRRDLSVIGFGLIGWMGPSSVPAINGNSLTGLFFSSIGQELAHFPTPPPVTSQFWLWLVTWHLGLFIVLTFGQIGFKGRTEDYFEK

SEQ ID NO: 83775 - DNA, 962 bp, Zea mays
  misc_feature: Ceres CLONE 1569722
  misc_feature: Encodes the peptide sequence at SEQ ID NO. 83776
ctccccgcggtggcggccgctctagaactagtggatcccccgggctgcaggaattcgtctcacccctagaaaaagcgcttggcgaggtcctgggtgactgactgaccacactagcgcagcgcgcacaggagcaaaggggggcatcctcgcgcgcgcccgcgccatggccaccaggccgggccctttgactgaatggccatggcaaaggcttggaaacttcaagtacttggtgatggctcccgtggtggtccacggcgcgcggcgggtggtcgcgcggggctggggcgacatcgacctggccttcgcgctcatcctgccgtcgctgcttctgcggatggtgcacaaccagatctggatcagcgccgcgcgctaccagacggcgcgcggcaagcaccgcatcgtcgaccgcggcatcgagttcgaccaggtcgacctggagcgcggctgggacgaccagatcatcctcaacgggctgctcttctacgttggctacctggcgatccccagcgccaagcccatgccgtgcttgaaagtcggaacgcgcccttgccgatgggccctgctccacccccgggcccgtggaagtcccctctactactgggttccaccggggggctgcaaccacaatttccttctaatcggggttacaattggaaccaaacaatcctccattttttacccgagcccaatcaattccggtgatccattcctttcccctgaaaaaatgggccaaatacattctggttcccccacccccatgggtttcaaacccctaaaatggggaaaacccccccccccccgggggattgtggctcttaatacggccaaattggaatttttttaaaacaaaagggggggcccgggaaccctccaagcggggggcccccaggggggaattttttaaaattttttttccccccccctcaaatttacccccttttttgcaacgccgcgctgttttc

SEQ ID NO: 83776 - protein, 226 aa, Zea mays
  misc_feature: Ceres CLONE 1569722
MATRPGPLTEWPWQRLGNFKYLVMAPVVVHGARRVVARGWGDIDLAFALILPSLLLRMVHNQIWISAARYQTARGKHRIVDRGIEFDQVDLERGWDDQIILNGLLFYVGYLAIPSAKPMPCLKVGTRPCRWALLHPRARGSPLYYWVPPGGCNHNFLLIGVTIGTKQSSIFYPSPINSGDPFLSPEKMGQIHSGSPTPMGFKPLKWGKPPPPRGIVALNTAKLEFF

SEQ ID NO: 83777 - DNA, 893 bp, Zea mays
  misc_feature: Ceres CLONE 1569723
  misc_feature: Encodes the peptide sequence at SEQ ID NO. 83778
  misc_feature (394)..(394): n is a, c, t, g, unknown, or other
tccccgcggtggcggccgctctagaactagtggatcccccgggctgcaggaattcgtctcacccctagaaaaaccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcntgctggtgtgcggcgccgagctgggcagcctcagccgcgacgagctgtggcgcaaggtgttgggggggaggccacctacgacctcgccaccgtgctcgccttcctcgccgtcctcgccttcaccatctccgtctacatcaggtccagggcccaggcccgtgtacctcatcgacttcgcatgctacaagccgggcgacgagctccaagtggccaaggcggagttcatcgacctggcgcgcaagtccggcagttcgacgaggacagcctggcgttccagtcgcgtctgctgggccagtccgggattcggcgagaattgtacatgcccccgctgcgtggtcaaacccaacgccggctgggccaccatgaaggaggccggcgccgagggctccccggcccttgttcccggcgcttggacaaacttttccaaaaagggcccgtccccgccccagggaagtgggggcggcttgggggggaaaaaggaaacccttctttacaccga

SEQ ID NO: 83778 - protein, 236 aa, Zea mays
  misc_feature: Ceres CLONE 1569723
  misc_feature: SWISSPROT Homolog: EC 2.3.1.119 Icosanoyl-CoA synthase
  misc_feature (71)..(71): Xaa is any aa, unknown, or other
MAREEQALLSTEIVNRGVEPSGPDAGSPAFSVRVRRRLPDFLQSVNLKYVRLGYHYLISHGVYLATIPVIXLVCGAELGSLSRDELWRKVLGGRPPTTSPPCSPSSPSSPSPSPSTSGPGPRPVYLIDFACYKPGDELQVAKAEFIDLARKSGSSTRTAWRSSRVCWASPGFGENCTCPRCVVKPNAGWATMKEAGAEGSPALVPGAWTNFSKKGPSPPQGSGGGLGGKKETLLYT

SEQ ID NO: 83779 - DNA, 936 bp, Zea mays
  misc_feature: Ceres CLONE 1569725
  misc_feature: Encodes the peptide sequence at SEQ ID NO. 83780
  misc_feature (936)..(936): n is a, c, t, g, unknown, or other
ctccccgcggtggcggccgctctagaactagtggatcccccgggctgcaggaattcgtctcacccctagaaaaaataaaaaatgggtacgcatcaataaataggagcttgggaagttgccaaggcctccgattttgccaatgcgacggtgaaatcccgcacctacctccttcctctctcaccgaggaccctcgcaccaagaactgagcgggaagagaggtagagaggcaagcgcacgagagtttctgcttctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccgaccaccgccaagccgcgggggtcgtcgtcggccctctgccagagggtggccggcggcggcaggcggcgctccggggtggtgcggtgcgacgccgcccgcgtggaggcccaggcgcaggccgtggcaaaggcggccagcgtcgccgccctcgagcagttcaagatatccgccgaccggtacatgaagggaaaggagtaccatagctgtgataggcctcagtgtacccacagcaccagggggagatgcgtgaaaaacttggctgttggagagggaactgtgggccccgtgctattcaagaactcactagcctgaaaccatattggaagaggctgcctggtcttagcacccggaaaagaaagggaaaatttatgtggggggcgctttctgtggaacccggggtattcaaaagaaagtgggggaacgggatgtcccaaaaaaaagtggggttttcccccccttccggagcctttaggggaaccccctggttctttctttggcgaaaacatggtaagn

SEQ ID NO: 83780 - protein, 43 aa, Zea mays
  misc_feature: Ceres CLONE 1569725
MKGKEYHSCDRPQCTHSTRGRCVKNLAVGEGTVGPVLFKNSLA

SEQ ID NO: 83781 - DNA, 901 bp, Zea mays
  misc_feature: Ceres CLONE 1569728
  misc_feature: Encodes the peptide sequence at SEQ ID NO. 83782
  misc_feature (659)..(659): n is a, c, t, g, unknown, or other
gcggtggcggccgctctagaactagtggatcccccgggctgcaggaattcgtctcacccctagaaaaacttatccgcttgacgctccccactgcgcctaaaaatggccgcgtcccactgaaccaaccgtctgcacatcctcctcctgttgccgctcgctcgccgtgccgcaatggctacggccgtcgcctcccatacgttgctctcctccgccttcgccccgcgccactaccaccgccgcctgacccggaccgcgtccgtggggccgcgccgggccgccccggtgggactggccgtgcggtgcgagaagagcgacaagcagaagaggcagccgctcgccgcgctcgtgccccgcgagcagcgcttcatgttcgagggagacgagctcccccgccccgacatatggaatacaacctggtatcctaaggctgcagatcatgtaactaccgagaagacatggtatgttgttgatgcaacagacaagatcctaggcaggctagcatccaccattgcagtacatatcaggggaaagaatgaacccacttacactcctagtgtagacatgggagcttttgttattgtggtcaatgcagataaggttgctgtttctggtaaaaagcggtcacaaaagctttataggaggcactccggaaggcctgnagggatgaaagaaaaaccgacacccgacgctgtctgctgccgcaaactggtagtagccgggcgcgccgtcaccgtatcctccgatcaacggggagcagaaaacaaaccactcttcgtgaccccgaaaagcatggtaaatttttccttcagccgggggtaagggaaagaccccatccaacttgggggcattgggcatggtcgacccgggaagatgacacccatgggccctggatttaaaattt

SEQ ID NO: 83782 - protein, 215 aa, Zea mays
  misc_feature: Ceres CLONE 1569728
  misc_feature (96)..(212): Pfam Name: Ribosomal_L13 Pfam Description: Ribosomal protein L13
  misc_feature (163)..(163): Xaa is any aa, unknown, or other
MATAVASHTLLSSAFAPRHYHRRLTRTASVGPRRAAPVGLAVRCEKSDKQKRQPLAALVPREQRFMFEGDELPRPDIWNTTWYPKAADHVTTEKTWYVVDATDKILGRLASTIAVHIRGKNEPTYTPSVDMGAFVIVVNADKVAVSGKKRSQKLYRRHSGRPXGMKEKPTPDAVCCRKLVVAGRAVTVSSDQRGAENKPLFVTPKSMVNFSFSRG

SEQ ID NO: 83783 - DNA, 941 bp, Zea mays
  misc_feature: Ceres CLONE 1569732
  misc_feature: Encodes the peptide sequence at SEQ ID NO. 83784
  misc_feature (867)..(867): n is a, c, t, g, unknown, or other
tccccgcggtggcggccgctctagaactagtggatcccccgggctgcaggaattcgtctcacccctagaaaaaatccccccgcggagaggagaggaagaagaacccagccaaatcctcagtcctcaggcagtcaggctgctcgcagctcgtgccgtccactctcccccgaggcagtctcttgcgttcgctgctcgacatggcgctccaggcggcgacgtccttcctcccctctgccctctccgcgcgcaaggaggtgagcggcgcagttctgcgttttccagcgagcaccgtgctgttctttcgattcgcgctcagcttcagtgtccgagctgccaagtggcggctctggtaagcgattgctgagtgttccggtagtaagttgcggttgcaatgttgatgctgtgtctgtgtgcaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccgcgtcgccgtctggcaagaagaccctccgcaagggcacggcggtcatcaccggcgcgtcgtccgggctcggcctcgccacggcgaaagccctggcggagacaggcaagtggcacgtcatcatgtcctgccgcgacttcctcaagcgtcccgcgcgggcaaggcggccgggattaaacaagaaagcttcaccgtcgtgcaccgggacttcgcctccttggaaaaggtccgccagttcgtaagaacgtgccccacctggaatgcccttcgacgggtggtgcggaaagcccgccnggttcaacccaccgccaagggagcctccttacacgcgcaagaggtttagaatgaggtcggggttaaacaccctc

SEQ ID NO: 83784 - protein, 51 aa, Zea mays
  misc_feature: Ceres CLONE 1569732
  misc_feature: SWISSPROT Homolog: EC 1.3.1.33 Protochlorophyllide reductase
MALQAATSFLPSALSARKEVSGAVLRFPASTVLFFRFALSFSVRAAKWRLW

SEQ ID NO: 83785 - DNA, 894 bp, Zea mays
  misc_feature: Ceres CLONE 1569733
  misc_feature: Translation starting site: 326
ctccccgcggtggcggccgctctagaactagtggatcccccgggctgcaggaattcgtctcacccctagaaaaattctccctgcaccgtttcgtcgtctcatttcagcagctactagaagtagtagctggctcgctcctgctgccggtttcttgccgtcttcttcttcaccgacgacggtcgcgcgttcctacaccaggtggtccgaattgttttactagggtgcaacggattcgtatccaggagacgtttgagatcgtccttcagcgcttatcatacatacatcaagcagatcaacaagggcttaattcacaagacaagagaggatgggtttcttctctctatttctggtggcgtctatgccgatcatccaggtcctgctcataggtgtcattggagcttacctggcctctggtttcagcaacgttctgacgacgagtgctcgaagggatatgaacaaggttgtttttactgtgttcaccccatctttgatgttcgccagcctcgcgttgacggtcaccccttgcagacgtcatttctgggtggtttatgccagttaacatagcgatcacgttcctgatcggtggcactctgggctggataactggcaacatcttggaagcaccgcagcacttttaggggtttgatcatgggcttctgctcagcaagaaacctcggaaacctgctcctgatcattggtcccggctggtttcgacaaagacgggaaccccttttggggatgattcaaagactttgccgtcccgcaagtctctcctattcgttcttgttcattggtcctgggtgggccccctcctatggaacccacactttcagcccgtatcagaaattcccggcaagcttgtccccagtaggcacgccaaaataatttcggtgc

SEQ ID NO: 83786 - DNA, 943 bp, Zea mays
  misc_feature: Ceres CLONE 1569734
  misc_feature: Encodes the peptide sequence at SEQ ID NO. 83787
  misc_feature (943)..(943): n is a, c, t, g, unknown, or other
tccccgcggtggcggccgctctagaactagtggatcccccgggctgcaggaattcgtctcacccctagaaaaagcaaacccctctcgatcgacacacgcagccgcgacccatcgagacctgacccgatcctcccgaggccgccagccttatcctctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaagttgagctggaggaccctgtggaaaacttggagctaaattgggcagggaagctgcagctaaaacaacgatcttgcgggaaatgggacaacacctccgggggccctggctcaggggctgattgctgagggggttaagggggaaccaaccggggccaaacccgtgtcaaattacccgggggtttggaaaaaacagctaaaccaccttttggaaaaactacggaagttgcctaaggagggtaaaaaaaggagagctgccaaaggtgcccccactttagggcggggcacacacctgtgaattgggtaaacttatatccaaaggcccttgaccaaggccggtccgaaagggcttttttccccctgaaagagggaggaaattctcaaaaatttctcccttggtgggggggggaaataatttgtaccgggtgtcctcctctcgcccatttgttgaagaaaaggggan

SEQ ID NO: 83787 - protein, 134 aa, Zea mays
  misc_feature: Ceres CLONE 1569734
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENLELNWAGKLQLKQRSCGKWDNTSGGPGSGADC

SEQ ID NO: 83788 - DNA, 883 bp, Zea mays
  misc_feature: Ceres CLONE 1569736
  misc_feature: Encodes the peptide sequence at SEQ ID NO. 83789
  misc_feature (46)..(46): n is a, c, t, g, unknown, or other
  misc_feature (168)..(168): n is a, c, t, g, unknown, or other
  misc_feature (341)..(341): n is a, c, t, g, unknown, or other
ctcacccgcgggtgggcgggccgctctagaactagtggatcccccngggctgcaggaattcgtctcacccctagaaaaagtcggggagaagtggaagtggactcgaggatcactctcgctatcgactacgctatctcaactgccacggaacaatcgaaaccaacagtngagagctagcctcgccaaaccgccggcgccgcagcatgcctgtacctctcggctctcgctcttatccccacccacctcgctttctcccctctacaagaagcgaccaccgctgtgaatcagcagagctgcagtgagagcaagtgagaggatcagaagaggcatccgtgaccaangatcgagtagccaagaagaagagagatgaacgccgacttcggcgcggccaaggagctcgcggggaggcctgcagaaacgggggggcccttctacaggccccgccctcccgccatggcctccagggaaccaacgggtaagggcggaaattccgggggaccccaccccccaacctttgaatccccccctggtgccaaaacccccccccgaaaggctttccccgaaaactttttggccaacccccctcttataaatttttttttcgccccgggcccccggggccccgggcccttttttaaaaaaccccccccccccaacagggggggggggggggggtgttttcccctggagaagaaccccccccggggggggaaaaaaaaacttttggggggggcccccctggaaccccttttaaaccacccaacacccccaaaaagtgttccctcaaaaaaattccccggggggaaaaaaagaaattttttttttaaaaaaaaaaggggggggaaaaaaaaaaattattttttttttctccaaaaaaaaaaaa

SEQ ID NO: 83789 - protein, 58 aa, Zea mays
  misc_feature: Ceres CLONE 1569736
  misc_feature (16)..(16): Xaa is any aa, unknown, or other
LTRGWAGRSRTSGSPXAAGIRLTPRKSRGEVEVDSRITLAIDYAISTATEQSKPTVES

SEQ ID NO: 83790 - DNA, 929 bp, Zea mays
  misc_feature: Ceres CLONE 1569738
  misc_feature: Encodes the peptide sequence at SEQ ID NO. 83791
  misc_feature (602)..(602): n is a, c, t, g, unknown, or other
  misc_feature (626)..(626): n is a, c, t, g, unknown, or other
  misc_feature (627)..(627): n is a, c, t, g, unknown, or other
  misc_feature (787)..(787): n is a, c, t, g, unknown, or other
ccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtgggcttacgtagcagggcagcgctcgtgcctcctcaagagatcaggccgcacgttctcgtcggcgatctgttactacnggtggcccgtggggaacaagttcnngctctgtcacgcaacctgctgctgctgccggcgacggcgatgatcctggggtccccgcatggcaaactaaatatctccacgaaggcatctcgtcgcttttccttgtccccactggaacacctaccaaaaagaccttaaaacggggcctcccccccctgcnaaatgatggtggggaaggcgggcaactttccccttcttccaagcgggggaaaaaccccggctttgtggaaaaacaacggggtggccaaccacaccaacctcgggggggccccaaggccccgtggccggggtctccccccgct

SEQ ID NO: 83791 - protein, 203 aa, Zea mays
  misc_feature: Ceres CLONE 1569738
  misc_feature: SWISSPROT Homolog: EC 3.2.2.22 rRNA N-glycosylase
  misc_feature (150)..(150): Xaa is any aa, unknown, or other
  misc_feature (158)..(158): Xaa is any aa, unknown, or other
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVGLRSRAALVPPQEIRPHVLVGDLLLXVARGEQVXALSRNLLLLPATAMILGSPHGKLNISTKASRRFSLSPLEHLPKRP

SEQ ID NO: 83792 - DNA, 1069 bp, Zea mays
  misc_feature: Ceres CLONE 1569740
  misc_feature: Encodes the peptide sequence at SEQ ID NO. 83793
  misc_feature (392)..(392): n is a, c, t, g, unknown, or other
  misc_feature (398)..(398): n is a, c, t, g, unknown, or other
ctccgcggtggcggccgctctagaactagtggatcccccgggctgcaggaattcgtctcacccctagaaaaagcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcggggccggggccggcgcgcgtctccgcgtgcggtgcgcgatcttgtcgtcgcccgcgcccgtggcgcccaccgagtcgaggccggtgcgccggatctcgccgtccgcgccggacggcgcgctgcggcccaagccggctgtgctggtcncccaanaagctgagcgaggccgggctggccgtgctggcggaagttcgcggacgtggagtgccgcttacggcattgtcccccgccggagcttcctcgccaaggcgggggcatttccgacgcgcttcttcgtggcccaacgggcacccaagggtgaccccggggaggttgctgggaagcccggggaagggccccggcttgcggggtggggggggccccccacgggggctttgtgggaatcaaaaaacacgttcgaaccctccaagtgcccgccccacacgaggggcccggggtggccctccgttcgttctaaaagcgggccccaccccgcccaaaaatatttttcccccccgggcccataaacacgcggatttccgggcctggctctcccctccctatgtggggccgccaaacgtttcttccaaagggggaaaaccgcggggcttataggggcgggggaaaattgtgcgaaaggaaaacaggtcccggggggggttttcccccggggggggagaaaacaacccgggccctctaggggcgttttgggaggagtgggggtcaaaaatcctcctgggcaaacaaaaagggccttggaagcacccggtaatttttaggtaccgttgcccccttcgcacacagggccggggcctcggggagaaaaatgtttttctctccagaac

SEQ ID NO: 83793 - protein, 204 aa, Zea mays
  misc_feature: Ceres CLONE 1569740
  misc_feature (86)..(86): Xaa is any aa, unknown, or other
  misc_feature (88)..(88): Xaa is any aa, unknown, or other
MAASRALLPSPQVSPASARVRLAAAVPSSLTLAARGGAGAGARLRVRCAILSSPAPVAPTESRPVRRISPSAPDGALRPKPAVLVXQXAERGRAGRAGGSSRTWSAAYGIVPRRSFLAKAGAFPTRFFVAQRAPKGDPGEVAGKPGEGPRLAGWGGPPTGALWESKNTFEPSKCPPHTRGPGWPSVRSKSGPHPAQKYFSPPGP

SEQ ID NO: 83794 - DNA, 955 bp, Zea mays
  misc_feature: Ceres CLONE 1569742
  misc_feature: Encodes the peptide sequence at SEQ ID NO. 83795
ctccgcggtggcggccgctctagaactagtggatcccccgggctgcaggaattcgtctcacccctagaaaaagatatgtgggactggccaaaaaccagacttctgatcagcaatggacacatttgaaaggaaagttcctccttcatgctccctttaccaaagctgttattttcatagaagggcctcctgctggaattgacattcttgtagatggtcttgtcttatctccagcaagaaagctccaagctgcaccatgcccaaaaattgagaatgttctgtatggaactaatctattgcacaataatggcttcactcgtgggctttctgggtggagtcctatgggttcatgtcgattgagtatccagactgaagcaccccatatgttaccttctatccccaaagaccgtgcaagccagaagcatataagtggtcattatatccttgccacgaaccgcacagatgtttggatgggtcccttcgcaggtcataactgataaactaagattgcatgtcacttacagagtattctgctggggtaccaagttggttctggaaggacatggacgtcccccatgtaaaatgtccggctttggtggggaaaaaaaaccaatggggtcaaatggtggggccaagtggattgctgaatgggcgaccaatgggtttgaaaataaaaaggagcattccaacctttgaaaaaccacccctccaaaagttcctgccaatttttccagggccccccctgcgggtgtttgaattcaaaaatccatgggactttcaaaaatattgccggcacaacaaaaaaaaccgggtttgtattttcctgaagggaaaaaaccaaccagggtaaaaaaccgtgattttgtttctaaagttccaagagaccaaagggcgggaaccttcgaggtcctcctctagaaaacaacaaaaccgaaataacctttccattgggagctgg

SEQ ID NO: 83795 - protein, 51 aa, Zea mays
  misc_feature: Ceres CLONE 1569742
MGSCRLSIQTEAPHMLPSIPKDRASQKHISGHYILATNRTDVWMGPFAGHN

SEQ ID NO: 83796 - DNA, 871 bp, Zea mays
  misc_feature: Ceres CLONE 1569744
  misc_feature: Encodes the peptide sequence at SEQ ID NO. 83797
  misc_feature (609)..(609): n is a, c, t, g, unknown, or other
ggagctccccgcggtggcggccgctctagaactagtggatcccccgggctgcaggaattcgtctcacccctagaaaaagctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaaacagatgccggcgccgctggcggtggcggacgatgcatggaggacttcttcgactgcctcctcggcttgctcggcgcgttaggcatgacatgggctgcggcgcggccccagcggcagccgcgcccgccgctgcctcgcggggctgcgggggcggggcctgcgccaactgactcccggcgtttcgcggcggagctcagggccacccccggnctgatcgccggcaatgggcgctgcgccgtcgcgtcactgttcacgctgcaggccaagaaagggcgtcaccaggatgctatgatcttcgggaagaacctctgttcaaaaatgataccatcttttgggggggggtttaacgggcatggacttaatgccctttggttgccagaaaagaagaaaccggccgcccctaaagtaggaagaaggttgacaaccgaaatatggaaaataacctcccgcggcaactttaacccaaccaccg

SEQ ID NO: 83797 - protein, 145 aa, Zea mays
  misc_feature: Ceres CLONE 1569744
MEDFFDCLLGLLGALGMTWAAARPQRQPRPPLPRGAAGAGPAPTDSRRFAAELRATPGLIAGNGRCAVASLFTLQAKKGRHQDAMIFGKNLCSKMIPSFGGGFNGHGLNALWLPEKKKPAAPKVGRRLTTEIWKITSRGNFNPTT

SEQ ID NO: 83798 - DNA, 882 bp, Zea mays
  misc_feature: Ceres CLONE 1569745
  misc_feature (842)..(842): n is a, c, t, g, unknown, or other
ctccccgcggtggcggccgctctagaactagtggatcccccgggctgcaggaattcgtctcacccctagaaaaagttctgcaacacgtgggtcagtcgaagcgggctcatctgcactgctgggttgtctaggacacgaccctacatcgcggctcgcgggcgtcagggcgcagatcagccatgccttccatcgagcagttccagcattggatggcaaccaacgtgtgtgctcttgtcttcgtttatccgtgcgtgggttctttcgtctggctggggactcctgcacgccggctctcgtacgaccgccgttctcccggacttcgtcggctcccacttttggaacttctagtctattgtcgccttctagcagagattggtggaagacgacgatgtcccgctcaccgtgtttgctattgtggtctccaaccgtctcctctctcctcaccatgtttgccattgcattgcatgtacaacgtcacaatatactctttcaacaactcaccccgctctatgaatgagggagttttaagggcatgtttggttcgtatctaactgtattacactttgcataaggttagtcgttcgaattgaagaactaaccttcgataaaaaaaagttaggcaaagtgtagcaaattaagcagtgaaccaaacatgtccttaatctccctgcttccattatcttaatttaatacctgataataatgtgttgtcctggttctgattcatagcggttgaaaataagtgacaacaatattcgttccaatttttaactacccgtatcccgtcatgtatcctgggagaatataatacgttaggatacagaatagcctttgtatctagntccctgtgttcatcccttagcagacagcactggtcccaga

SEQ ID NO: 83799 - DNA, 905 bp, Zea mays
  misc_feature: Ceres CLONE 1569747
  misc_feature: Encodes the peptide sequence at SEQ ID NO. 83800
  misc_feature (659)..(659): n is a, c, t, g, unknown, or other
ctccccgcggtggcggccgctctagaactagtggatcccccgggctgcaggaattcgtctcacccctagaaaaaatatctcgcctccacttcgtcacctcctcgccattctatcccaccagctgcatatatccctggtgtgtgaggtcagctgttttagctcagcgcgcgcggcgtggcagcaaaggaagcaaggagggagagcagcggcggcggcgtagcatgcagcggtgagagcgagggagctagggatcttatagccgagagagcgagagccagaggatgatgcagctgccgcagcatcacaagccgtccgcccactcctgctgcccgtcgtggatccggaggtccccgccgtcgccgccgccgccgccgccgccgcacaagaagccgggcggcgggaggagccggtatgcttgccgcctcgtgcccctgctcgtgctcaccgtgtacagcgtcgtcaccgtgcttcgcatccccagcgcctccctcgtcgtctccaccgccgattcagagcgcgtggacaggcgggaggacttggtagcgctcatcaagacccacctgccgtcgaaccagaacagcctcgatgcccgcgaggagacgcggtcggttgcctccctcccctgctccgcttcatcagcggtgaggcggggcaacgcnaaggagggcgtcctgtgctgcaacgggaccactaccgcagcgacttgtgctacctgtcgcgggaactggccacggacccgtccaccctcgtcggggcctcctggtacacccgggcccgccgatacggcccccagaaagggccgccgtacccccccatttcaaggaacgcgtggtgaccaccttccacaaggtgaccatgtggcccgtgccgggggccacaaacagaggccagccccctggggtggg

SEQ ID NO: 83800 - protein, 208 aa, Zea mays
  misc_feature: Ceres CLONE 1569747
MMQLPQHHKPSAHSCCPSWIRRSPPSPPPPPPPHKKPGGGRSRYACRLVPLLVLTVYSVVTVLRIPSASLVVSTADSERVDRREDLVALIKTHLPSNQNSLDAREETRSVASLPCSASSAVRRGNAKEGVLCCNGTTTAATCATCRGNWPRTRPPSSGPPGTPGPADTAPRKGRRTPPFQGTRGDHLPQGDHVARAGGHKQRPAPWGG

SEQ ID NO: 83801 - DNA, 904 bp, Zea mays
  misc_feature: Ceres CLONE 1569748
  misc_feature: Encodes the peptide sequence at SEQ ID NO. 83802
ggagctccccgcggtggcggccgctctagaactagtggatcccccgggctgcaggaattcgtctcacccctagaaaaatgatgaaatcaggagggcacaacccaccccacaggacgaaatgcgctatgggatgagctacatccatgagactgtatggaagggcgtgcctaagttcttgcgccgtgtggatacagccctgaagaatatcggcatcaatgagcgccttccctacaatgtttctctcattcggttctcttcttggatgggtggtgaccgcgatggaaatccaagagttaccccggaggtgacaagagatgtatgcttgctggccagaatgatggctgcaaacttgtacatcgatcagattgaagagctgatgtttgagctctctatgtggcgctgcaacgatgagcttcgcgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctctggaacctctgccgcagtgttcacgttcgggctctccctggtgagctggacatccgcaggagtcggagcgggccccgacgtgatcgacgcttcccacgcacctcggatcggggcgtaccgcgagtggtcaagacaagagcaggattgcctgctttcgaactgcaaggaaggcccccttggtgcccggacttccccaat

SEQ ID NO: 83802 - protein, 262 aa, Zea mays
  misc_feature: Ceres CLONE 1569748
  misc_feature: SWISSPROT Homolog: EC 4.1.1.31 Phosphoenolpyruvate carboxylase
MRYGMSYIHETVWKGVPKFLRRVDTALKNIGINERLPYNVSLIRFSSWMGGDRDGNPRVTPEVTRDVCLLARMMAANLYIDQIEELMFELSMWRCNDELRVRAEELHSSSGSKVTKYYIEFWKQIPPNEPYRVILGHVRDKLYNTRERARHLLASGVSEISAESSFTSIEEFLEPLELCYKSLCDCGDKAIADGSLWNLCRSVHVRALPGELDIRRSRSGPRRDRRFPRTSDRGVPRVVKTRAGLPAFELQGRPPWCPDFPN

SEQ ID NO: 83803 - DNA, 882 bp, Zea mays
  misc_feature: Ceres CLONE 1569751
  misc_feature: Encodes the peptide sequence at SEQ ID NO. 83804
ctccccgcggtggcggccgctctagaactagtggatcccccgggctgcaggaattcgtctcacccctagaaaaaatcgccctcgcgcacccgacagagtccgcgaagcccgcccgcccgcccacccgctcgcgcaaacgagagagaggcgagatccggctccgggccggcggcgagagagagagagagagggatcggtgacggactaccagggaccatcctcctcgcccttctccttcggccgctcgttgctctcgctgcgcaggcaccccgccgccatgccgtcaggcgaggaggccgacctcgaggcgttccaacgccacgtggcgtcggctctcgcggagctgctgcccgcggctgaggccggggccggtggcgactccgcggcggacggggcgggcgaggagttcctctgcgccgcgtggacccgccgcctgctcgaggcgttcgtgctgtgccaggaggagttccgcgtcgtggtcgcccaggcgcggcgccgcgccggggccctgccgcccgccgccgagaggctggtcgccgagttccacgagcgcgccgtcaatgtcctcgacgtctgcaacgcggcgcgcgacggcgtggaccatgtgcgccgctgggagcgtctcgccgacgtcgccgcgtctgcgctgcgcgcgccctggggaggtccacgtagggcagctccgccgcgcgcgccgggggctcatccacctcttcgcgctcgtcgttaaagaacaacgcagcgccgacgcggtccggggcctgcggcgtcacactccttcctctcctccaacggaaccgctccttaagcgggccgcgggcttcccgtttaaaacgggccgggccggggccggtgaccttctcttcgccctcgggttctttt

SEQ ID NO: 83804 - protein, 150 aa, Zea mays
  misc_feature: Ceres CLONE 1569751
MPSGEEADLEAFQRHVASALAELLPAAEAGAGGDSAADGAGEEFLCAAWTRRLLEAFVLCQEEFRVVVAQARRRAGALPPAAERLVAEFHERAVNVLDVCNAARDGVDHVRRWERLADVAASALRAPWGGPRRAAPPRAPGAHPPLRARR

SEQ ID NO: 83805 - DNA, 1079 bp, Zea mays
  misc_feature: Ceres CLONE 1569752
  misc_feature: Encodes the peptide sequence at SEQ ID NO. 83806
ctccccgcggtggcggccgctctagaactagtggatcccccgggctgcaggaattcgtctcacccctagaaaaattacgcacctccacggctccccagtccccacgcaggccgctctgttctgccagcagttggcacaagcagcttgggcgcaaaagaacaactgcgatcgagcaagggacaatggcccgcaccgcggcgccggccgcgggctacggagaggacggagtgtaccactccgccaccggccaatccctcaccttcgccgcctttcgctccgccgtcctcaccacggccgtcgccctctcctcgcgcgcgggcgtccggcgcggcgacgtcgtcctcttcttcgcccccaactgcttcctctaccccgtctgcttcttcgccgcccccggcctcggggccgtcgctacccaggccaaccccctctacaccccctcgggagggcgcttaaacaggccaccgaactccccgggccaagctcgcaatcaccggctcctgaaccccctccccaaaaatcgtggaacctcgggcttccccacccttccctgtcttcaaaggggggggggggaacggcgaacccgggccaatgggccccccccccctcaaagccctcatgggaaggcacgcggggacccccttttactacacaaacccccgttttccccgggggcccccgggaaaaaacgaaaataacccgcccgccccccccccaaccaaataccaaaagcggcccccgcaccccgcccctctaaattgttactcctttcgggggaacaaaagaggggggcaaaataaagggggcctaataaccttgtaaacacccgcgaaactttcatcctctgtggggggggcgcctttaattaacacgggaacaccagaaccgcccctccggaaaggggggcccacaaattctccctcttgttttctcggcccatgtttcaaatctctctgggtgttggcggctattacatttcgcccaaaataagcgggggaaattccctcccccagaatgttacccggttcaacgggaaccgggaagggccgggtgaaaggacaccctttcttaccctcttt

SEQ ID NO: 83806 - protein, 171 aa, Zea mays
  misc_feature: Ceres CLONE 1569752
  misc_feature: SWISSPROT Homolog: EC 6.2.1.12 4-coumarate--CoA ligase
MARTAAPAAGYGEDGVYHSATGQSLTFAAFRSAVLTTAVALSSRAGVRRGDVVLFFAPNCFLYPVCFFAAPGLGAVATQANPLYTPSGGRLNRPPNSPGQARNHRLLNPLPKNRGTSGFPTLPCLQRGGGERRTRANGPPPPQSPHGKARGDPLLLHKPPFSPGAPGKKRK

SEQ ID NO: 83807 - DNA, 876 bp, Zea mays
  misc_feature: Ceres CLONE 1569756
ctccccgcggtggcggccgctctagaactagtggatcccccgggctgcaggaattcgtctcaccccttaaaaaacagatcgatcggtactagtaactgtcgtctgtaagccaccctctagaagcgtttctcctctgacaatatgtaattcaataatgcaggtgaagccgcgtaaaccaaaaaaatggcactggtaggcctatgctgtgctttccctcctctcagaggttcttggatacccacttggatctcgcacggtggccaacgtacatggatctccttgtgtccatctccctcgatcaggacgagctgctcggcagtggtatctggcggaggtatacttcatagacgcctactaggcgaagaggctctcgggctacgagggatacacggcgctggacatcagggacagggcgacagcgcaagagggcaaacatcaagtgctccacacacttgcctctcttcattgagaaccaagacaacaacgttgggaccatcgtgaagcacctgctgcacaacaacttcgcggagctcttcttcgggctgctcttcgccaagctcagacgcgacttcggcctgacagtcaaggacaatttctcccgagagcaagctgctggttgtctaccaggaagtctcaggtcagcgactgctgcacatgcactggagaaagtacgcttcgacaatattgcatgcatcacatcatgtcgtcgaacagtgtagcctgcatcgtttgtatctagcgggaatacgtgagctgcaaagcgcgagtatacctggcctgtgacataccaaggaacatctctgcatccttgagactgtatgatggctgctaccagatataacatgctgcagaccagctgagagcgtttgactggct

SEQ ID NO: 83808 - DNA, 964 bp, Zea mays
  misc_feature: Ceres CLONE 1569758
  misc_feature: Encodes the peptide sequence at SEQ ID NO. 83809
  misc_feature (394)..(394): n is a, c, t, g, unknown, or other
  misc_feature (474)..(474): n is a, c, t, g, unknown, or other
  misc_feature (741)..(741): n is a, c, t, g, unknown, or other
ctccccgcggtggcggccgctctagaactagtggatcccccgggctgcaggaattcgtctcacccctagaaaaatccgttccgagccgaaccaaggcgccatgagctccccggccgtgcgccgcgtcgtactcctctcgtcactcctctgcgccggagcgctcggtttcttgtcatgctcccatggcgccgcggtggcgcccggctacgtcgccgtctccgccgccagcttcgtgccgtcctcaacgtgcagctcccccgaccgagttccgccgcagcggcggaacggcacgtccgccgtgctgcggctgacgcacaggcacgggccgtgcgccccctcgcgggcgtcctcgctagcggccccgtcggtggctgacacgctgcgcgcggaccancgccgagcggagtacatactgaggagggtgtcggggcgcgcgcctcagctgtgggactccaaggcggcggcgacggtgcnggcgagctgggggtacgacatcggcacgctcaactacgtggtgacggcgagcctcggcacgccgggcgtggcgcagaccatggaggtgggcaccggcagcgatctgtcgtgtgtgcagtgcaagccgtgctccgcggcgccgtcgtgctacagccagaaagacccgctcttcgaccccgcccagtcgtcgtcctacgccgccgtgccttgcgggggccccctgtgcgcggggctgggcattctaccccggtccgcctgctcgggggncaattgcgggtacttggtcaactacggggaacggtccaaccccacgggcgggtaaggttcgaaacacctcaccttgtcgggaacaagggggtggcaggggttcttccttggctgggggcacgcccaaagaggcctgttcaaggggtcaaaggggcccctgggcccgggcccaaaaaaccctcctcttgtgagcaaaaggggggacctatcgggggggccttct

SEQ ID NO: 83809 - protein, 231 aa, Zea mays
  misc_feature: Ceres CLONE 1569758
  misc_feature: SWISSPROT Homolog: EC 3.4.23.12 Nepenthesin
  misc_feature (98)..(98): Xaa is any aa, unknown, or other
  misc_feature (125)..(125): Xaa is any aa, unknown, or other
  misc_feature (214)..(214): Xaa is any aa, unknown, or other
MSSPAVRRVVLLSSLLCAGALGFLSCSHGAAVAPGYVAVSAASFVPSSTCSSPDRVPPQRRNGTSAVLRLTHRHGPCAPSRASSLAAPSVADTLRADXRRAEYILRRVSGRAPQLWDSKAAATVXASWGYDIGTLNYVVTASLGTPGVAQTMEVGTGSDLSCVQCKPCSAAPSCYSQKDPLFDPAQSSSYAAVPCGGPLCAGLGILPRSACSGXNCGYLVNYGERSNPTGG

SEQ ID NO: 83810 - DNA, 920 bp, Zea mays
  misc_feature: Ceres CLONE 1569759
  misc_feature: Encodes the peptide sequence at SEQ ID NO. 83811
tccccgcggtggcggccgctctagaactagtggatcccccgggctgcaggaattcgtctcacccctagaaaaagtgtctcacctctatcgccatccgttccctactccacttcaatccgctattcctgctccactccgcttcaatccgccgcccctgctccagtaggaacgttccccaccccggcaaccccccccacgctagctactccggagcaccggaacgcaccgtcgcccccgtcaagcaggttgcgccgcccgcccgtggtgccggcgctgtgctggaggcggtggagctggggccgtggggaagcttctcgctggggagagccgggacaagctagagcgacggacatgggtcaccagtaagccacggtcaggggcatttcagtcccacccaccagtggtgatggcaaaaatctaacataatgcaagaaaaaccttggaatgaatgtacaagccacttagggtgctgtattagagctgtaacaggatgggttcgttatgctgcgtggcggcacggcctcatggggctagcacagcaagccggggagtggtcctctattagccgtagcgacccaccctggcgtactggtgctggcttctcccccctctgtctagagggtgggagaccagatcaactcggaagggctgtcttatggatcccatggggatagtgggggcgctgggaactatggatcatcactatcctccaaatataaaagggctagtagaacctgggaaaggaataacctccccaaaatccccgctccctaaatctgagggtgccattttcgatctcaaagcccaaatatcagcttccagaatcaccttattatgccacccaagcgtgcaaaatccaggggtggaggaaaaacaagagaaagttccgcccgtggaccctatgggtctttatttatggg

SEQ ID NO: 83811 - protein, 82 aa, Zea mays
  misc_feature: Ceres CLONE 1569759
MQEKPWNECTSHLGCCIRAVTGWVRYAAWRHGLMGLAQQAGEWSSISRSDPPWRTGAGFSPLCLEGGRPDQLGRAVLWIPWG

SEQ ID NO: 83812 - DNA, 946 bp, Zea mays
  misc_feature: Ceres CLONE 1569760
ctccccgcggtggcggccgctctagaactagtggatcccccgggctgcaggaattcgtctcacccctagaaaaagtatcctctcctcagttgcttcgacgtatttctctctctatctatacggttccgaagaaggtagagagagaaactcgaaggggagaggacagaagagggagatacaggtacactgctcctgacccctcctcgattggtcagttctgttcttgagcgcactgccaccacagattggacggcttgtctgctctccgttcccggagtggcgtcgtgctcactctgctgggttgctttgccttatagtcttgctctgcggtttgatttgcttcatcttttttttttcttcaatcttgtcactcctaaggtttcccccctctggttttcttgattccccgcttgggaatttgtgaagtttaacaggatttttttttggctgagttcgcattgtttctgttcttggccatgccccatgctatgctttgctgggataagctttgggcttccagcctagctcgcatttgcacgattgcgttggttcttagaaatcccgatcgcaacctcttattaagctgaacaaccttttttcgggggattggccccggggccgttggggcctgttttaagggttttccggcaattttggggggggggggggaaattctgcaaacccccttttcctttcctagccaagggaattaaaaggcgttgaaatcccattttgggggggaacccccaaagaagttaaaaccgggccgcgaaaaaagggggcctccttttgagggggggggaatattccctgtgttaaaaactctcaaaaggaagtttccaagtccggggttttttcaagggcccaaaaaatttttgtgataaccaaaccacaaaattttgtgcgagaaacacctttttcccggggagagaccacaaaaaacaaa

SEQ ID NO: 83813 - DNA, 952 bp, Zea mays
  misc_feature: Ceres CLONE 1569765
  misc_feature: Encodes the peptide sequence at SEQ ID NO. 83814
ctccccgcggtggcggccgctctagaactagtggatcccccgggctgcaggaattcgtctcacccctagaaaaaatctgaccacgtcacacgacaccaccaccagccctccccttcatcaattggagcacggcgcccgttcattcccctctgctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgttagttgctgccgttgttgaagacgcgtagctctttagggttcgcgatccccccccaatcggttcgagaattggtaagctatggatctctcgcgggccacatcgtcggacctctcgctcggggctcactctcacggtcacgcccacgcccacgctcgaatggacgcggtagccgcgccgctgcgcctgttcgacgacgcgaagagccaaagccggagcgcgtcgtggcccgataagcctacgccggaaaggatgaccaggacgggggctaccagcacttctccctcctcgggcactccctcttcctcaagcgcccgcgcccgcgccggcaacggcggcgggggcggagaagacttcttctgggttcgtcaactcccggggggcttcgccctgccaagcaaaaggcaaccgggggaaggcacccgccccaaaatttggaaaacccgccccgcccgcggtccccgccctggggaaaacaatcccttgggggaaaggccaacccgaacttcccctctcctaaagagacaagagaattgaacccccccggggcaaaagacacccaacccccttaaggccggaaaaaatttcggctctcccccggttggcctca

SEQ ID NO: 83814 - protein, 125 aa, Zea mays
  misc_feature: Ceres CLONE 1569765
MDAVAAPLRLFDDAKSQSRSASWPDKPTPERMTRTGATSTSPSSGTPSSSSARARAGNGGGGGEDFFWVRQLPGGFALPSKRQPGEGTRPKIWKTRPARGPRPGENNPLGERPTRTSPLLKRQEN

SEQ ID NO: 83815 - DNA, 924 bp, Zea mays
  misc_feature: Ceres CLONE 1569767
ctccccgcggtggcggccgctctagaactagtggatcccccgggctgcaggaattcgtctcacccctagaaaaacctgtcgttgctctccgccgccaccagtgcccgtagcgctcgccgccgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccggcctcgccgtccgcttcctcgtgccgcggccggccgaggtaaccccagaagcctggcagctcctctccatcttcctctccaccatcgcggggctcgtcctcggcccgctccccgtcggtgcgtgggcgttccttggcctcacagccaccgtcgccacccgcacgctccccttcaccgccgcggttggggcgttcactaacgaagtcatctggctcatcgtcatatccttcttcttcgcgcgcgggttttgtaaaaacggactcggcgaccgcgtcgccacctactttcggcaaaggggtggggcgcaccactttggggcctatcttaggggcgtggcatcaggggagggttttatcttcccctggcatggcccaaaaaccacggccaggggcgggaggtgttttccttccccattggcaaagtcgctattcgctcctcgtccggaaacaaggcccaccgaatccttcgggcgaaaaaaacccgggcccctttatttggggcaac

SEQ ID NO: 83816 - DNA, 941 bp, Zea mays
  misc_feature: Ceres CLONE 1569768
  misc_feature: Encodes the peptide sequence at SEQ ID NO. 83817
  misc_feature (888)..(888): n is a, c, t, g, unknown, or other
ggagctcaccgcggtggcggccgctctagaactagtggatcccccgggctgcaggaattcgtctcacccctagaaaattgtacacaccgcccgtcgctcctaccgattgaatggtccggtgaagtgttcggatcgcggcgacgggggcggttctccgcccccgacgtcgcgagaagtccattgaaccttatcatttagaggaaggagaagtcgtaacaaggtttccgtaggtgaacctgcggaaggatcattgaagaacaactcccagttcgctacgcgctcaccgaacctgacgttcaggacccacaagctggtgacacattaacccaccaaatagcgtcacccaccactgttcgtcgtccgcaaaccaataatttggggagaaaattcccaattacggcgggcaaagagagtgatagagaggaaatattttttctctctctctccaatttttcacccccaattctgactcgccagcggcgccaccatctcgccagaatcctagtcgaagtgttggtagcgtcgggccgtggtcgggagcccgcttgtcgcggcgagctccaccgccgcggatcgctggaacccttgggcggcggcggccgaagctaaggtttgctgctctacccgaacagctagcgtggcaaatcgtccgcccgcgggggctgcatttatttttgtgcctttccccggcagatttcgttgcagcccccggtccaaaaatttcgccgcctggaacacggtccgctccaggcccaaattgttgaggcgactgggggcccagggcgccaagctttattttcccagccctaccaaatttccggggctcccaccccgggagggacaaattccccaaaagcccgccctccctccacttgggaaagaaaaaanttaggggtgaacaattctctcggccaagccattttccgcaaagggtgggttgg

SEQ ID NO: 83817 - protein, 65 aa, Zea mays
  misc_feature: Ceres CLONE 1569768
GAHRGGGRSRTSGSPGLQEFVSPLENCTHRPSLLPIEWSGEVFGSRRRGRFSAPDVARSPLNLII

SEQ ID NO: 83818 - DNA, 858 bp, Zea mays
  misc_feature: Ceres CLONE 1569769
  misc_feature: Encodes the peptide sequence at SEQ ID NO. 83819
ctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaagccgtgtggttcaaggccgggtcccagatcttcagcgagggcgggcttgactacctcggcaacccgagcctgatccacgcgcagagcatcctggccatctgggcgtgccaggtggtgctcatgggcgccgtcgtagggtaccgcatcgccggtggcccgctcggggatgtggtcgacccgctgtaccccggctgcagcttcgaccggctcgtgctcgccgacgacccgaggcgttcgcgagctcaggtcaaggagatcagaacggcgcctcgcatgttccccatgttcggcttctcgtgcaggcatcgtcaccggaagggccccgtgagaacct

SEQ ID NO: 83819 - protein, 232 aa, Zea mays
  misc_feature: Ceres CLONE 1569769
  misc_feature (58)..(224): Pfam Name: Chloroa_b-bind Pfam Description: Chlorophyll A-B binding protein
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVVGYRIAGGPLGDVVDPLYPGCSFDRLVLADDPRRSRAQVKEIRTAPRMFPMFGFSCRHRHRKGPVRT

SEQ ID NO: 83820 - DNA, 956 bp, Zea mays
  misc_feature: Ceres CLONE 1569770
  misc_feature: Encodes the peptide sequence at SEQ ID NO. 83821
ggagctccccgcggtggcggccgctctagaactagtggatcccccgggctgcaggaattcgtctcacccctagaaaaaaacagctactccgcctcctcgcccttttctcctcatccctcgctttcgcttcgccgttccaacgcggagcccccacggaaaataaaggccaagaagtgatggtagtggagtaaaaccacgcgttggagggcagagggacaggttggtggaggacgcgcacccagcgtggagagcagcaggagctacgcgaattcgggccgcgagtgcgccggttcaggttgccgccgccggtggaattgtggcagacgaggtggcctgttggtagccgcgggagtttgcgagtaggtcggttccggttggtgtgcgagcgaaggtgctgttggaggcgtggatctggccggcggcgggcgatgggaaggagggactagggctcgattggagggaaaggcgcgatcttggaggttcccatgggcggatgcctctcgcaggaggagcaccggctccagagcaggccagctgaagctgctggagcagatggattgcggaagtctaaatctgattctaaagctgtagcaagtgttcttgctcctccaaagatgtggtggacctgcaagtagaaggatatgggaatgtgaatattttcacatttgacgatttagagcagccacaaaaactttcggcagatcaattcttggagagttggattttggatttgtttcaaaggggaattgagaaaaaggtaaaacagtttcccatcgagacggttggtggtaaagactaaacccgagggctttcagggggacaggagtgcttggcaaaaccacctaccttgggaacttgtctccaaaacttgttaaatgattgggattggccgggagggcccaataacggcttgccatagaaacagggctggggaacacccagaaaccccttttcgc

SEQ ID NO: 83821 - protein, 49 aa, Zea mays; identical to SEQ ID NO: 82454
  misc_feature: Ceres CLONE 1569770

SEQ ID NO: 83822 - DNA, 960 bp, Zea mays
  misc_feature: Ceres CLONE 1569771
  misc_feature: Translation starting site: 153
  misc_feature: SWISSPROT Homolog: EC 5.4.2.1 Phosphoglycerate mutase
  misc_feature (695)..(695): n is a, c, t, g, unknown, or other
  misc_feature (696)..(696): n is a, c, t, g, unknown, or other
ctccccgcggtggcggccgctctagaactagtggatcccccgggctgcaggaattcgtctcacccctagaaaaattccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcatgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggcgctaagcttttgatcaagctcttgcctcaggaaagatttatgatggagatgggttcaactacatcacagaatcttttgaaaatggtactcttcaccttattgggttgttgagtgatggtggtgtccactcccgccttgaccaactgcagttacttctgaaaggtgtcagtgagagacgagcaaaaaaaattcgtgtgcacatccttaccgatgggcgtgacgttttggatggcagacatgatggtttcgtcgagaccctannagatgatcttttcgagcttcggagacatgggtatgatgcacacattgccttctggggtggaaagaatgttggtccccatgccccgttatgagaatgactgggaagcggtttaacctcggtgggatgctcaagggcccggaaaaccaccttacaattccaaaagggacttggaggctgcgaaacacctaggagcccagcccattgctatggccaatactttggcccccattgttgaaggttaattaccgcggccaaacctgtggg

SEQ ID NO: 83823 - DNA, 889 bp, Zea mays
  misc_feature: Ceres CLONE 1569772
  misc_feature: Encodes the peptide sequence at SEQ ID NO. 83824
  misc_feature (615)..(615): n is a, c, t, g, unknown, or other
  misc_feature (644)..(644): n is a, c, t, g, unknown, or other
  misc_feature (889)..(889): n is a, c, t, g, unknown, or other
ctccccgcggtggcggccgctctagaactagtggatcccccgggctgcaggaattcgtctcacccctagaaaaaactggtagacaggacaagcatcagaattactagtcaccagcagagggacgacgggagaaggaaacccttcgccctcgctgccgccttctccttccccggtcgcgtcttgttggggctctctcgtggtctcgacccgccggccgagttctcgcgtccaagcgtggcaatccacatatctctgtctccctctctcgctcacccctgtatccccgtctaaccgaagagcccaatcaatcgaatcggatcgaaacagaccgtgtattcaatctgctactagggaagggggaagcgcgagcgtgcttgcgtgcgtgcgttccttcgttcgtgacaaggcggcccggccggccggccgatcgatcggcgatggcgccgccgtcgagggactactggctgggcttcttccgcggcgcaggggacaacgtgttcgacgccatcgacgcggccatcacggtcgccgcgtccgacccaccggccgccctcggggagcgccgcgacggcatcgccgagcgcctcttcaccgcgctcctggtgacccgccccncggggggcgggggcggcggcgggccaggnaaggtccgcgggggagacccccgtgcccagcctctgcagctccgacccgcgcgaggccgtcacgaacgacgcgcgcgcgcggaacgatcccgtcctcgcgagacggaacgcatcagggcgtcctcctcggcggcataacaagtcggatcccgagtgctggagctctccggcggctgcagagctggacctccttccaaccctggatgccctggcatcggcaacggtgtccacttccgaaaccaccn

SEQ ID NO: 83824 - protein, 114 aa, Zea mays
  misc_feature: Ceres CLONE 1569772
  misc_feature (60)..(60): Xaa is any aa, unknown, or other
MAPPSRDYWLGFFRGAGDNVFDAIDAAITVAASDPPAALGERRDGIAERLFTALLVTRPXGGGGGGGPGKVRGGDPRAQPLQLRPARGRHERRARAERSRPRETERIRASSSAA

SEQ ID NO: 83825 - DNA, 919 bp, Zea mays
  misc_feature: Ceres CLONE 1569773
  misc_feature: Encodes the peptide sequence at SEQ ID NO. 83826
  misc_feature (892)..(892): n is a, c, t, g, unknown, or other
ctccccgcggtggcggccgctctagaactagtggatcccccgggctgcaggaattcgtctcacccctagaaaaaaccgctacccattgcaaacgctttccctccactcgtccgctccggccgcgcgcctccgccccacgccgatgccgcccccgccctcgcccccgccgcctctcggcctccgcctccgtctctccctcctcccgccccaccctatcgcgccttctatccgtcatgccttctgctcaccctccgtcgtgtcctgccatctttcggtgcgccccctcgcccaacgccgcggtgggcgcccgcgccccctctgcgccgcgcggggcgaggccgaggcggagggcttcgcgtggccggatgggtccgaggaggagctgcggcggctcctggagctgctccctagggagctgagtgggcgggtggagacccacccagagctcccggcgctcgtggaggtggtcatggacctcggccggcccccgctcgcgcgcttcccgtccggagacttccctctctcccaacgccccatctccttcgacgacctccgtcacgctacctcccagtttggggactttggagcggataatcgtgctggaatcagccgcacgctgcaccggatcagcgccattaggaatcggaagggcgtcattgtcggcctcacatgccgtgtggggcgtgcagttgccggggagcgctatttgcttcaggatttgggtaaggaccgtggtcattgctgctcatcggccacctgggggtggggaagactactgtcataagaaaattgcccgtatgttagctgatgactttaaaagcgcggatgattgtcgaccctctatgaaatgggggggggatggtgatttcctccccaggaatagcaatgcccntggtggcagtgcctaccaaaaatgggg

SEQ ID NO: 83826 - protein, 213 aa, Zea mays
  misc_feature: Ceres CLONE 1569773
MPPPPSPPPPLGLRLRLSLLPPHPIAPSIRHAFCSPSVVSCHLSVRPLAQRRGGRPRPLCAARGEAEAEGFAWPDGSEEELRRLLELLPRELSGRVETHPELPALVEVVMDLGRPPLARFPSGDFPLSQRPISFDDLRHATSQFGDFGADNRAGISRTLHRISAIRNRKGVIVGLTCRVGRAVAGERYLLQDLGKDRGHCCSSATWGWGRLLS

SEQ ID NO: 83827 - DNA, 942 bp, Zea mays
  misc_feature: Ceres CLONE 1569774
  misc_feature: Translation starting site: 223
  misc_feature: SWISSPROT Homolog: EC 2.3.1.41 Beta-ketoacyl-acyl-carrier-protein synthase I
ctccccgcggtggcggccgctctagaactagtggatcccccgggctgcaggaattcgtctcacccctagaaaaagcgaacccattctccatatacacaggggtaacgctccgcctcgcagccagcaggacaccactcatcttccttcccccccgcctcgtttccatcgccgccactctcttgctcccccgtaccatccctcgccaccgccaccgccgtcgctatgcagagcctcctcgtgcccactgctgcatcggccccggtggcggctccgcgggctcggcggaatctccctatgcgcctctccgtccgcgcctccgcgacggcggcagcggcaccgcggcgggagacggatcccaagaagcgggtggtgatcacggggatggggttggtctccgtgttcgggaacgacgtagacgcttactacgaccgcctgctagccggggagagcggcatcgggcccatcgaccgcttcgacgcctctaagttccccaccgcttcgccggccagatccggggcttctcgtccgagggctacatcgacggaaagaaacgacgccgcctcgacgactgcctccgatactgcatcgtcagtggcaagaaggctctcgaggctgccggtattgcccacggctccaggccatgggaaaagattgacaaaccccggggctggtgtgcttgtgggcacctggatgggggggcctcacgtgtttttccgatgggggtcaaaaacccattggaaaagggcaacgaaaaataacctcctttcttccccccataggctataaacaaactgggttcccgccccgcttggaaatgaaattgggtttcagggggccaaaaataatccatttaaaacggccgtggtaaccccgaaactatggtttcctatgcggacaaaacacttttccgttaaggggaaaaccgaatataatgatatggtg

SEQ ID NO: 83828 - DNA, 970 bp, Zea mays
  misc_feature: Ceres CLONE 1569776
caccgcggtggcggccgctctagaactagtggatcccccgggctgcaggaattcgtctcacccctagaaaaacggcgttcgtcaccgcgctgtccggccggctcttcgagatgtcgccgaccaaggactgacggaacggatcggatggattgggagattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaacagagatcgtcgtcaccgcccgcgggggtgtggtcgacgacgcgacatgcgaaacactacgtgctagctagcataggaaaaaacaacatgaaaatcgtacaaccaaccaatccctcgcactgttttagttgttagctgtaggcgaaactgttcatcccaattgatcaaatgaaaaattattttttcctttggataattatttattataacaggcccactgtgttttttatcaatcggagtagaaagtcccctttttgggtgttgagctttttttttcttttaaacaaaatttggccttttggaactttttcctttttttttaaaaccggcgccccaaaaaacaccctttgggtttcaaccccttttaggaaccttgtttttctgggacggccttttttttttttgggtttcacatcttgtggtgttacaggtttccatgggggttgacttttttttccccccaaagtgttatgttttgttccccttaccaaaaaacttttttaaaaaaaaactgggcatgggccggtgtgttttgatccccaaaaaggtcttaaattaaaaattggcgccggggggaaataatgtcaaaatacttt

SEQ ID NO: 83829 - DNA, 946 bp, Zea mays
  misc_feature: Ceres CLONE 1569777
  misc_feature: Translation starting site: 283
  misc_feature: Pfam Name: Terpene_synth Pfam Description: Terpene synthase, N-terminal domain
  misc_feature: SWISSPROT Homolog: EC 4.2.3.13 (+)-delta-cadinene synthase
ctccccgcggtggcggccgctctagaactagtggatcccccgggctgcaggaattcgtctcacccctagaaaaaaactgtgattggcggtagcccatcgacgacacgagatatcagctgcctcagatctcgtcggtgggtgccaatcacattcttcgacagtttgtcgatcgtcgtcaagacatttcaacagctagctagcctgcctataaaatgcgcgcgcacgaacctctgtagcacaaatggacctgtgagaaagcaagaaataaagatatatacacacatggctactacgggcacaacatctatgccagcacctgtgtttcaccccacggtgtggggggactacttcatcaaatttgtcccagagccattgcaggtttcagatgaaacgatggcagagagaatcaggcatttgagagaggaggtaagtggtatgttccaggcttgcaagaacgttgtggacaaaacgaacctagtagacgtggtacaacgtcttggaatagatcaccatttcgaggaacagatagccactgccctagccagcatccacagcgctggattattcaatagctcaagcctacacgaggctgcccttcggtttcgcttgcttaggcagcaggggtttttgggtttctgcagatgaacttgtcaagttcatcaggaacgaagacgggagctttatcgatggtataaccaatgaccccaagggcctgttgagcttatacaacgcagctcaccttgttactcacgacgaggggacgacgacacttggtgatgccatcgcatttgcaaggaacatctggaagctgtaaaaaatgaagcctcaagcccctctagctgaacaatcgggccggccccttggtatccactggccaggactttaagagggaggaggcaataactttttcccgggattaagctcaaaaagaacaaaagggtaccgc

SEQ ID NO: 83830 - DNA, 913 bp, Zea mays
  misc_feature: Ceres CLONE 1569778
  misc_feature: Encodes the peptide sequence at SEQ ID NO. 83831
ctcaccgcggtggcggccgctctagaactagtggatcccccgggctgcaggaattcgtctcacccctagaaaaaagctggtgagtagtagtagtatactagaagaggaggaggagagggagaagacgaagcgaagccatagcaaggtcgtcggagccggagagggaggagggtggggaacctcttcctgcgtcacgtgacaactgtctcctgacccaccggagcggcggactccctctgcgcgccgcgcacggcctgttccggtgcggtcgcaggccgacggccggcgacggaggcagcaggaagctactataccaaccggcccaagagaattgcgggtccagaggcagtgatggcggggcgctacgattgacgtgctacgattatgggcatccaaggcaacaaggcggcgacgcacgagcacgacttcctctcgctgtacgccgccgccgccgccaaggacgctcctctcctgctacacgactccaaggcgccgcctccttctcaaggtaatttcctcttgaagacgcacgactttcttgcgcccgttggatcagaagccgggagcgcccgcggatccgtcgccgctgcccgcttccgccgcggagagcaggcacccaccccagcagcaggtcgtcttcgcgtatccagacggtctgccccttgcccgggggcgtccgcccccttttattcatcccccccgcccgtgttcgtcctcttttcggggggcgtcgttcatgcggacccccctttcttgttttggggctagcctgccgcatactccctcctggggcccgagggccccctccggtgtgggcgttccccttttcccggctccgggaatgttagtttcccccccttaggccccccctgaataaaaagggccggggccgccccggttgccggccttttta

SEQ ID NO: 83831 - protein, 127 aa, Zea mays
  misc_feature: Ceres CLONE 1569778
MGIQGNKAATHEHDFLSLYAAAAAKDAPLLLHDSKAPPPSQGNFLLKTHDFLAPVGSEAGSARGSVAAARFRRGEQAPTPAAGRLRVSRRSAPCPGASAPFYSSPPPVFVLFSGGVVHADPPFLFWG

SEQ ID NO: 83832 - DNA, 923 bp, Zea mays
  misc_feature: Ceres CLONE 1569779
  misc_feature (399)..(399): n is a, c, t, g, unknown, or other
  misc_feature (402)..(402): n is a, c, t, g, unknown, or other
ctccccgcggtggcggccgctctagaactagtggatcccccgggctgcaggaattcgtctcacccctagaaaaagcaggtcgccacctccctcccttcttccacctcggctccgcttcttgggtcttgcttgctcggcctgaccaaccaagaacgaggagaagggatggggatggggtggcggagggcgctgtgcacgtccgtccagcgggacgacgaccccgaccgcgacgccagtaccaagaagcgccggccgcagtacgacgcgccgagcccgcgcggcaccgccgccggtttcttctccgccgtcaagagcgcggccgccggtggcggtgcggctagcggcagtggcagcaacccgtccacgccggccctccgctgccgcaccaggccgctgcancanccggctgactccgcccccgtgacgccgccctccgcgccggctcccgccaggaaccaccgggtgccgctgatgcaggcgctgtcggcgccggtctcgcctagatccccctccagattcgcgctgctcaaggcgtcgctcctcccgtccaagtcccggtgcggcgtgtgctcgcgtggcgtcaagagcggcggcagctcggcggtgttcacggccgagtgctcccacgccttcacttcccctgcatcggagcccacgcgcgctcctccttccgcaacggcgttctgtcctgccccgtctgcgccttgccgtggcggcaggagccctttctcggctccttcggcctcattgttcctttcacacgacaggccccaaggaggaagccaacgccccaaaacccccccccccccaagctttacaacaacaacaagccgcttttggcccccagggccgcggccaaggggggcggttctaacccatccccggggcccaaaaaacaaacaagaaggacggatcccccccca

SEQ ID NO: 83833 - DNA, 879 bp, Zea mays
  misc_feature: Ceres CLONE 1569781
  misc_feature: Encodes the peptide sequence at SEQ ID NO. 83834
tcaccgcggtggcggccgctctagaactagtggatcccccgggctgcaggaattcgtctcacccctagaaaaagaggcccacacagtacgtacaagcctctcatcagcaatggagtccaccaagctctccgcgctgctggtgctcgccatgctcgcgctctcctcgtccccgctggctctagcgtgggagaaggcggaaccggagtgccactcgtgcgagtccggctcgccaccctcgaccggcggcgtccccctgcctcccgtcagcataccgtcagtcccgctgccccctgtcagcataccgtcggtccccctgccccctgtcagcataccgtcagtgcccctgccgccggtgaccctccctcccattccgatcgttgggggaagcccgagcccgacgaagaagggacaccggaaggcgtgcccaccgcctccgtctcccccgacgccgacacccacgcccacgccgtcctcggacaagtgccccatcgacgcgctcaagctcggcgcctgcgtggacgttctcgggaacgaggtgcacgtcggcgacgccaacgtccagtgctgcccgctcgtgaagggcatcgccgggctctccgcggcggcgtgcctttgcacccgcatcaaggccaaggtgctcgacatctccgtctacgtgcccatcgcgctcgaggtgctcgtcaactgcggctgcgccgtcccgccaggctacaaatgcacttgaacgatgccatcccattccattttcattttcacccagcacacgtgcacagcaatacgtctcccttttgcccctccgatgcaaagtttgaaaagctcctcaacggatttggtgggtagccgcccgcccgccggccggctggtccacaaggtgcttct

SEQ ID NO: 83834 - protein, 204 aa, Zea mays
  misc_feature: Ceres CLONE 1569781
  misc_feature (125)..(203): Pfam Name: Tryp_alpha_amyl Pfam Description: Protease inhibitor/seed storage/LTP family
MESTKLSALLVLAMLALSSSPLALAWEKAEPECHSCESGSPPSTGGVPLPPVSIPSVPLPPVSIPSVPLPPVSIPSVPLPPVTLPPIPIVGGSPSPTKKGHRKACPPPPSPPTPTPTPTPSSDKCPIDALKLGACVDVLGNEVHVGDANVQCCPLVKGIAGLSAAACLCTRIKAKVLDISVYVPIALEVLVNCGCAVPPGYKCT

SEQ ID NO: 83835 - DNA, 954 bp, Zea mays
  misc_feature: Ceres CLONE 1569782
  misc_feature: Encodes the peptide sequence at SEQ ID NO. 83836
  misc_feature (810)..(810): n is a, c, t, g, unknown, or other
gcggtggcggccgctctagaactagtggatcccccgggctgcaggaattcgtctcacccctagaaaaaatttcgctaatgcgacggtgaaatcccgcacctacctccttcctctctctccgaggaccctcgcaccaagaactgagcgggaagagaggtagagaggcaagcgcacgagagtttctgctcctctctcgcctcgcctccgtctcctttcctctctggttctctctctgcgattctcgtcgcattggttccgttccctcacgaaaggcggtagctttctgtcttccctgatctatctagataatggcgaccacgacgtcagcgaccaccgccgccgcagcagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcaaaggctgccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtgggcccgtgctattccagaactcactagccttgaccatattgaagaagctgctggttctaggacctgtaatagaaagggaatttatgtggtggcgctttcatggaaccgtggtatcagagaagtagtggactggaagtccaaaaaaagtgtttttcccccttcgaacttagggagaactggtncatcttggcgagcaagaaggccccccccatctgttgtagggtgtcaccgggccttaatctttggttctcggtgaaggagaaaaccttgcccaggttaaaaagttggaaggagtggaaaaaacagtgagggcgtggggaaataat

SEQ ID NO: 83836 - protein, 191 aa, Zea mays
  misc_feature: Ceres CLONE 1569782
  misc_feature (85)..(191): Pfam Name: GlutR_N Pfam Description: Glutamyl-tRNAGlu reductase, N-terminal domain
  misc_feature: SWISSPROT Homolog: EC 1.2.1.70 Glutamyl-tRNA reductase
  misc_feature (168)..(168): Xaa is any aa, unknown, or other
MATTTSATTAAAAAATTAKPRGSSSALCQRVAGGGRRRSGVVRCDAAGVEAQAQAVAKAASVAALEQFKISADRYMKERSTIAVIGLSVHTAPVEMREKLAVAEELWARAIPELTSLDHIEEAAGSRTCNRKGIYVVALSWNRGIREVVDWKSKKSVFPPSNLGRTGXSWRARRPPPSVVGCHRALIFGSR

SEQ ID NO: 83837 - DNA, 1052 bp, Zea mays
  misc_feature: Ceres CLONE 1569783
  misc_feature: Encodes the peptide sequence at SEQ ID NO. 83838
  misc_feature (962)..(962): n is a, c, t, g, unknown, or other
  misc_feature (1027)..(1027): n is a, c, t, g, unknown, or other
ccccgcggtggcggccgctctagaactagtggatcccccgggctgcaggaattcgtctcacccctagaaaaaagcacgcccacacagcagcatcaacctcgggtgctctgcggccactggactgccctgccagtgcccgtgcccgcgcgcgctagcctagctgctcctgcctggttcgccgtagcccgtagcacaacaacaacaacaaaaaaaaaaaatctccgcgccgcggggggaggtggtctgttcaccttggggagcagcggcgggccggcggccgagaaatgcccggtggcgccttcctcctcaacggcagcggcggcggcatggcggactacggcggcggcctcaccgtacccgtcgtcgtgacctgcctcatggcggcctccggccccctcatcttcggctacgacattggcatctcaggaggtgtgtcggagatggaggatttcctgaacaagtttttccccgggttgctcaaaaggacggcgcccgccaacaaggacgtggactgcatttttacaacaacagggggctgacgggctttcacgtcgtccctgtacgcgtttcgggattggtgggggaagcttgctgtgcgagcccccgtagaccccggcgggcttgggggggcccagagccgtcaatgctttatactggggggcgggcccttgtttcttgggccggggggccccctccttacaaacgccgccccgtggggccaaaatattcggccttgggcttcaatccttccgggaaaagaagagcttgctttccggccatggggaggctcgtgattttcctcccgggcaggagccaccgtccggtgggtataccctcgccggaatgggggggccccccccccccttgggggcgggcgggttttaattctgtggcctttccccccctttataataatgagtgtgggtaaactgggggagccaaacttacttctaatttcaganaccaccgtgtgtaaaccgcgggtgtgggaagagggaaactttattggtaggactcacacgcacgnccctgggacacttttaatgtgtggg

SEQ ID NO: 83838 - protein, 84 aa, Zea mays
  misc_feature: Ceres CLONE 1569783
MPGGAFLLNGSGGGMADYGGGLTVPVVVTCLMAASGPLIFGYDIGISGGVSEMEDFLNKFFPGLLKRTAPANKDVDCIFTTTGG

SEQ ID NO: 83839 - DNA, 862 bp, Zea mays
  misc_feature: Ceres CLONE 1569784
  misc_feature: Encodes the peptide sequence at SEQ ID NO. 83840
  misc_feature (429)..(429): n is a, c, t, g, unknown, or other
  misc_feature (498)..(498): n is a, c, t, g, unknown, or other
  misc_feature (499)..(499): n is a, c, t, g, unknown, or other
  misc_feature (510)..(510): n is a, c, t, g, unknown, or other
  misc_feature (566)..(566): n is a, c, t, g, unknown, or other
  misc_feature (598)..(598): n is a, c, t, g, unknown, or other
cccgcggtggcggccgctctagactagtggatcccccgggctgcaggaattcgtctccccctagaaaaaggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgaagacgcgtagctcgctagggttcgtgatttctcgccgatcggttcgggaactggtaagctatggatctctcgcggcccgcatcgtcagacctctcgctcgggctgcactctcatgcccacgcccacgctcgcgtgcatgcngcagccgcgccgctgcgcctgttcgacgacgcgaagcccggagcgcctcgtggccggggtagccctacnncgaaagggacnaacggggacggtgggcgaacagcactttctcccctcctcgggcaactccctctggntcaaaggggccggggcggggccttaaaagggntgtggggggccggggggtgaaaaaaaatttattcctggttcgtccccgggggctggggcccccgccaagggggagggggggggggggaaaaaaaaagcggggccgtgaatttgggaaaacccccccgcgcccccgggtgccctttttctggggggaaaaacaagtgtccgtgtggggagagggccccacccccgaatattttcccccccccccttataagaagagaaaggagaattttcccccccccccagggtggttgtgtgg

SEQ ID NO: 83840 - protein, 89 aa, Zea mays
  misc_feature: Ceres CLONE 1569784
  misc_feature (51)..(51): Xaa is any aa, unknown, or other
  misc_feature (73)..(73): Xaa is any aa, unknown, or other
  misc_feature (84)..(84): Xaa is any aa, unknown, or other
MDLSRPASSDLSLGLHSHAHAHARVHAAAAPLRLFDDAKPGAPRGRGSPTXKGTNGDGGRTALSPLLGQLPLXQRGRGGALKGXWGAGG

SEQ ID NO: 83841 - DNA, 959 bp, Zea mays
  misc_feature: Ceres CLONE 1569786
  misc_feature: Encodes the peptide sequence at SEQ ID NO. 83842
acccgcggtggcggccgctctagaactagtggatcccccgggctgcaggaattcgtctcacccctagaaaaatcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccgccagataaggactgggtgggcggacgggccggaattcgtgacgcagtgccccatcaggcccgggcgcagctacaagtaccgggccaccatccagggggcaggagggccccctggggtggcacccgcacagctcctgggttcaggccacccgtctacggggcgctcattattcgcccccagtaggacaaagaccttcccttttcccaagcccttgggaagaagcccccgtcatccccgggggagtgggggggatgcgaaacccgaatagacttcttccggggaggcccaaaagaaccgggggtggtccctacgttttccaaagctttcacccataaaggggcggccccgggaacttgtaaaaattggcccaaaaaaagaacccaccgcccctcccgggggaaggcccgcaaaaacgggccctttttggtgttttttaaacccccgccctcaccacgaaagttttttcgtccccttcccccaacaatagattaatgggtttttccccccagaggggttctataaccagcg

SEQ ID NO: 83842 - protein, 178 aa, Zea mays
  misc_feature: Ceres CLONE 1569786
  misc_feature (35)..(140): Pfam Name: Cu-oxidase_3 Pfam Description: Multicopper oxidase
  misc_feature: SWISSPROT Homolog: EC 1.10.3.2 Laccase
MASSSSSRLLLLLLPCLALTLLGAADAEVHHHEFVIQETPVKRLCKTHNIITVNGQYPGPTLEVREGDTLVINVVNRAQYNATIHWHGIRQIRTGWADGPEFVTQCPIRPGRSYKYRATIQGAGGPPGVAPAQLLGSGHPSTGRSLFAPSRTKTFPFPKPLGRSPRHPRGSGGDAKPE

SEQ ID NO: 83843 - DNA, 954 bp, Zea mays
  misc_feature: Ceres CLONE 1569789
  misc_feature: Translation starting site: 484
  misc_feature: SWISSPROT Homolog: EC 5.4.2.2 Phosphoglucomutase
  misc_feature (394)..(394): n is a, c, t, g, unknown, or other
ctccccgcggtggcggccgctctagaactagtggatcccccgggctgcaggaattcgtctcacccctagaaaaaaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcactgtgacgaaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccnctatttctcaaaagatgctgttcagatcataacaaaaatgggctgctgccaatggagtaagacgtgtttgggttggacaaaacagtctcatgtctactcctgctgtatctgctgtcatccgtgaaagagttggtgcagatggatcaaaggctactgggtgcttcatcttgacagcgagccataaccaggtggtcctaaaggagaacttcggatcaaatacaactggggaaatggtgggcctgctcctgaatctgttaccgacagaatttctctaatacaacgacattctccgaatacttcctctctgaagacctaccaaaggtggaaatttcccgttggcggggtcccccagcttcagtggacctgaaggccccttttgaggggatggtttttgacccccgggtagaattaccaaagtgaaagaaaggcatttttggactcccaacaaaaaaaaaagcggctgacctccccccaagttttcattctggtttgtaaggcctccctggtgggtggggggagcttttgcccaaacccatctttttggggaagagcgtgggggg

SEQ ID NO: 83844 - DNA, 936 bp, Zea mays
  misc_feature: Ceres CLONE 1569790
  misc_feature: Translation starting site: 323
  misc_feature: SWISSPROT Homolog: EC 1.2.1.70 Glutamyl-tRNA reductase
  misc_feature (397)..(397): n is a, c, t, g, unknown, or other
ctccccgcggtggcggccgctctagaactagtggatcccccgggctgcaggaattcgtctcacccctagaaaaagattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcngccctctgccagagggtggccggcggcggcaggcggcgctccggggtggtgcggtgcgacgccgccggcgtgtaggccaggcgcaggccgtggcaaaggcggccagcgtcgccgccctcgagcagttcaagatatccgccgaccggtacatgaaagaaaggagtaccatagctgtgataggcctcagtgtacacacagcaccaggtggagatgcgtgaaaaacttgctgttgcagaagaactgtggccccgtgctattcaagaactcactagcctgaacctattgaagaagctggctgttctagtacctggaatagaatggaatattatggggtgggcgcttcctggggaccgttggtatccgagaattatgggactggatggcaaaaaaaaaggggtattcccgcttccgagctttagggagccccgtgtcatcttgcgaaacagtgatggccacacgccattctgttttgaagggtcaacctggccctttaacctcttggggttccccggggaaagaacaaatcctgtgctcagggt

SEQ ID NO: 83845 - DNA, 883 bp, Zea mays
  misc_feature: Ceres CLONE 1569792
  misc_feature: Translation starting site: 314
  misc_feature (734)..(734): n is a, c, t, g, unknown, or other
tggagctccccgcggtggcggccgctctagaactagtggatcccccgggctgcaggaattcgtctcacccctagaaaaaacccgcgatctccgcgaccgcaagcagctcggcaggcaggcctccaccgctccaccacctccactcggtctacgtgctccgtcaccaaacccacccgggccaacgccgaagcaaccccccctccgtcctccccagatccggcgccgcctccgccctcacttacactagcacgcacggcggacacgtcgcctcccccgcgcgatctgatgcaggcgcacgcggtggccagcggcgatgcggtggaagcttaactcctccgtctacaagcgcgtgccgtccagggaaaccgccatggaacccgacgtcgagacgccaatgagaatgacggacggcggcggcagcggcgcggggccgtcgtggcgcatgtcgttgccgcatgtctgtgtcgccacgctcacctcgttcctctttggataccactccggggtggtgaacgagcccttggaggtcatctccgctgaccttggcttcgccggcaacactcttgctgaagggctcgtggtgagtatctgtttgggaagagcttttgttggggcctcttcagcgggctcatcgcagatggtattgggcgacgccgtgcgttccagctcagtgcgctgcctatgattattgtgcttgccatagtgctctccccatagtttggagggatgctccntggaagattttgggaggaacaggattggattgggtccacagtagcttcccttaattacggaggttctcctccacggggagggtacattgggagcttgttcaaatgacctgcctggaataaagaacccaccattggaaccggcaaaaata

SEQ ID NO: 83846 - DNA, 963 bp, Zea mays
  misc_feature: Ceres CLONE 1569794
  misc_feature (545)..(545): n is a, c, t, g, unknown, or other
  misc_feature (607)..(607): n is a, c, t, g, unknown, or other
  misc_feature (848)..(848): n is a, c, t, g, unknown, or other
ctccccgcggtggcggccgctctagaactagtggatcccccgggctgcaggaattcgtctcacccctagaaaaaaaaaccctaatccccaccgccgcccgaccccgcagcctcattccaggcgcatcgacagcgacggcacgcgctggtccatccacggtccaccagtcgacctcgctcacccgcgagccgcgggccttgtcctcgtcgtcgttcataggcagtgcagcctcattcaccggtcgtcctcgtccaccagcgaattgaagttcctcgcccatcagccaacgacgtcgacgcggcctcgttctcgtccagcccacagcccagcgtgctgcacgtcgccttgctgttgctgtgctgctgctgcctatgtttcaaatgtcccaactggacctagccctcggacggaagtgcccaggacctgtcaatatatgccagctgtgcggcgagccagagctgagcggcgtacagatttcttgcccttgatttgatcaagggcaaaagtgtccggccactagctgccaatatataaaataagtcccngccgcattcaccaaatcggccgccagggctcccgtctctagctgctccgtccggtggtccangcagctgcctagctccctccgacgggtcggccagcaccgcctcctgctcgtgggctttgcccagcttctcccgcctcccgggaaaacttaaaatcttggtgcgggaagggccctcggaaggggggggggggggcttttttggccctgggccggggggccctgggcttaacaaaccaaaacccagtggggccaggggtcaaacctttgcaatttaaaccccggggggtaaagagcccccaanggttggtctttggggaaaggggccaattttaccaaacaacccaactctttttttctttgggggttttttccccactaggccccccaaatatttggaaccccggttgtcccacccc

SEQ ID NO: 83847 - DNA, 904 bp, Zea mays
  misc_feature: Ceres CLONE 1569799
  misc_feature: Encodes the peptide sequence at SEQ ID NO. 83848
  misc_feature (783)..(783): n is a, c, t, g, unknown, or other
  misc_feature (904)..(904): n is a, c, t, g, unknown, or other
ctccccgcggtggcggccgctctagaactagtggatcccccgggctgcaggaattcgtctcacccctagaaaaaaaaaccaagcggtcgagctagataagacaaccatgaagatgcacgaggtcgaggagcctccagcggagatcacccgcgacgcccacccggcgcacgcgctgaggctggtggccaccgacgacggcgcgccgttccggtgcgacgggtgcaaggagcccggcagcggccaggggcggcggtacaggtgcggccacggctgcgacttcgacctgcacgtggcctgcgcgctggcggggccgactctgaggcaccccctcttcggcgagggcctcgagttccagctcctcccggaggcgccgccgcccgtcgacaagacgttctgcgacgcctgcggcctgcgggcgcccggcctcgtctaccactgcttcgacagggacctggacctccacccgacctgcgccgcgctgaagccggagagcgccttcccgggcggccacctggcccagctcggctgggaggccgccgagcaccgctgcgtcgcctgcgacgccgccgccgccgccgccggcaagaggttctgggcgtaccgctgggcctacggcggcacgcacgggtacctgcacgtggcgtgcatgaaagagatcgcctttcagagctggggacaggcctaccaggccagcgtcgtctgcggcggcctcgtggatgcgagcgtgccgacgatgacagccgtgctgcacaggaagcgcaccgacgaaattacggcctgcgnttaagattaaacgcaggccgcagtcgcgtgcggaactagagctccttcagagaagtgccgtgccagtggcaccgccggccgcatcatcgttcctgccccctgggtgcccgttctgctagcn

SEQ ID NO: 83848 - protein, 225 aa, Zea mays
  misc_feature: Ceres CLONE 1569799
  misc_feature (34)..(65): Pfam Name: C1_3 Pfam Description: C1-like domain
  misc_feature (95)..(123): Pfam Name: C1_3 Pfam Description: C1-like domain
MKMHEVEEPPAEITRDAHPAHALRLVATDDGAPFRCDGCKEPGSGQGRRYRCGHGCDFDLHVACALAGPTLRHPLFGEGLEFQLLPEAPPPVDKTFCDACGLRAPGLVYHCFDRDLDLHPTCAALKPESAFPGGHLAQLGWEAAEHRCVACDAAAAAAGKRFWAYRWAYGGTHGYLHVACMKEIAFQSWGQAYQASVVCGGLVDASVPTMTAVLHRKRTDEITAC

SEQ ID NO: 83849 - DNA, 956 bp, Zea mays
  misc_feature: Ceres CLONE 1569801
  misc_feature: Encodes the peptide sequence at SEQ ID NO. 83850
  misc_feature (418)..(418): n is a, c, t, g, unknown, or other
ctccccgcggtggcggccgctctagaactagtggatcccccgggctgcaggaattcgtctcacccctagaaaaaattccagtccacacacacacacaataataattaacgagagtgctctggctagctatctcgtccggtcctgcgtcaggtatagctgcagtggggattgttttgttgatggtgtggaaagaagagagagagagaaaaaagaaagatccatggcgacggaggaggccggtgccctggcgacgaaggcgaggctggtggcggcggtgctggtgctggagctgctcgtcgcgggcttccacgtcgtgtcgagggcggcgctcgacatgggcgtcagcaagatggcgttcctcgtctaccggaacgccgcggccctgctcgtggtcccccccgtcgccatactcctcgancagtgagtggtctatgcatgtgaactctgcacaggtcgtagttagtattccccttctgattatggtatggatatgcgcacgggaccacccccttcttcaaagaaaagaaaggccgcccttcacgctaccctttgctgatgggactccttcttgctggctgcaatcgggggtaaccttcaacaaggggttctaatcctcgggccggtaatacctgggaaccaaccttcgttttttgtatccaaaaattaattccctgggataccctttcttattgggccctttttttaggccatacaagggggaaaactttttttggggaaataaaataaaccccccaaattttttttaaccccaaaaatcttttatacacctggggtgaaaaaatccaaaggttaattgggggaaaaaaacggggggaaaaaattggggccggggcccacaagggggggacacctaaccccctcaaagggggcctttttttaaaaacagtcttgagaggccccccccccgggggggcccccctctgtggggtgggggg

SEQ ID NO: 83850 - protein, 67 aa, Zea mays
  misc_feature: Ceres CLONE 1569801
  misc_feature (66)..(66): Xaa is any aa, unknown, or other
MATEEAGALATKARLVAAVLVLELLVAGFHVVSRAALDMGVSKMAFLVYRNAAALLVVPPVAILLXQ

SEQ ID NO: 83851 - DNA, 932 bp, Zea mays
  misc_feature: Ceres CLONE 1569803
  misc_feature: Translation starting site: 150
  misc_feature: SWISSPROT Homolog: EC 2.5.1.46 Deoxyhypusine synthase
  misc_feature (399)..(399): n is a, c, t, g, unknown, or other
ctccgcggtggcggccgctctagaactagtggatcccccaggctgcaggaattcgtctcacccctagaaaaagaagcgaaagcgaggctgctgtctcacggctgcggctgcggctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccgtcggactcgaggggctgctcgcctcgctcgcgtccaccgggttccaggcatccaacctcggcgacgccatcgacgtcgtcaaccagatgactggaggttgtcgcatgagaagcccanccaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttccctggagcactgctgcggtcaaaaggactgaaccggataggaaatctgttggtgccccatgacaactattgcaagtttgagaactggatcatgcccctcttcgaccagatgctacgggagcaatctactgaggtaagcatccctgctggggccaagctttcaaatatttcttctgggtgaaacaaatgtcctggctaaccctggcttccatttgccgtatggagttgcttttcaaaactacagaggtgaattggtttttttttgcaatcgggtaaaagtgttctttgaagaggatttaaatttttcggcg

SEQ ID NO: 83852 - DNA, 725 bp, Zea mays
  misc_feature: Ceres CLONE 1569804
  misc_feature: Encodes the peptide sequence at SEQ ID NO. 83853
ctccccgcggtggcggccgctctagaactagtggatcccccgggctgcaggaattcgtctcacccctagaaaaaactccccagtcaaggcatatccattccatggatctcgcgtccctgctcctctcccagctgctgctgacttccggtggtaacggttgtctccggcgagaccgccgcgcacccgggctacgcgcacgctgaggaggcatgcagcggtatgctagaggcagaggcggagaaacacggtgtggtgctgcgcggatcgcgcgagagtcgacggcggcgatcgtggactcagcactactacgcgagacatgccggatggagtcatcagagggctccgcgagttctgcagttggcgcggtccatgccgcacgggtcccaaaatcgctttacttcccgggaacccccggttcaatggcgcaactcccgggcccccccatgtttaaccccccccgggaacaacttttttttaaggcctttttttgggaaaccccgggtttttaaaaatttaaaaaaacccccccgaaaacccgcgggggggcccccaaaggggaaaaaacaagggcccggtgttggggttttaaaactctcccccccaaaaaaaaaaaaaaaaacaaccccccccccccccttaaatgtttttttttggggcccccccccccccaaaaaaaaattcttcccccaaaaaagggggtggtttcccccaacaaaggttttttt

SEQ ID NO: 83853 - protein, 99 aa, Zea mays
  misc_feature: Ceres CLONE 1569804
MQRYARGRGGETRCGAARIARESTAAIVDSALLRETCRMESSEGSASSAVGAVHAARVPKSLYFPGTPGSMAQLPGPPMFNPPREQLFFKAFFWETPGF

SEQ ID NO: 83854 - DNA, 983 bp, Zea mays
  misc_feature: Ceres CLONE 1569805
ctccccgcggtggcggccgctctagaactagtggatcccccgggctgcaggaattcgtctcacccctagaaaaaccgtcgtcgtctagctcccatccgacctcctgcattccccactagtcccaactcccaaccaccgccagccgtccgctctccgcaagcgcgaccttccggacagatccgccccgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtggggacgccatcagtgctctgtctggggttcggtctgttctttgcccccacatctggaagggtttcgtgggatccgtcgctacgatctgtcccagtcagagcatctgcatcatctcgggttgggccatggagactctgctcatctcggaggagcgcaaccaccagctccaccacttctcggggtcccgttaagaaggcgtttagctgcgtccccctcagtccacgcgcaagctaccatgcgggggaactgcccgggcggttccactcccggcattcacggggcgggaatccctggccgtccccccgcccgtggaaaaagggtttggccctgtacccggctccctcctcctggagccccaaggacccccgaaaaactttcgggttttcccccgggggggaaaaaaaccgcggccccgaaccatatcctttttgtgaaacctttgttgaggaaagtcccccccccttttttcttgcgcgatagtgaggattttggggggagtggcgcccccgcgtgggtcgttccttgtaaatggcggagtgcacctcgccacacgtgggtgttcgttttgcgacaatgctaaattatgtgatgattggtgttggtgccttctcttataccccatgcaatatgatgg

SEQ ID NO: 83855 - DNA, 887 bp, Zea mays
  misc_feature: Ceres CLONE 1569806
  misc_feature: Encodes the peptide sequence at SEQ ID NO. 83856
  misc_feature (721)..(721): n is a, c, t, g, unknown, or other
  misc_feature (722)..(722): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (863)..(863): n is a, c, t, g, unknown, or other
  misc_feature (864)..(864): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (877)..(877): n is a, c, t, g, unknown, or other
gctccccgcggtggcggccgctctagaactagtggatcccccgggctgcaggaattcgtctcacccctagaaaaacatccccgcacttcaccggcctcctcctcctccccgtccatcggcgtcgccggggcttcctacaacttcaaaatggcggctaccgccaccgccatggctatagcaactatctcccccgccgctccgattccatccgcgcccttcccatcccttcttctccttctcgggctccgtcctcgctctcaaccggctcctcttcgctgcttcccgccgcgatttcgtcatgttccaaagtcgcctccggggacaaatccgccccgaggatggtggagatgcggaggaaacccgtgcccgtgggggaccacgaggacgaagaggaaaaccccccgccccaaaccggggtccctccccccaattccattttccggggggcccccggggggggctaaaacaaaacccccggggttttggaaaacccaagggttattgccccccccaaaaggggtcctttttttcttacaagggaaaagggaaaattttccgccaggaaaaaaattaattacccccggggagccccctgtgtaaaccccccccccccccccccacaggggggggtccctccccccccccacaaacaataagggggggcccccccgtgtttggccccctttttattccccccccccccccccgggaaaacaaaatnntttttatatccccgccaaggggggccccctcaaaacccctgaaaaagaaacttttctccccnnnnnnnnnnnnnnnnnnnnnnnnnnnntnnnnnnnnnntnnnnnnnnnnnnnnnnnnnnngnnnnnnnnnnnnnnnttnntnnnnnnnnnttntttatttggg

SEQ ID NO: 83856 - protein, 150 aa, Zea mays
  misc_feature: Ceres CLONE 1569806
MAATATAMAIATISPAAPIPSAPFPSLLLLLGLRPRSQPAPLRCFPPRFRHVPKSPPGTNPPRGWWRCGGNPCPWGTTRTKRKTPRPKPGSLPPIPFSGGPPGGAKTKPPGFWKTQGLLPPPKGVLFFLQGKRENFPPGKKLITPGEPPV

SEQ ID NO: 83857 - DNA, 975 bp, Zea mays
  misc_feature: Ceres CLONE 1569807
ctcaccgcggtggcggccgctctagaactagtggatcccccgggctgcaggaattcgtctcacccctagaaaaagtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagaacgacggagcggcgccggccagcgaccccacaagctcttgagcctgctgccgtcgccgccatgaagctcccatcatcgggcacctgcacctgatgggggacatcccccacgtgtcccctcgcgcgctcgccaccaggtacggcccgggacctgatggctgttccccctcggggccgtgcccaaccgggggggggcttcttccccccgcgttccccaaaggcgggcccccgcacctaaaaaaaagttttttccctccccgccccgggcttcctggggggcccaaaaaccttcttggggggggcgccccccaaaatttggggttttcggcccctatgggggaaaacccttccccaaagggggggagaaaaatgggtaccccggggaacctttgttaaaaaccaaaaaagggtgcgggccctcccccccccccccccaaaaaaaaaaaaaattcccccccccccctcctccataagggtgggcccctcccccccccccccccccggggggggcgcccctaaaataaaaaaacaatccctccatcccccgtcgttaggaaaatcaccttttttgccccccgcccccctcgcgggtatttttccctcctgggaaggaaggcgccacattggagtttgtgttggaggtcttctcaaagatctgtggatgttgatttgtg

SEQ ID NO: 83858 - DNA, 960 bp, Zea mays
  misc_feature: Ceres CLONE 1569809
  misc_feature: Encodes the peptide sequence at SEQ ID NO. 83859
  misc_feature (380)..(380): n is a, c, t, g, unknown, or other
  misc_feature (382)..(382): n is a, c, t, g, unknown, or other
  misc_feature (386)..(386): n is a, c, t, g, unknown, or other
  misc_feature (389)..(389): n is a, c, t, g, unknown, or other
acccgcggtggcggccgctctagaactagtggatcccccgggctgcaggaattcgtctcacccctagaaaaaacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaccgccccgtaccagggcggcgaggagtacggcncnaacntcnacggatacaccccaatctacaacgaggatgactggtctcccaccgggcaacgtctacttcgggggaaccactggggtttctgatctggggccgtcaccctccctgggatcctcggcgggcggcgcccctcctcctctacaacaccaacccccctccccggctaaagatatcccaagggatggcccttccttgccaattcggcatggaaaaaaccaggggggtcctgtcctaaaatctagccctccgtgggattgccccacccctccccccatggaaacagaaattactgggcgcccccctcctcgagaaaattggggagggcatcaaataaagacccccctcccccccctgttttcttcaagggacttcgttcggccccggcctgcgcgttgccccgtgtggcgctggtgtctagctccccgtgtggcgtaaccccccctggcggcgtgggtggctcgtgggtgtgccctaggggtctactgttcccctgcgctgtatgggtgcctgactgcccctcggccttgcagcgtccctaagcgagcctcctctacggcctactgggttcatcgcc

SEQ ID NO: 83859 - protein, 103 aa, Zea mays
  misc_feature: Ceres CLONE 1569809
  misc_feature (32)..(103): Pfam Name: PsbR Pfam Description: Photosystem II 10 kDa polypeptide PsbR
  misc_feature (74)..(74): Xaa is any aa, unknown, or other
  misc_feature (76)..(76): Xaa is any aa, unknown, or other
  misc_feature (77)..(77): Xaa is any aa, unknown, or other
MAASMISSSALAVAPQGLPPLGRRASSFAVVCSKKKIKTDKPYGIGGGLTVDVDANGRKGKGTAPYQGGEEYGXNXXGYTPIYNEDDWSPTGQRLLRGNHWGF

SEQ ID NO: 83860 - DNA, 897 bp, Zea mays
  misc_feature: Ceres CLONE 1569810
  misc_feature: Translation starting site: 188
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaacctcatcaacaccgtctttgatgccaagcgtctcattggcaggaggtttagtgatgcctctgtccagagtgatattaagctgtggcccttcaaggtcattcctgggcccggtgagaaccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctactttcacgactcacagaggcaggccacgaaggatgctggggtgattgctggcctcaatgtgctgcgtatcatcaatgagcaaaccgctgctgctattgcctatggttctgacaaagaagcaaccagcggccggtgagaaggatgtcctcatctttgaccttggaagtggtacctccgatgtcccctcccttacttttgaggagggttccttgaaggccaagccacagctggggacccccttttgggggtggag

SEQ ID NO: 83861 - DNA, 935 bp, Zea mays
  misc_feature: Ceres CLONE 1569811
  misc_feature: Translation starting site: 218
  misc_feature (935)..(935): n is a, c, t, g, unknown, or other
ctccccgcggtggcggccgctctagaactagtggatcccccgggctgcaggaattcgtctcacccctagaaaagttcgcatcttcgcgcgtggcgcacaccgctccagctctccttcgacgggcacggccgagccgccttcgtcttggccgcagcggtgcgcgctctccatggcgtcctaattagcctagccgcaacgccgcgcccgtgcctgcggcatggatgaaccccttcttggcaatggtcttaagaccagcgggaaaagagagagcctggtagtggccgaggtcagaaaacagatgtaccttgctgggccactcatcgctgcatggatcctacagaacattgtccagatgatatctatcatgtttgtcggtcaccttggtgagcttgccctctccagtgcctccatcgccacctcctttgcaggcgttactggcttcagcttattgtctggcatggcgagcagcttggacacactgtgtgggcaatcgttcggggcaaagcagtactatcttcttggcatctacaagcagaggggcatcctttgtgctcactctagtcagccctgtgggtgcgattattctggcatacacgggacagatccttctactctttggtcaggatccaaaaattgcagctggggaaggaagctattccgggaggatgatcccggccctatttgtgtatggccacatacagggcctggtcgggttctgcaaaccaaaacatagccctccagggatggtgacctcaggggcacagcactgaaccaccgggggggggctggctgctggtgtaaaaattgggatgggcaaaaggggggctgcttggccaaggccttctcaacttttaccaagttccaacccgggaatttacgtcagggtggcccccctgtaaaaacccgggaaggggtctccaaggaggctttcaaan

SEQ ID NO: 83862 - DNA, 936 bp, Zea mays
  misc_feature: Ceres CLONE 1569815
  misc_feature: Translation starting site: 579
  misc_feature: SWISSPROT Homolog: EC 5.1.3.6 UDP-glucuronate 4-epimerase
  misc_feature (405)..(405): n is a, c, t, g, unknown, or other
tggagctccccgcggtggcggccgctctagaactagtggatcccccgggctgcaggaattcgtctcacccctagaaaaaggcaggcgcgcatccagctcctgccttgcttcctctcctcccggttcccgaataaaatttcctggacccggagcgcgcagcgcgctcccccgcctcccaaggaaacttatctaagcattccggcggtcgatccatcttcccgtccagggagagcaaggaataatcaatcaaccggccagtgaaacgttaggaggaggaggagagccggagtccgtccagcgcggcgcgggttgatcccttgcgtctccgcccctgccccgcgccggcgacacctttttgcggtgctagcgttgcgtcgaggagggacaggcgctctgcgtccttcncacggcaacggcaagacggcggcgttgaagatgcgggtgtttgggagaggacctcttccccctcaccccaggcaagggtgagatcgagcgggcgggcgccatgaaccggcagctccaccgctgcttcgcgtccaccagcaccatgtttcctgtgggcgctgttcctcgtcgccatgacggcgtcctacctcagcttccagtccttcgtcgacacctccctcaaagtacttggccgccccccgggggcgccctgcactgggagcggcagatcctgtgctcccccgcgccaaggggggccccccgggtcccccccggggcccgggatgtcggtcttgggaacgggcccgcgggtttgtcggaaccaatggtccttcgggctcccaaagggcgggaaaggggtttttcgggtttaaaatatttaacgcctttaaaaccccttgtttaaaaaaggccccaagggccttcttgcccccccccggggggttctccctgagagggggaataaaagaggggcgtccctggggcaaattt

SEQ ID NO: 83863 - DNA, 974 bp, Zea mays
  misc_feature: Ceres CLONE 1569816
  misc_feature: SWISSPROT Homolog: EC 1.21.3.3 Reticuline oxidase
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (557)..(557): n is a, c, t, g, unknown, or other
  misc_feature (559)..(559): n is a, c, t, g, unknown, or other
  misc_feature (563)..(563): n is a, c, t, g, unknown, or other
  misc_feature (565)..(565): n is a, c, t, g, unknown, or other
  misc_feature (567)..(567): n is a, c, t, g, unknown, or other
  misc_feature (568)..(568): n is a, c, t, g, unknown, or other
  misc_feature (571)..(571): n is a, c, t, g, unknown, or other
  misc_feature (574)..(574): n is a, c, t, g, unknown, or other
  misc_feature (575)..(575): n is a, c, t, g, unknown, or other
  misc_feature (581)..(581): n is a, c, t, g, unknown, or other
  misc_feature (583)..(583): n is a, c, t, g, unknown, or other
  misc_feature (584)..(584): n is a, c, t, g, unknown, or other
  misc_feature (609)..(609): n is a, c, t, g, unknown, or other
  misc_feature (610)..(610): n is a, c, t, g, unknown, or other
  misc_feature (618)..(618): n is a, c, t, g, unknown, or other
  misc_feature (623)..(623): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (650)..(650): n is a, c, t, g, unknown, or other
  misc_feature (653)..(653): n is a, c, t, g, unknown, or other
  misc_feature (654)..(654): n is a, c, t, g, unknown, or other
  misc_feature (665)..(665): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (679)..(679): n is a, c, t, g, unknown, or other
  misc_feature (680)..(680): n is a, c, t, g, unknown, or other
  misc_feature (707)..(707): n is a, c, t, g, unknown, or other
  misc_feature (709)..(709): n is a, c, t, g, unknown, or other
  misc_feature (712)..(712): n is a, c, t, g, unknown, or other
  misc_feature (716)..(716): n is a, c, t, g, unknown, or other
  misc_feature (734)..(734): n is a, c, t, g, unknown, or other
  misc_feature (742)..(742): n is a, c, t, g, unknown, or other
  misc_feature (747)..(747): n is a, c, t, g, unknown, or other
  misc_feature (748)..(748): n is a, c, t, g, unknown, or other
  misc_feature (750)..(750): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (765)..(765): n is a, c, t, g, unknown, or other
  misc_feature (768)..(768): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (788)..(788): n is a, c, t, g, unknown, or other
  misc_feature (794)..(794): n is a, c, t, g, unknown, or other
  misc_feature (795)..(795): n is a, c, t, g, unknown, or other
  misc_feature (813)..(813): n is a, c, t, g, unknown, or other
  misc_feature (820)..(820): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (845)..(845): n is a, c, t, g, unknown, or other
  misc_feature (850)..(850): n is a, c, t, g, unknown, or other
  misc_feature (852)..(852): n is a, c, t, g, unknown, or other
  misc_feature (853)..(853): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (865)..(865): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (876)..(876): n is a, c, t, g, unknown, or other
  misc_feature (877)..(877): n is a, c, t, g, unknown, or other
  misc_feature (898)..(898): n is a, c, t, g, unknown, or other
  misc_feature (903)..(903): n is a, c, t, g, unknown, or other
  misc_feature (904)..(904): n is a, c, t, g, unknown, or other
  misc_feature (954)..(954): n is a, c, t, g, unknown, or other
  misc_feature (970)..(970): n is a, c, t, g, unknown, or other
tggagctccccgcggtggcggccgctctagaactagtggatcccccgggctgcaggaattcgtctcacccctagaaaaaaactaatccacacaagcacacccaagaggcaaggcaagagagtaggtgtaagtgcaagagatgatgagcaagacgaaggcggctgtgcgaccaagatcctggcacctccctttcctcttcctgctgctcctcgcccagacttgttccccgcaggagcaaggcggcggcggcggcgccctccacgggagcttcgtccgctgcgtggcgcgcctctcgccggccaccgccgacacgtccaggctcgtccacgccccgtcggccgcttcgtacccttccctgctgaacgccaccatccagaacctccgcttcgcgtccccgcggacaccgcgcccggcgctgctgctgaccccggcgaccgtcgccgaagctcgggcctgcgtcgcctgctgcatgcgccacggcctcacggtccgcgcccgcagcggcgggcacgactacgagggctctctacgatggggggggggggggggnnnnnttntntttntntnnttnttnntttttntnnttttttttttttttttttttttttnntttttttnttttntttnnnntttttttttttttttttttnttnnttttttttttntttttttnnnnttnnttttttttttttttttttttttttttntnttntttntttttttttttttttttntttttttnttttnntnttttttttnnntttnttnttttgttnnntttttttttntttttnntttttttttttttttttnttttttntttttttnnnttttttttttttttnttttntnntttnnnnnnntnttttnnntttnnttgttgtttggtttttttttnttttnntttttggtttgttttgtttttgtttgtggtggtgtgtgtggggggggttngtttgtggtgttttgngttt

SEQ ID NO: 83864 - DNA, 956 bp, Zea mays
  misc_feature: Ceres CLONE 1569818
  misc_feature: Encodes the peptide sequence at SEQ ID NO. 83865
  misc_feature (682)..(682): n is a, c, t, g, unknown, or other
  misc_feature (864)..(864): n is a, c, t, g, unknown, or other
ctccccgcggtggcggccgctctagaactagtggatcccccgggctgcaggaattcgtctcacccctagaaaaagccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaggaatgttgtcttggatgagtttggaacccccaaagtggtcaatgatggagttaccattgcccgcgctattgagcttgctgatcccatggagaatgctggtgcttccttgattcgtgaagttgctagcaagacgaatgactcggctggtgatggaaccacaactgcctctgttctcgctagggagatcatcaaattgggcatgttgagcattacttcaggggcaaatccagtgtccgttaagaagggcattgataagactgttcagaaatgggtggaggaacttgagaagaaatcnaggccggtcaagggtagtggggatataaaagctgttgctgccatatcagctggaaatgatgaatttgttgggactatgatcgccgaagctttggacaggttgggccctgatggtggcctctcaatgagtccgcatcgtcgtttgaaaccacatttgagttgaagaaagaatggagcttgacngaggattatctcccctcaggttggcactacccttgaaaatcattggtgagttccaaaggcccggatcttgtcctgatccaaaaattcatcga

SEQ ID NO: 83865 - protein, 233 aa, Zea mays
  misc_feature: Ceres CLONE 1569818
MATIPTTDSGLVLSSSALLRRTRRAASSVTARLPAVARRRPQLLVRASAKEIAFDQGSRAALQAGVEKLAAAVGVTLGPRGRNVVLDEFGTPKVVNDGVTIARAIELADPMENAGASLIREVASKTNDSAGDGTTTASVLAREIIKLGMLSITSGANPVSVKKGIDKTVQKWVEELEKKSRPVKGSGDIKAVAAISAGNDEFVGTMIAEALDRLGPDGGLSMSPHRRLKPHLS

SEQ ID NO: 83866 - DNA, 944 bp, Zea mays
  misc_feature: Ceres CLONE 1569819
ctccccgcggtggcggccgctctagaactagtggatcccccgggctgcaggaattcgtctcacccctagaacacccggaccccggtctgcgtttgtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggccccttcgccggcgacgagccgcaccaggcgtacatgtgtacacccagcccaggcccttaactgcgcccgcccctgcgactggttttcctgctggtttctgtggatttggctgccggaggattggtgcagcctttaggatcacggtagattcgctgtgaaatccgaagggtgctcaggtcatgttgggggaccagcgcatgatactgggcttagactcggcaaacctcatcaagcactgcccctgatttgacccgcgctgaagaggatccttctgtgagcaggagctgcgtgatccaccgccctgcagtggggtgggcgcacaagggaggaccggtggagggtctggtgaattgttatagcaagaagaaaacaagaccggcagtggttcgaggaatctgcagccagagcctggtcttcgagatggagggttctgataagggtggaaagtcaacacggggcacctcatcggcgggatcggcaaggaattggccatttcatgcctgctcggtcctccccgggccttactatatgaaggggccatggggttaaccaatctttctacccccttgggggggttggggagctttacacggtttaagccttgaagcttggatcctccaaaaaataattttctggcccaggcaaggtcccaaggggggaagggttttatcccgcccggccaccggg

SEQ ID NO: 83867 - DNA, 975 bp, Zea mays
  misc_feature: Ceres CLONE 1569822
  misc_feature: Encodes the peptide sequence at SEQ ID NO. 83868
tccccgcggtggcggccgctctagaactagtggatcccccgggctgcaggaattcgtctcacccctagaaaaattctccctgcaccgtttcgtcgtctcatttcagcagctactagaagtagtagctggctcgctcctgctgccggtttcttgccgtcttcttcttcaccgacgacggtcgcgcgttcctacaccaggtggtccgaattgttttactagggtgcaacggattcgtatccaggagacgtttgagatcgtccttcagcgcttatcatacatacatcaagcagatcaacaagggcttaattcacaagacaagagaggatgggtttcttctctctatttctggtggcgtctatgccgatcatccaggtcctgctcataggtgtcattggagcttacctggcctctggtttcagcaacgttctgacgacgagtgctcgaagggatatgaacaaggttgtttttactgtgttcaccccatctttgatgttcgccagcctcgcgaagactgtcacccttgcagacgtcatttcttggtggtttatgccagttaacatagcgatcacgttcatgatcggtggcactctgggctggatagcttgcaacatcttgaagcccccgcaacacttttaggggcttgatcatgggcttcctgctcaccaagaaacctcggaaacctgctcctgatcattgtccccggcttgttgccacaaataagggaaccccttttggggatgatttaaagcactggcgccccagcagtctcccctacccgtccttggcccaggggctcgggggggccccttcctttggaacccccccttacgccttgttgccaaattcccgcaaaccgtcccccaagaaggagcccaaaagtttttttggcccccccaacccgcctagggacttttaccaacccaaataatatgggcccgttggctgctctaaaaaaaagccacctttcctaagttt

SEQ ID NO: 83868 - protein, 103 aa, Zea mays
  misc_feature: Ceres CLONE 1569822
MGFFSLFLVASMPIIQVLLIGVIGAYLASGFSNVLTTSARRDMNKVVFTVFTPSLMFASLAKTVTLADVISWWFMPVNIAITFMIGGTLGWIACNILKPPQHF

SEQ ID NO: 83869 - DNA, 968 bp, Zea mays
  misc_feature: Ceres CLONE 1569823
  misc_feature: Encodes the peptide sequence at SEQ ID NO. 83870
  misc_feature (657)..(657): n is a, c, t, g, unknown, or other
tccccgcggtggcggccgctctagaatagtggatcccccgggctgcaggaattcgtctcacccctagaaaaagacccgacctgtcctcgcctcacttcactagagagatcccaacagttcgctgccgtcgcctactcgcctccgccagaccgccgccgcgacactacacaccagcgcccccgcagaaggagcaaggggggagaaggaaagcggcacccgccgcacatacgccgcgcggcggagccatggccgagctgcggcacgccacggcggcggcggcggcgacgcgcgccactggctccccttccaagcgcgacgccgaggccgcgtcctcgcccttggtcgcgtctccccgcgtcggcggcggcaaggacgggctccgcccccaccagaggtggccgctcccgccccccgtccgcgccctcctcgcgtgcgaggaccccaggtcccccaccgcctccgcctcctaccggatcctggtcgcggccatcgcctgcttcgccctcgctgcgctcttctccgcgccttccctctgggcacgcctctacgcgccgtacctgtgccgcaaggaggggattcggctccactgccccagggtcagccagccagactctctgtgggagaatcctcatgcagcagcaacttcttggaagccgngtgctgagcgtcagagacatgagggcccaagacctggtgcaagagaatgaaacttccggggttatatttattccacgctgaggggggattaaaccagcaacgtatagctttagggtatgctggttgcaattggctaagataatgaatgcctacccttattcggcccggggcttaagccgggacccaattggggaaagatccaaaccaaattctcggggacactcttgatagtagacacatttttataaatttatttgaaaggaggaatgggccgctttgtttccggaatatttccgcgaaccggtgttaca

SEQ ID NO: 83870 - protein, 153 aa, Zea mays
  misc_feature: Ceres CLONE 1569823
  misc_feature (138)..(138): Xaa is any aa, unknown, or other
MAELRHATAAAAATRATGSPSKRDAEAASSPLVASPRVGGGKDGLRPHQRWPLPPPVRALLACEDPRSPTASASYRILVAAIACFALAALFSAPSLWARLYAPYLCRKEGIRLHCPRVSQPDSLWENPHAAATSWKPXAERQRHEGPRPGARE

SEQ ID NO: 83871 - DNA, 944 bp, Zea mays
  misc_feature: Ceres CLONE 1569824
  misc_feature: Translation starting site: 246
  misc_feature: SWISSPROT Homolog: EC 6.1.1.3 Threonine--tRNA ligase
  misc_feature (588)..(588): n is a, c, t, g, unknown, or other
  misc_feature (868)..(868): n is a, c, t, g, unknown, or other
tccccgcggtggcggccgctctagaactagtggatcccccgggctgcaggaattcgtctcacccctagaaaaaagaggcgaccggccagcgccatatcccgcgccgccgccgccgccgccaacgcttaatgctagtgttcctccggcgaggcctcttgctcgtccggcagcccaccacccgcgtccttgccaaaccgtctctccgccctgcttgtctcttcgtccaccacttcgccgtcgacacgatgggtgagggttctgctgctggtaaggacgcgaaggggaaggggaaggggaaggggaagaccaaggccgccgccgcggattcggccctggtcgttcgcgacgactcctacctagaggcggtcactcagaagaggattcgcttcttcgaggagatccaggcaaggcaagccgtcgagcggctgaatatcggcggcgaagttatcaaggtaactttgcctgatggcgctatcaaggagggtaagaaatggataacaaccccaatggatattgctaaggaagatatcaagtggatttgcagctagttgtttgatagctcaagtggacgaaacactctgggacatnggggagccactcgaaggtgattgtaaattgcaaatgttcaaagttgataccaatgaaggtcgtgacaccttctggcactcaagtgctcatattcttggagaatctattgagagagcatatggatgcaagctgtgtatgggccctgcacacaaggagggagggtttctactatgaggcttactcaatgatcagacttggatgaagagccttggttatcttgaaaaccagcttaaaggctgttgcgaaaaacaaccgtttaacccattgaggccagcgggcnaaacccttgaaaggtgccggaaaagattccaggtgaaatcttaatgagtgcccgagaaaaacattacggtataggg

SEQ ID NO: 83872 - DNA, 1112 bp, Zea mays
  misc_feature: Ceres CLONE 1569826
  misc_feature: Encodes the peptide sequence at SEQ ID NO. 83873
  misc_feature (838)..(838): n is a, c, t, g, unknown, or other
  misc_feature (931)..(931): n is a, c, t, g, unknown, or other
  misc_feature (1112)..(1112): n is a, c, t, g, unknown, or other
ggcggccgctctagaactagtggatcccccgggctgcaggaattcgtctcacccctagaaaatttaaggttggagaaagatacttcaaggagcttgtgaatagaagcatgatccagccgacagaggacaaaaatgatcggtttgtagaagggttccgtattcacgacattgtgtttgatctcatctgtaagttgtccaaggatgaagacttcattaccattagcgggcaacattcatctcgggatagtttaagaagagagaagaaaacatgtgtgcctcgctcagactgcaagctacgtcggctggccgtccggaatcaacgtgtgcagcgcttctctgtccaccccttcgaggtggggggaggggttgagatcacttaccattatacactccccccctgagggtttggcccccatttgaaactccacgggtttgccctgtgcttgttttgggggaaaacttacctccccctccctccccaaaccctttgggggaagcttgttcctatccaaaatccccccaaaaaaacaaacccccccccttcttttctaagcccctccccgtaaacatttgcgcttcctgaggctctcctttccagactttattttttataccgggccgtggatctataagaccaggcttcccccccccggcttttttttatccctcttttccatggttgtcttatgcggctctatgtactccgctcgggttgttctctaatcatatttctcgttccgtcgcgacgagcgcggcaacgttctacttttcccttcgataggacacccctcccccgccagcttgtacgtaccatctgatccttccgctggcgctgccntacttcttcctgctgtttgatcccattctcggctgtctattgtgtaccttcgcctgcagcactgacactatcttctctcggtttagctggagngatgtcttttactcgtcttcctgatccgcactggcgctgtgttcgtcgcttctgcgtcgactctcgtagagtcgtctgactataactacctgacctctgtgttgtatctccacaccaccgagtccggtgtgtgtgcatacgtgctgctcgtacactcttaggacgtattccgcttcctgcn

SEQ ID NO: 83873 - protein, 97 aa, Zea mays
  misc_feature: Ceres CLONE 1569826
MIQPTEDKNDRFVEGFRIHDIVFDLICKLSKDEDFITISGQHSSRDSLRREKKTCVPRSDCKLRRLAVRNQRVQRFSVHPFEVGGGVEITYHYTLPP

SEQ ID NO: 83874 - DNA, 965 bp, Zea mays
  misc_feature: Ceres CLONE 1569828
  misc_feature: Encodes the peptide sequence at SEQ ID NO. 83875
  misc_feature (698)..(698): n is a, c, t, g, unknown, or other
ctccccgcggtggcggccgctctagaactagtggatcccccgggctgcaggaattcgtctcacccctagaaaaagtccacccattcctccgctcttccttaattcctcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacacgtcggtgcagagtgacgccaagctatggcctttcaaagtgatcccgggctccggcgacaagcccatgatcggggtgcagttcaggggcgaggagaaacagttctcggccgatgagatcagctccatgatcctgaacaagatgaaggagacggccgatgcttacctcgggcacaccatctagaacgctgtcgtcaccgtcccggcctacttcaacgactcccagcgccaggccatcaaggacgccggcgtcatcntcggcctcaacgtcatgcgcatcatctacgaggccaccgccgcggccatcgcatacgggctcgacagtaatcgagcagcgacgccgagtagaacgtcctcatcttcgacctcgggggcgggtacctttgacgtcccgctccctacatcgagggaggcatcttttgaggtaaagccaccgccgggaaacccaaccggggaggcgaggacttcgaaaacgggtcgggaaccacttcgtcaggagttcagaagaaaacaggatgactcca

SEQ ID NO: 83875 - protein, 143 aa, Zea mays
  misc_feature: Ceres CLONE 1569828
MAGKGDGPAIGIDLGTTYSCVGVWQHDRVEIIANDQGNRTTPSYVAFTDSERLVGDAAKNQVAMNPINTVFDAKRLIGRRFSDTSVQSDAKLWPFKVIPGSGDKPMIGVQFRGEEKQFSADEISSMILNKMKETADAYLGHTI

SEQ ID NO: 83876 - DNA, 929 bp, Zea mays
  misc_feature: Ceres CLONE 1569829
  misc_feature: Encodes the peptide sequence at SEQ ID NO. 83877
  misc_feature (549)..(549): n is a, c, t, g, unknown, or other
  misc_feature (586)..(586): n is a, c, t, g, unknown, or other
  misc_feature (589)..(589): n is a, c, t, g, unknown, or other
ctccccgcggtggcggccgctctagaactagtggatcccccgggctgcaggaattcgtctcacccctagaaaaagtccgtcgcctcgcgcggtcgcgcctcacctcgcccctccctccctcctttctgccggccactcccggctcccgagccacagcaattacccagctcagcggctgccgaaccccctccgcttcccggctctccaggtcgagaagggcgctgctcgccacctgcctttctttctacagttcgacgcactttggtggcggtgccgctactctccttcccgagttcctaacttcctaactaggagggcgggcgttgtctgcctgtgtgcttttggcgattcgggggcttgggctcggatctgcgcgtgccttcctccggacccgagcgaggctcgggcgcgaatttggggcggatcagcgcagatctggaggcacatgaggaggaggaggcggaggggtagcgggagcgatgcggtgcttctgcgaagggcttgagccgacctgggaaggtgattctgggagaggtggcggtggctgcngaagcggagggggaggctggatgagggatggaaaacntcntagcagtcgtggcgtcactctccgcggcgccggcgcctgggtttagccccgccgcggcggggctcacgctgatcgccgcgccggtcgcggacccgatcgccgcgtgggcctccggaccatggagggggtctccctgcccgtgactgtgcccccgggcaagaacggctcccgcgggggacaacaaccccctgcccccggaatagaaaaggggaaaaccccttttggcgggagcccgggctcgggggcaccaatggtacaccggggccacccttattccaggggggcgggttggtttctccggggggaaaagggcggagaggggccctgggggtgagaggaa

SEQ ID NO: 83877 - protein, 51 aa, Zea mays
  misc_feature: Ceres CLONE 1569829
  misc_feature (4)..(4): Xaa is any aa, unknown, or other
  misc_feature (5)..(5): Xaa is any aa, unknown, or other
MENXXAVVASLSAAPAPGFSPAAAGLTLIAAPVADPIAAWASGPWRGSPCP

SEQ ID NO: 83878 - DNA, 935 bp, Zea mays
  misc_feature: Ceres CLONE 1569831
  misc_feature: Encodes the peptide sequence at SEQ ID NO. 83879
  misc_feature (578)..(578): n is a, c, t, g, unknown, or other
ctccccgcggtggcggccgctctagaactagtggatcccccgggctgcaggaattcgtctcacccctagaaaaaatcaggcatccaagaagctcaaagcaagcagatctaagttccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgaagctcatggatttctcccgttctctctagaagcacttgacgcctagcctcgacgccnagggtttgggccggccgagatagcttccactggcgaaggttttggaaagggatgcttagggtttcgtgaccaccgacgacgctcttctcatcgacctccggcgacatttacgactgcatcaggtcccgtcttcgcttagtgtgcgatttctccatcgttttctccctctttgtgctctctgatgccgtggccactgttttctatgccatcagcatcgctgggctctgactcatgcggattgcctttgcgaactgcatctgggcgcgggggtatcttctggcataagcttcgtcgtagccgccaaaaaacacgtcgcgtccctttgtaaagaccgaataccgccgcccgacgggtata

SEQ ID NO: 83879 - protein, 63 aa, Zea mays; identical to SEQ ID NO: 28299
  misc_feature: Ceres CLONE 1569831

SEQ ID NO: 83880 - DNA, 930 bp, Zea mays
  misc_feature: Ceres CLONE 1569832
  misc_feature: Encodes the peptide sequence at SEQ ID NO. 83881
  misc_feature (660)..(660): n is a, c, t, g, unknown, or other
  misc_feature (910)..(910): n is a, c, t, g, unknown, or other
  misc_feature (916)..(916): n is a, c, t, g, unknown, or other
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgctttctcccctactgcggcagctgcaagtacccggcgaagacttcttncacgacgtcgggctcggcggcatcggctacgaggtcacccgctacctctacgcacctgcaacgacctcaagttccccacttcggcatcagacggccgcaacgccagatgtggagcgagtcggcacgtcatcgggtacgtggcgtgtcaccgacaaggagacgggcggctcggcgccggacatcccgtggcgtgcgcgcacatcaccggcctgagtgggtggcgatttgacgcaccgatcccctgcggaanggggtnctggccgacccgaa

SEQ ID NO: 83881 - protein, 213 aa, Zea mays
  misc_feature: Ceres CLONE 1569832
  misc_feature (138)..(138): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFLPYCGSCKYPAKTSXTTSGSAASATRSPATSTHLQRPQVPHFGIRRPQRQMWSESARHRVRGVSPTRRRAARRRTSRGVRAHHRPEWVAI

SEQ ID NO: 83882 - DNA, 905 bp, Zea mays
  misc_feature: Ceres CLONE 1569833
  misc_feature: Encodes the peptide sequence at SEQ ID NO. 83883
  misc_feature (627)..(627): n is a, c, t, g, unknown, or other
  misc_feature (749)..(749): n is a, c, t, g, unknown, or other
  misc_feature (755)..(755): n is a, c, t, g, unknown, or other
acccgcggtggcggccgctctagaactagtggatcccccgggctgcaggaattcgtctcacccctagaaaagattcgcgcggccgtgtcttgctcgcgcctgcccccttccttccttgtcgtgccagcgcccagatctctcgctcgccggcgctcgggccagatctgggtgggggctcggaggcggagccgggcgcaggtttggtttgacccaaggggcgaggaggagagggaagaagaccccggacgccatggagctggcggttggcggcgggatgcggcggtcggcgtcgcacacctcgctgtcggagtcggatgactttgagctcacgcggctgctcagtaagccgcggatcaacgtcgagcgccagcgctccttcgacgaccactctctcagcgacgtctcgcactccggcggatacggcaggggtggcttcgacggcatgtactcgcctgggggcggcctgcgctccctcgtcggcacgccggcctcctccgcgctgcactccttcgagccccaccctatcgtcggcgacgcctgggaggcgctccgccgctccctcgtcttctttcgcggccagccccttggcaccgttgcccgcgtcgaccacgcgtccgaagaagtccntcactacgaccaagtgtttgtgaggggattcgtgccgagtgcactggcgtttctgatgaatggcgagccagatattgtcaagaacttcctctcagaccctgctgctgcagggctgggagaanaaagtnaccggttcaagcttggggagggagcatgccggctagcttcaggtgatgcatgacccccagaaggggtcgagaccctactgctgattttggaagagcccattgggagggtggaccggtgattcggggtccgggggattaacccccccggcc

SEQ ID NO: 83883 - protein, 185 aa, Zea mays
  misc_feature: Ceres CLONE 1569833
  misc_feature (126)..(126): Xaa is any aa, unknown, or other
  misc_feature (167)..(167): Xaa is any aa, unknown, or other
  misc_feature (169)..(169): Xaa is any aa, unknown, or other
MELAVGGGMRRSASHTSLSESDDFELTRLLSKPRINVERQRSFDDHSLSDVSHSGGYGRGGFDGMYSPGGGLRSLVGTPASSALHSFEPHPIVGDAWEALRRSLVFFRGQPLGTVARVDHASEEVXHYDQVFVRGFVPSALAFLMNGEPDIVKNFLSDPAAAGLGEXSXRFKLGEGACRLASGDA

SEQ ID NO: 83884 - DNA, 723 bp, Zea mays
  misc_feature: Ceres CLONE 1569836
cccgcggtggcggccgctctagaatagtggatcccccgggctgcaggaattcgtctcacccctagaaaaaatctatccatcaccaccacctcctcctccttcccacgactcccgagcgctttctccgcctgcgtgtggcgtgcagcatggcgactgcgaacgggagcagcaaggggccgttcgaggtgcccaaggtggaggtcaggttcaccaagctcttctcgacggcagtcgtcgacgcgtctcggcaagacgtcgagaccgggacctcgcacgcgagtgatcgcagcatccggaaggagcaagccgacgtcgactcgcgtcaagccgccgggaggcctcgacaacggcccctggcccaagatgaccggaaccaagcgtggtccgaatcctcccaaagtttccccggaacctgatccaaccaaaaccctgtggaaaaaaaattgggggggcccccttgaaaaacagggtgggaaaccccccggaaaaattttttttcccccctgggggaaaaaagggcccgggaaaaaattcccggggggggccccccgcccccaccggtggggggggctaaaaaaaacccgcggggggcccccccccaaaaaaaagttgttaagggggggcgccacaaccctttctaaaataaggtgcccccccccgaaaaatatcccgggggtataccacccccccccaaaaaaaaaccccccccgggggggggtgtgt

SEQ ID NO: 83885 - DNA, 984 bp, Zea mays
  misc_feature: Ceres CLONE 1569840
  misc_feature: Encodes the peptide sequence at SEQ ID NO. 83886
  misc_feature (699)..(699): n is a, c, t, g, unknown, or other
  misc_feature (724)..(724): n is a, c, t, g, unknown, or other
  misc_feature (907)..(907): n is a, c, t, g, unknown, or other
  misc_feature (939)..(939): n is a, c, t, g, unknown, or other
ctccccgcggtggcggccgctctagaactagtggatcccccgggctgcaggaattcgtctcacccctagaaaaagttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttttgatcaagctcttgcctcaggaaagatttatgatggagatgggttcaactacatcaaagaatcttttgaaaatggtactcttcaccttattgggttgttgagtgaatggtggtgtccactcccgccttgaccaactgcagttacttctgaaaggtgtcagtgagagaggagcaaaaaaaattcgtgtgcacatccttaccgatggggcgtgacgttttggatggcagcagtgttggtttcgtggagacctagangatgatcttttgggagctcgagcangggtattgatgcacagattgcttctgggtggtggaaagatgtatgttaccatggaccgttatgagatgaccggggatgtggttaaacgtggctgggatgctcaggtgctcgggaaaacaccctacaattcaaaagtgcacttgaggctgtgaaacactgaaagcacagccaatggctatgacnatacttgcccccttttgtgatagtgatgaaancgcaaaactggtgggcctgtattaaatggggagcattggtccttt

SEQ ID NO: 83886 - protein, 130 aa, Zea mays
  misc_feature: Ceres CLONE 1569840
  misc_feature (15)..(129): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLLIKLLPQERFMMEMGSTTSKNLLKMVLFTLLGC

SEQ ID NO: 83887 - DNA, 943 bp, Zea mays
  misc_feature: Ceres CLONE 1569841
  misc_feature: Encodes the peptide sequence at SEQ ID NO. 83888
  misc_feature (587)..(587): n is a, c, t, g, unknown, or other
  misc_feature (593)..(593): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (932)..(932): n is a, c, t, g, unknown, or other
  misc_feature (933)..(933): n is a, c, t, g, unknown, or other
ggagctccccgcggtggcggccgctctagaactagtggatcccccgggctgcaggaattcgtctcacccctagaaaaaactccagaagtccagaccaaagctctaaagtccaatccctcgctagccacttgccatctgatcaaccagccagccgatctcagcgatccgccatggccaccgcgtattacgagaggccccgtggcggcgccgtcgaggaggcggacgacttcgatgagttcgaccccacgccgtacggcggtgggtacgacctcgccgtcaccttcggtcgcccgctgccaccgtccgaggaaacctgctacccgtgctcggcgccctcgacctcctacgacgcaccgcactacgccgcctccgagccgtccccctacggtcaccacgccaagccaaagcccaactatgggttccgcccccagcaggagcaacagccgtcttacggcagcggctacggatccaggcccgagcccgctgcggaggagggcggtggctatggatctggcttcggatccgggtatgggaggaagaagcaggaggaggagagctacggctctggatatggggagaaaccgcangcggangagagctacgggtcccggcggtacggctctggctacggcggtcagacccggccgggagagagctatgggtcaacagggtatggatctgcccatcggcaagctgagacatacggctctggctacgggagggaagccacaggtagagaaaactacggatcggaagtaggggtctggggtcggggaagaagccgcatattgaggaaagctttgggatcggggtacgggaaggacccccaggttgaggaaagcctaggattcggttacgggaggaagccccaggtgaaggaaacctttggactggggacggccacagccccaagtgggagattataccnnntnnggggggtggg

SEQ ID NO: 83888 - protein, 257 aa, Zea mays
  misc_feature: Ceres CLONE 1569841
  misc_feature (139)..(139): Xaa is any aa, unknown, or other
  misc_feature (141)..(141): Xaa is any aa, unknown, or other
  misc_feature (253)..(253): Xaa is any aa, unknown, or other
  misc_feature (254)..(254): Xaa is any aa, unknown, or other
  misc_feature (255)..(255): Xaa is any aa, unknown, or other
MATAYYERPRGGAVEEADDFDEFDPTPYGGGYDLAVTFGRPLPPSEETCYPCSAPSTSYDAPHYAASEPSPYGHHAKPKPNYGFRPQQEQQPSYGSGYGSRPEPAAEEGGGYGSGFGSGYGRKKQEEESYGSGYGEKPXAXESYGSRRYGSGYGGQTRPGESYGSTGYGSAHRQAETYGSGYGREATGRENYGSEVGVWGRGRSRILRKALGSGYGKDPQVEESLGFGYGRKPQVKETFGLGTATAPSGRLYXXXGV

SEQ ID NO: 83889 - DNA, 945 bp, Zea mays
  misc_feature: Ceres CLONE 1569842
  misc_feature: Encodes the peptide sequence at SEQ ID NO. 83890
ctccccgcggtggcggccgctctagaactagtggatcccccgggctgcaggaattcgtctcacccctagaaaaagctcctgcctcgcctcaccaccattagagcgcgcgcgccaagctcgtggtgaggttttcgagatgaaggttatcgagaagatcctggaggcggcgggggatggccggacggcgttctcgttcgagtacttccctccttctgcgacatcacctggggcgccgggggatccaccgctgaccttaccctcgaaatcgccaaccgtatgcagaacatggtgtgtgtggaaaccatgatgcacctgacatgtacaaacatgccagtagagaagattgaccatgccttggaaaccatcaaatccaatgggattcaaaatgttttggccctcagaggggatcctccacatgggcaagacaaatttgtgcaagttgaaggcggatttgcttgtgctcttgatttggtgcagcatattagagccaagtacggtgattattttggcataactgtagctgggtatccagaggcacaccctgatgcgatacaaggtgagggaggtgctacattggaagcatatagcaatgatcttgcgtactttgaagaaaaaggtgatgctggtgctgaccttattgttacacaacttttctatgataccgacatctttcccaagtttgtgattgactgccgcccaaatttggattacttgtccccttggttcctgggattatgccattaaataactccaaaggtttcctggcccttgaaaggtttctgcaaaaactaaaataccttcggagaacccggctggccctaatcccttcaaagaaatggggggggctgttaaaaatttgggaccccccctggaaccgagatgggcacaaaaattcctggccccggggttaagaactttgcccctttaccccataaaatgggaaaa

SEQ ID NO: 83890 - protein, 155 aa, Zea mays
  misc_feature: Ceres CLONE 1569842
  misc_feature (1)..(156): Pfam Name: MTHFR Pfam Description: Methylenetetrahydrofolate reductase
  misc_feature: SWISSPROT Homolog: EC 1.5.1.20 Methylenetetrahydrofolate reductase (NAD(P)H)
MQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYSNDLAYFEEKGDAGADLIVTQLFYDTDIFPKFVIDCRPNLDYLSPWFLGLCH

SEQ ID NO: 83891 - DNA, 931 bp, Zea mays
  misc_feature: Ceres CLONE 1569847
  misc_feature: Encodes the peptide sequence at SEQ ID NO. 83892
ctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaagtgctggagaagtggggtgcgcgtggacttcaaggagcccgtgtggttcaagcctgcgcgcagatcctctcgggaggcgggctggactacctgggcaccccaacctggtgcacgcgcagagcatcctggccgtgctcggcttccagtcatcctcaggggcctcgtcgaaggcttcgcatcaacgcctcgacggggtcggggagggcacaacctctaccccggcggcagtactttgacccgttgggcctcgccgacaaacccgtcaccttccccgagctcaaaggtcaaggaaaaaaggaagtgtcccccccccccctccccccatttcggcttttctttcaggcattgttcccgggaaggggcccctgagaaacgggttaaacacctggaaaccccgtcgcaaaaaggctgggg

SEQ ID NO: 83892 - protein, 243 aa, Zea mays
  misc_feature: Ceres CLONE 1569847
  misc_feature (69)..(237): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAGLSADPEAFARNRALEVIHGRWAMLGALGCITPEVLEKWGARGLQGARVVQACAQILSGGGLDYLGTPTWCTRRASWPCSASSHPQGPRRRLRINASTGSGRAQPLPRRQYFDPLGLADKPVTFPELKGQGKKEVSPPPLPPFRLFFQALFPGRGP

SEQ ID NO: 83893 - DNA, 877 bp, Zea mays
  misc_feature: Ceres CLONE 1569849
  misc_feature: Translation starting site: 287
  misc_feature (395)..(395): n is a, c, t, g, unknown, or other
ctccccgcggtggcggccgctctagaactagtggatcccccgggctgcaggaattcgtctcacccctagaaaaactcgcctcgccgtcgccgtcgtcatctcagctttaattcgcagcaggcgggcagtggcaggccaggccacggcgtccagcaccagctacgcctgtgcgcgcgcttgtgcagtacctacgttggtgggtgggtaggtagctagtgcggcggagcatcgatcgcgcggtactctcagttccatccgtcgagagatcgaccggtcgtcgatcgacatggcgggccggggaggagcctcggcggaggcgccgttgctggagaagacagcggcggcggcggagtcgggcggcgggtgctgctacgtggacgggtgccccgggtgcnccctggaccggcacaaggcagcgaacccggggcttccctacggcaacttcatctacgtctggatcgtcaccctctgcacagccttaccgatatcgtcgctcttccccttcttgtattcatgataagagacctgaatgtcgctaaaagaacgaagacatcgggttctacgctggttttgtaggtgcctcattcatgtttgggagatgcttgacttcaaccagtatggggcatagcggcagaccgcgtttgggaagaaacctggttgtcgtgttcggcattttcctctgtagtgggttccacccattgttttggcctgagggtcacctacggaatggcattacctacccgggttcggctgggggccctgaaaggtttgcttggaccaaaaaaggctttatccattaaatttccccaactgaaaatgaaaccctagccttatccttgttaaccaaaatatggggaaaagggcccttttttggccc

SEQ ID NO: 83894 - DNA, 1024 bp, Zea mays
  misc_feature: Ceres CLONE 1569850
  misc_feature: Encodes the peptide sequence at SEQ ID NO. 83895
  misc_feature (981)..(981): n is a, c, t, g, unknown, or other
  misc_feature (1007)..(1007): n is a, c, t, g, unknown, or other
  misc_feature (1024)..(1024): n is a, c, t, g, unknown, or other
gagctccccgcggtggcggccgctctagaactagtggatcccccgggctgcaggaattcgtctcacccctagaaaaaactccagaagtccagaccaaagctctaaagtccaatccctcgctagccacttgccatctgatcaaccagccagccgatctcagcgatccgccatggccaccgcgtattacgagaggccccgtggcggcgccgtcgaggaggcggacgacttcgatgagttcgaccccacgccgtacggcggtgggtacgacctcgccgtcaccttcggtcgcccgctgccaccgtccgaggaaacctgctacccgtgctcggcgccctcgacctcctacgacgcaccgcactacgccgcctccgagccgtccccctacggtcaccacgccaagccaaaccccaactatgggttccgcccccagcaggagcaacagccgtcctacggcagcggctacggatccagggcccacccccctgccgaggagggcggtggctatggatccgggcttcggaccggggttggggaggaaaaaagcggggggagggagacctccggctccgggaaatgggagggaaaccgccggccgaaggaaaaacttccggggcccgggggggaacagggctctggggttacggggggggaaaaaccccggccgggaaggaaaatactttgggggcccccccgggggcatgggagtttgcgcccatctcccgagggggggaaaaaaatacgggtctgtggtgtttggggaggaaaaccccaccgtggaaggggaaagtctcccgcccccggcgttttgggccgggcttccgcggaacacacccccactgttggggcaaattctgttttcggggctcctagcagcctcccccgggtatgaaaaaaattttggattctgtcgcgcgagaaacacccttagggggagggagctgtgttttcgcttggcccctacgctggggcgggggaaaatcncgggggcgtggggggcgcggtggccnaatggttgtggtgttgn

SEQ ID NO: 83895 - protein, 239 aa, Zea mays
  misc_feature: Ceres CLONE 1569850
MATAYYERPRGGAVEEADDFDEFDPTPYGGGYDLAVTFGRPLPPSEETCYPCSAPSTSYDAPHYAASEPSPYGHHAKPNPNYGFRPQQEQQPSYGSGYGSRAHPPAEEGGGYGSGLRTGVGEEKSGGRETSGSGKWEGNRRPKEKLPGPGGEQGSGVTGGEKPRPGRKILWGPPRGHGSLRPSPEGGKKIRVCGVWGGKPHRGRGKSPAPGVLGRASAEHTPTVGANSVFGAPSSLPRV

SEQ ID NO: 83896 - DNA, 976 bp, Zea mays
  misc_feature: Ceres CLONE 1569851
  misc_feature: Encodes the peptide sequence at SEQ ID NO. 83897
  misc_feature (355)..(355): n is a, c, t, g, unknown, or other
ctctccgcggtggcggccgctctagaactagtggatcccccgggctgcaggaattcgtctcacccctagaaaaatcgtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcancccctcccgaccacgtcgctctacgtgggcgacctggagggggccgtctcggactcgcagctgtacgaactcttcagccaggcggggcaggtggtgtcggtgcgcgtctgcagggatgttacctcgggccgctggctcgggatacggcctacgtcaacttcaggaatcccttgggatgctgcgaaagcattgggaagtggctaaacttttgcgggctcttaacaacaagcctatcccggggggatgtttttcaaaccgggggtccaaggagagcgcgcggggatgggaatctgccaaactttttccataaagaaatcctggaccaggagcgttggcccatgataacccctttcaggggaaccttttttctcgcttgggggacccttttctcccaatgtaaggggaagcccgtgggagaaaacagggcccatcccaagggggtgtggttttttttcccgttgggacaaaaaaaaaagcggggccggaagccttatatataaggctttggcggggggtggttttaaaatgagaaaacccgtgtttgttgggggaacctttgtgtcgggaagagaaaaagaagtttttttttttgacacaataaatataagaaataggcttggg

SEQ ID NO: 83897 - protein, 96 aa, Zea mays
  misc_feature: Ceres CLONE 1569851
  misc_feature (29)..(29): Xaa is any aa, unknown, or other
MSAQVAVVPNGGPGAVPAVVSPGAVGVAXPLPTTSLYVGDLEGAVSDSQLYELFSQAGQVVSVRVCRDVTSGRWLGIRPTSTSGIPWDAAKALGSG

SEQ ID NO: 83898 - DNA, 941 bp, Zea mays
  misc_feature: Ceres CLONE 1569852
  misc_feature (246)..(246): n is a, c, t, g, unknown, or other
  misc_feature (249)..(249): n is a, c, t, g, unknown, or other
  misc_feature (255)..(255): n is a, c, t, g, unknown, or other
  misc_feature (258)..(258): n is a, c, t, g, unknown, or other
  misc_feature (268)..(268): n is a, c, t, g, unknown, or other
  misc_feature (277)..(277): n is a, c, t, g, unknown, or other
  misc_feature (283)..(283): n is a, c, t, g, unknown, or other
  misc_feature (316)..(316): n is a, c, t, g, unknown, or other
  misc_feature (348)..(348): n is a, c, t, g, unknown, or other
  misc_feature (387)..(387): n is a, c, t, g, unknown, or other
  misc_feature (773)..(773): n is a, c, t, g, unknown, or other
tccccgcggtggcggccgctctagactagtggatcccccgggctgcaggattcgtctcacccctagaaaaatctcttctggaaccgtccctcgctcgtcatctttccgccttcgctacgcaattcctgtccacgctgtcgggccagttgtgacgacctgcgaagcttcgtcagagaaagaagagaggccggcaggcgggcggcgatcggagatggcgccagagaatcccggaaggagcaggaggangtnagaganganttgatgctgnaggatggangcatcnaggagagcccgcgccgcagcttcgatgactgcngtgattccgacgtagatgacgatgacggtgancacgatgatgagcgggacggcgtacggcgtcggttcccngcgctccctccagtccccacaagtgggcgccagaacttccggaaaaacaactgatcctttccacattccctggctcaccccaacctttgggtaccttggggccccttctaacaacaaaataccccccccccccaacccttgggcctatacggtccgggggtttccgaaccctaaaattttccccctttttttgccggaaaaggggcttaacaggaaaaacaaatatttttttgtaaaaaaccccccggcgcaaaaaaccccctggggtccaaaaaaaaaaagagaagaggggggggctccctttttttttttgcacccccccgggggggaaaccccccccttttccccaggggggggggatgggggggccccaaaaaagcgccccnagggggggataatttgtccccccggggggggtgtggggcccttttttccccccccctttttatatttttttagaaggggggtgggtggcgacgccccccccccctccaaaaaaattttttttgcacaattttttttttgtgtttaataggggggattcttctaaaaat

SEQ ID NO: 83899 - DNA, 918 bp, Zea mays
  misc_feature: Ceres CLONE 1569853
  misc_feature: Encodes the peptide sequence at SEQ ID NO. 83900
  misc_feature (469)..(469): n is a, c, t, g, unknown, or other
  misc_feature (576)..(576): n is a, c, t, g, unknown, or other
  misc_feature (584)..(584): n is a, c, t, g, unknown, or other
  misc_feature (619)..(619): n is a, c, t, g, unknown, or other
ctccccgcggtggcggccgctctagaactagtggatcccccgggctgcaggaattcgtctcacccctagaaaaagcgacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagttaagcgaagcaaggttgagataatcaaggaaaagagcaacttcctccggtaccctttgaacgaggagttggtctcagagggcccaaatatcaacgagagtgctngtcagctgatcaagtttcatgggagctaccagcaaactgaccgagatgtccgtgggcagaagaattactcgtttatgctccgggacaagaacccttgtgggatagtnccaaaccnactttatttagctatggatacactagctgatgagnttggcatcggaacactccgcctgacgaccagcagacattccagttgcacgggggtctaagaagaaactggagactgttctaagcactgtcataaagatatgggctcaccatgggtgcctggtgggatctcaacagaatgtacttgctcctgcaccgcttttggaaaaaagaatccttttgctcacaaaagcagagacattgcagccctccctaacccaagccgggctattagaacctggggtggagggcaaaaaaaatgcccctaagagccccggagggaacaagccccaataaacccc

SEQ ID NO: 83900 - protein, 165 aa, Zea mays
  misc_feature: Ceres CLONE 1569853
  misc_feature: SWISSPROT Homolog: EC 1.8.7.1 Sulfite reductase (ferredoxin)
  misc_feature (97)..(97): Xaa is any aa, unknown, or other
  misc_feature (135)..(135): Xaa is any aa, unknown, or other
  misc_feature (147)..(147): Xaa is any aa, unknown, or other
MSGAIGGAEVHGFRGAAAQLPRSRVLGRPIRVAPPAAARPGGASAGSIRAVSAPAKKDASEVKRSKVEIIKEKSNFLRYPLNEELVSEGPNINESAXQLIKFHGSYQQTDRDVRGQKNYSFMLRDKNPCGIVPNXLYLAMDTLADEXGIGTLRLTTSRHSSCTGV

SEQ ID NO: 83901 - DNA, 944 bp, Zea mays
  misc_feature: Ceres CLONE 1569854
  misc_feature (578)..(578): n is a, c, t, g, unknown, or other
ctccccgcggtggcggccgctctagaactagtggatcccccgggctgcaggaattcgtctcacccctagaaaaatcattaaaaaaggacacggaaacttaatccgatccaccaaacaaaaatccctgtctctcgcgcagggcaccgccacgcgcgcctcatccggtaccgccatgacgtgcgccagcacctgcacaccgtgagaatccgtcgccccagtctccctcccgcttgattattgtcgtatcagttgtgttgtggctggatcggagaatcaccggcgctggcttatcaattcgtggacactattaggattaggctcgcgcggaattcaatgatgaatggaaatgccgattttatgatcatggttacatagctcgggaaatgggtaccgatagggattacgcacttgcatttgttaccggggttgaacctgtgtattttttttgccaacatactgggggttaaactttcacgttctaattggtgaaatactggaatgtatcggatttgtaatcctatctgagattctgaaccaagcttcataatcccacaggcactggactacccatgtgcacnaagagtgaaacgacaaacgagccttggtcattatagtagcagtgatcgagcttggcatcatgtagtcctgacggctttgtgcgattgtagccctcccgcagtgaaatttcgtagatgacgcaagttccgtgctagttctggtctggggaatatattttgcgggaaacattattccaagttttcctaaggcatgttttaatgttccaacactaaaattagctaaaaacatcaacaatctagctaatagtagctaaccattggttaactagcaaatggtactacaatttttagaccactaattatggggcccgactatttggcagcggttaatttgggaagccccagccatacttttgatcccgtaaa

SEQ ID NO: 83902 - DNA, 941 bp, Zea mays
  misc_feature: Ceres CLONE 1569855
  misc_feature: Translation starting site: 307
  misc_feature (514)..(514): n is a, c, t, g, unknown, or other
acccgcggtggcggccgctctagaactagtggatcccccgggctgcaggaattcgtctcacccctagaaaaatcgtcctcctcttcgcattagcgcggccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccnacaacgtcaccaactggcaaggggacgtgctacatcacgccgctcatcggcgccttcttcgccgacgcgtacatggggaagttctgggacatcgccatcttcatgatcatctacattttcggcctggcgctgctgacgatggctccgtcggtgaaggggctggggctacgtcctgcggggacaggatgtgtgccacccgacggacccccaggggcggtggtgtttcgtggcgctgtacctcctccccctgggcacggcgggattaagccgtgcgttgtcctcttccggcccgaacattttgacaaaaacgacaaaggggagaaaaaaaccagacctcctcttcaacgggttttacttttcaataaaatggggcgccggtggggtcccactggttggggttccttcaaacccactgggcttggggcgg

SEQ ID NO: 83903 - DNA, 948 bp, Zea mays
  misc_feature: Ceres CLONE 1569856
  misc_feature: Translation starting site: 152
  misc_feature: SWISSPROT Homolog: EC 2.5.1.46 Deoxyhypusine synthase
  misc_feature (672)..(672): n is a, c, t, g, unknown, or other
  misc_feature (827)..(827): n is a, c, t, g, unknown, or other
ctccccgcggtggcggccgctctagaactagtggatcccccgggctgcaggaattcgtctcacccctagaaaaagaagcgaaagcgaggctgctgtctcacggctgcggctgcggctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccgtcggactcgaggggctgctcgcctcgctcgcgtccaccgggttccaggcatccaacctcggcgacgccatcgacgtcgtcaaccagatgactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagagggagatctcattaaatgctttgcaccaacttacagaggcgatttttctttacctggagcactgctgcggtcaaaaggactgaaccgggataggaatctngtgggtgccaatgacaactattgcaagtttgagaactggatcatgccactcttcgaccagatgctacaggagcaatctactgaggtaagcatacctgctgggtcaaagctatcaaattatttctctggctgaaacaatgtacttgctaccatggncttcatttggcgtatgcagtgctattcaatactacagggaatatgttttttttgcaatcggaaatgtttctttagagggattaaattttccggcggcggggaccaatagccaaaagaagct

SEQ ID NO: 83904 - DNA, 877 bp, Zea mays
  misc_feature: Ceres CLONE 1569857
  misc_feature: Encodes the peptide sequence at SEQ ID NO. 83905
  misc_feature (606)..(606): n is a, c, t, g, unknown, or other
  misc_feature (657)..(657): n is a, c, t, g, unknown, or other
ctccccgcggtggcggccgctctagaactagtggatcccccgggctgcaggaattcgtctcacccctagaaaaatcgcaaccctgcactgcgtgcgctccatgtgactctcacttatttctcctgtcagcgcagcagcagcagcagcagcctactactactactactgcttttaccggccggtggatcggatcaccaaaccggaacgacagcgatggaggccgggacgtgggcggcggcggccgtggcggccgtggcgctgtacgtggcctggttctggcggatgtcgcgcgggctcagcgggccgcgggtgtggccgctgctcggcagcctgccggggctcgtgcagcacgccgaagacatgcacgagtggatcgccgccaacctgcgccgcgcggggggcacgtaccagacctgcatcttcgccgtgcccggggtggcgcgccgtggcggcctggtcaccgtcacgtgcgacccccggaacctggagcacgtcctcaaggcgcgcttcgacaactacccccagggccccttctggcacgccgtcttcagggacctgctcggggacggcatctttcactccgacggcgacacctgggtggcgcancgcaagacggccgcgctcgagttaaacaggggacgcttcgaacggcatgtngggctggggttcccgctcatccacgccccgctgctgcctatctcgccgagcgcacgtcgtcgaactgaagaacctctgctccgcctaccttcaaaaatctgcggcctcgcttcgggaagaccccaaacctccccggggctccccaaaagccttgcctccggtttaccggccaggaaggcacctaacgcttattttcccaatggttggcctcaaaaagggt

SEQ ID NO: 83905 - protein, 221 aa, Zea mays
  misc_feature: Ceres CLONE 1569857
  misc_feature (131)..(131): Xaa is any aa, unknown, or other
MEAGTWAAAAVAAVALYVAWFWRMSRGLSGPRVWPLLGSLPGLVQHAEDMHEWIAANLRRAGGTYQTCIFAVPGVARRGGLVTVTCDPRNLEHVLKARFDNYPQGPFWHAVFRDLLGDGIFHSDGDTWVAXRKTAALELNRGRFERHVGLGFPLIHAPLLPISPSARRRTEEPLLRLPSKICGLASGRPQTSPGLPKSLASGLPARKAPNAYFPNGWPQKG

SEQ ID NO: 83906 - DNA, 772 bp, Zea mays
  misc_feature: Ceres CLONE 1569858
  misc_feature: Encodes the peptide sequence at SEQ ID NO. 83907
ctccccgcggtggcggccgctctagaactagtggatcccccgggctgcaggaattcgtctcacccctagaaaaagctcgtgccgttgcgctgcggcaaagcctcccccccacacctctctcctccatccgccgcccccgcgggaccgaaaccctagctagggttctgcccgccgccgccgccgccgccttcgatcctgacgcggccaggcttcccgcaacaccgccatggacacggggcgcaagcggaccgcaccggagggcgccaactgcgcgggcgaccccaagcgcgcgagagaatcggagacaactggtgtaggaagcaaatcccaagccgtgcaccaaattttttcagggtctaaatctagctttaaaatgaacagtcatccgggtaaacatctacctatccgttattatgcccccttcttttttttaaatttaaaaatttggtaatggttacctaaaagggcgggggccttggaagccaaaacaaagggggttggggcctaaaattcccggcccccaggagagggggttttacccaaaaccctgggggcctaaaaaaacccccccccggggggggagaaaaaaatgggggaaaacccccccggggggggttttttacccccgggggggaaaaaaagtgggggggggcacacacgggggggaaacccccccccccggggcggttttttttttctcccccccgggggggggaaaaaaaccccgcggggtgggggcccaaaagagggggggggagagaccctccctccg

SEQ ID NO: 83907 - protein, 74 aa, Zea mays
  misc_feature: Ceres CLONE 1569858
MDTGRKRTAPEGANCAGDPKRARESETTGVGSKSQAVHQIFSGSKSSFKMNSHPGKHLPIRYYAPFFFLNLKIW

SEQ ID NO: 83908 - DNA, 1305 bp, Zea mays
  misc_feature: Ceres CLONE 1569859
  misc_feature (55)..(55): n is a, c, t, g, unknown, or other
  misc_feature (56)..(56): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (74)..(74): n is a, c, t, g, unknown, or other
  misc_feature (76)..(76): n is a, c, t, g, unknown, or other
  misc_feature (77)..(77): n is a, c, t, g, unknown, or other
actcggtcgcctaccccctctcctctcctggtgcttcacccctcttttggctggnnagtcctcnnnncccttancnncaccccccggggtggcggccgctctagactagtggatcccccgggctgcaggaattcgtctcacccctagaaaaaatggagccgagctacatcacgtccgccctccccctctctctccctctccctctctcgacgacacaccaggccaccacgcacatgctttgtcccatggatgccgaccacctcagggtgttcaagaccatgctcgccgtcaggtggtagtcccggggaagcgagatctccccaatcaagggtgtgtcccatggctcgctgccgccccatgttgtttgcggccgtggctcgccaaccgcggcagggaagccgtcgatccgaccgggagccccttcccaatggacaaaggcgttcgttcttcttcgggaaatgaggggcttttttggggggcaccccccacataaacacctggggaaaccccgggttccccccacccctccttcatcctgcactatggggagggaagtctcggggaaccgcgcgtcaccaccccttcttgagttgtcggaatctccgtgggggcgggcgcaacccccgcccgtccgggtaccaggggcgcgcccccgcagtttgggttgttgtgccccttggtccccgtggggggagcccccttggcggcgtctatttgtcgaaaaacgcgcgtctgtccgagatgacagcccgggaatgacacgccgcgtactttactcctcgcggtcccttgccgtgtcattggaatgcggtgtttctcggagcgcgggtgttcggggtggtgcacccgcccccgcgtcttcgatcttatttcctcccctggggtaacgccatccacttgcctcgttctggtcacgacatgggcctcgacgtccccccacgctgcctctgtgtctcaccccacggtgagcgagcttgctgctctgctctggcagtggggcgttccacgcctggcagcgcctattaggttatgatggttgtaggtcgctatctcccctgtgccggcgtgctatgggttcgtgacttgtctggattctttccgcactataccccttggttttttgtgtggcgacacggcgttcggtgcactccgctgttccgcctttcgggcgaggcgctcgtaaaagacgcgtggtatccacaactatacgcctcacacctgggttggttggctatgtcacacgcgttgtgtagcgcctcttgggttcgggtcccactgccgtgtggagccccagttgcgcgagag

SEQ ID NO: 83909 - DNA, 922 bp, Zea mays
  misc_feature: Ceres CLONE 1569860
  misc_feature: Encodes the peptide sequence at SEQ ID NO. 83910
ctccccgcggtggcggccgctctagaactagtggatcccccgggctgcaggaattcgtctcacccctagaaaaatagagaactatggaattaaagttgctggatttcatgctgatacaatgcatcttgcacgactttgggattcttcaagaagaacagatggaggatattctcttgagggacttacaaatgatcatagggtcatgggtgttgttccaaaggaattgcaaaagattgggaagagatcaatgaaaaccatctttggtcggaaaaaaataaagaaggatgggtcagaagggaagattactgcaattgagcctgttgaaattttacaaagagagacagagaattgtggatctgctattcttcgttagattccatgagtaccttgaggctttatgagagcttgaaaagcaagcttgaaaggaagccctggacttttgacggttaccccagacccggaggttcattgtacgatttctatgaggagtattggcgtcctttcggtgctattcttgtaaaaaatggaacagctggaatgcttgttgaccgtgcttatctttcagagattgaaaaggttgctgttgcacagcgagaatcagctgcagataaatttcggagtgggcatctaagtattgccctgatgcaaaatacctgaatgttaatagtgaccctcagattccacaacttttctttcgtggtataaagaaacttttcaaatctggtgattttttgcccaagaataaagcctttaaaagggcctaacaatgaaactgctgtttcaaaaggcaaaaaagttccaaaagttccgccccattgaactttcccgccttgtgggaaaaccgaaaacctgttttttttctgggagggggttgcccctccctttaggggggccgcctttaaaaaatttgcgcgggaaaggc

SEQ ID NO: 83910 - protein, 84 aa, Zea mays
  misc_feature: Ceres CLONE 1569860
MHLARLWDSSRRTDGGYSLEGLTNDHRVMGVVPKELQKIGKRSMKTIFGRKKIKKDGSEGKITAIEPVEILQRETENCGSAILR

SEQ ID NO: 83911 - DNA, 959 bp, Zea mays
  misc_feature: Ceres CLONE 1569862
  misc_feature: Translation starting site: 228
  misc_feature: SWISSPROT Homolog: EC 1.2.1.3 Aldehyde dehydrogenase (NAD(+))
  misc_feature: SWISSPROT Homolog: EC 1.2.1.36 Retinal dehydrogenase
  misc_feature (543)..(543): n is a, c, t, g, unknown, or other
  misc_feature (959)..(959): n is a, c, t, g, unknown, or other
ctccccgcggtggcggccgctctagaactagtggatcccccgggctgcaggaattcgtctcacccctagaaaaaaacaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatccgggcagaccttcccaactctggaccctcgtacaggggaagtgattgctcatgtggctgagggtgacgcanaagacaatttaccgtgcagtagctgcggctcgcaaggcttttgatgaagggccatggccgatgatgactgcctatgaaaggtccggtatcctactgggggttgctgattttgtagagaaacccatggccagcttgctgctttggaaacttggaacaacgggaaagcctttgaccaagcgccccaaatggaagtcccatgggggccccgccttatgcgttactagggcggtggggctgataagacccagggcctcatggggccggtgaaggcccaccccatgtacaatcctgcatgaaccccttgggatgtgcaggcaaaatctccccaggaacattccccctccgaattttcgccgaaaaattgccccccctttgaatggggaaatacctcgggctcaaaaggcgaacaaaccccn

SEQ ID NO: 83912 - DNA, 1005 bp, Zea mays
  misc_feature: Ceres CLONE 1569863
ctccccgcggtggcggccgctctagaactagtggatcccccgggctgcaggaattcgtctcaccccctagaaaaaaatggtcaactgggggtaaacaagcttgaaaaatgctgacagtggcacaaattagcatagatcactttgtatttttcaaaaagcagcttgtctgtagacagggattttctactgtatgtaggcttaattgggtaggcttgctggtgagtatagtatttatagttccttcagattagctatgaaagctatcactgctaccaaattttggttgtggagcaatcagcaaccttacacaatactaattgcatctctcaactcctagagtcgaagatccatcgattttgcgcataaggggtatacatcactcacttggtatttatggggggccccccaacttcgttatcattctggtttgtttggaaaacgaaggctgaacaaatttcaccgatggagggcaacttggtatagtatttagttctatcgtacacccctttcctttagtataaaattccctgggtaagggggatatcccattttattttcccaacgtaatgccaatcgggcccagacgacgctttttccctccaactggggttgaatctggggctgggattttcactccctcggggggggaaatctcctacattggggcaaagggttaagccacggcctgggtttttagggttttttatggccttgtcttgtccgtggcaaccaataaaattattgcctcaaaaagttaaaaggaacgcaaccctcattttcgcacctaaaaaatcttaaccttattccttataccttcgaggggaaccttgtcttattgggaaatttgggttcatctactaagatttggattccttctccaggttcctcttttgttatctgaggaaaagattccagggtgaacgcggaagggattcgcctgtctcttggaagttgtcgcccccgaccgaaacatgtgaatatggcctacaagggcggggagagtgg

SEQ ID NO: 83913 - DNA, 929 bp, Zea mays
  misc_feature: Ceres CLONE 1569865
  misc_feature: Translation starting site: 145
  misc_feature (732)..(732): n is a, c, t, g, unknown, or other
  misc_feature (760)..(760): n is a, c, t, g, unknown, or other
  misc_feature (796)..(796): n is a, c, t, g, unknown, or other
  misc_feature (896)..(896): n is a, c, t, g, unknown, or other
ccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttnccgcgcgcgcaggtctggcccagcgccnggtctggttggcctctgctggcccatgaacttcggncgctccaagagcaagtcccaggagttgcctgagacgggtgtcaccttcctcgacgttgcccgcgcggaacaagccaaactcgagctggcaggagtcggcnatatcctcaagaaccccgaaaagtacaccgggc

SEQ ID NO: 83914 - DNA, 943 bp, Zea mays
  misc_feature: Ceres CLONE 1569866
  misc_feature: Translation starting site: 174
  misc_feature: SWISSPROT Homolog: EC 2.7.7.27 Glucose-1-phosphate adenylyltransferase
  misc_feature (896)..(896): n is a, c, t, g, unknown, or other
ctccccgcggtggcggccgctctagaactagtggatcccccgggctgcaggaattcgtctcacccctagaaaaaaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttgggtggtggtaccgggactcagcttttacctctcacaagcacaagggccacccctgctgttcctattggaggatgttacatgcttattgatatgcccatgagcaactgtttcaacagaggcataaacaagatatttgttatgactcagttcaactcagcttctctgaacagcacattcatcgtacctatcttggtgggaggatcaagctcactgatggatcctgtgaggtgctggctgcaacaccaatgcctgtgcgagctgcatggtcggttcaagggcacagacactccgtaagaaatctatctggggtacttgatgattattaccagcgtatagccttagagcaaggtatgattttgtcgggatataagatctatccgatggatggcttgcagatgatggataacctgcccatgacaatgccagctaactttttcaaggcccccgggntggagaaacgcgaccaaagaacctcgctttggtaaacctcacccggc

SEQ ID NO: 83915 - DNA, 844 bp, Zea mays
  misc_feature: Ceres CLONE 1569867
  misc_feature: Encodes the peptide sequence at SEQ ID NO. 83916
  misc_feature (769)..(769): n is a, c, t, g, unknown, or other
ctggagctccccgcggtggcggccgctctagaactagtggatcccccgggctgcaggaattcgtctcacccctagaaaaaaccccgaaaattctccctcgctctctctcagtctctctctccgtgagggaggaagttgggcttcgttctcgagtactcttcgttctcaggcgccccccggctgcttctgctggtcgccgcccagctccagttattagagaaataagggccggcctgcttgcccgaggctgacccaacacctgcgatggaggagaaggctgtcacaaatggagcggcagctgctgatgttgctgctcctgataataaggataacaccaaggaagaggttagcaagagcaaggaggcagtagcgaataaggatgctgaagagcagaacaaaggctcggaaaatggtgctgagggccattcaggtggagatgtcaatatggcagaggctgagatcgctgaggaaggtggtggtggtgatgctggtgcggcaaagcaggtggattctggagatgtcaaaacggatgccgatacaaaggaagatgccaatgcgagaacagaagaaggtgaagatgccaagatgactgaggctgacgtaggaagtacagaggtcaaagataaagaagagaaggaagatgaagttgagaacacaattgagcaggatgaatcgaaggagcaagagaaaggtgttttggctgagcaagaggaaaacgaaggaaaagaaacggatgctgatgagaaccaagaagaagaggaagcagaangaaaggtttctgctggtaagaaagatgaagctgaagctgaaagtgacaagaagacggaaaagagaataggagact

SEQ ID NO: 83916 - protein, 193 aa, Zea mays
  misc_feature: Ceres CLONE 1569867
  misc_feature (169)..(169): Xaa is any aa, unknown, or other
MEEKAVTNGAAAADVAAPDNKDNTKEEVSKSKEAVANKDAEEQNKGSENGAEGHSGGDVNMAEAEIAEEGGGGDAGAAKQVDSGDVKTDADTKEDANARTEEGEDAKMTEADVGSTEVKDKEEKEDEVENTIEQDESKEQEKGVLAEQEENEGKETDADENQEEEEAEXKVSAGKKDEAEAESDKKTEKRIGD

SEQ ID NO: 83917 - DNA, 878 bp, Zea mays
  misc_feature: Ceres CLONE 1569872
  misc_feature: Translation starting site: 236
  misc_feature (457)..(457): n is a, c, t, g, unknown, or other
  misc_feature (458)..(458): n is a, c, t, g, unknown, or other
  misc_feature (462)..(462): n is a, c, t, g, unknown, or other
  misc_feature (469)..(469): n is a, c, t, g, unknown, or other
  misc_feature (473)..(473): n is a, c, t, g, unknown, or other
  misc_feature (474)..(474): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (482)..(482): n is a, c, t, g, unknown, or other
  misc_feature (485)..(485): n is a, c, t, g, unknown, or other
  misc_feature (554)..(554): n is a, c, t, g, unknown, or other
  misc_feature (555)..(555): n is a, c, t, g, unknown, or other
  misc_feature (572)..(572): n is a, c, t, g, unknown, or other
  misc_feature (579)..(579): n is a, c, t, g, unknown, or other
  misc_feature (662)..(662): n is a, c, t, g, unknown, or other
  misc_feature (703)..(703): n is a, c, t, g, unknown, or other
  misc_feature (744)..(744): n is a, c, t, g, unknown, or other
tccccgcggtggcggccgctctagaactagtggatcccccgggctgcaggaattcgtctcacccctagaaaaagcgccgccggggcgtcccggatcgtggtggtgcttgccgtcgctggtgagtccatgagacgtgtgtcacccggccgttcagcgcagagcccatccggccatcccgttcgtacctaaccggcaccttcttctgcggatcaatccggcaaagccagcgcgcgcgatgcgccggcggtgggacagctgcttctcgggcagcgacgtccgcgtgggcgggcgcgtcccccccgaggagccggagccggaggtcttctccttcgccgagcccctcccgtcgtggcccacaggcgggggattcgcgcgggggaggatacgcatcggcggaggggaactggagctcgccgcggtcaccgcgttccagaagatctgcaccctgtcgtccggnngccntgtggcnggcnncnnnnncnccncccttttaccggccgggtcggcgtccccgagggggttctcgctccctgggtttctgcttgccccgcctnnctgcccgcccggctccncgggccncgtccttcgtttgccgggagcggggggagcgccccgtccgggggcctccgctttgggccgcccgccgcctgccggtttttggnggcccgctggggcttttccggcttctcttggggggttcccnggcccggtgggtcattggcgggttccgggtttccggtcggnggcggcccccctcttttttgggttcccccgtgccgcccgggggtggtttctgggggccccgggggtgtttctgtgcccccccgggcccccggggagccccccccttctgggggggggtgggtttccctttcccc

SEQ ID NO: 83918 - DNA, 962 bp, Zea mays
  misc_feature: Ceres CLONE 1569875
  misc_feature: Encodes the peptide sequence at SEQ ID NO. 83919
  misc_feature (962)..(962): n is a, c, t, g, unknown, or other
ggccgctctagaactagtggatcccccgggctgcaggaattcgtctcacccctagaaaaagctgttgcattccatctccatagacaagtaatcccaatcccgtcctacctggatggttcctgcctgtctgtcgcctcgtgacgtctgtccaagaacactcgctccccacctgttcgctgcttcttcttcttgccaatctgctccttcttctagctagatcttggatggagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagttggtggttagcaaatcccaccaagcaggaagcagccgcgagcgagccatggccatggatcccgttctgaaggtggccctgggctcggcggcgttcgccgtgttctgggtgctggcggtgttcccggcggtgccgttcctgcccatcgggcgcacggcgggctccctgctgggcgccatgctgatggtgctgctgggcgtgattaacgccgacaaccctacgcctgccgtggacctgcccatcctgggcctgccgttcgggaaccatggtggtggagccttgacctgggaacgcgcccaacttggtacgggcacctggggcgccctgttgttcctgggcggaaccagggcggggcggtaacctgctggtggggctccttgtgctctttgatcgtggtttgccttcccgcgctctttaaacaataaaacacctggcatgggtgtggtgcctaaccgtaagttaaaccctccaaaaatcgccgcgtccataaaaaaaacttggcccacgaggcgcctcttctctgtatgtgtgggctgtggcggtccgatgtgn

SEQ ID NO: 83919 - protein, 103 aa, Zea mays
  misc_feature: Ceres CLONE 1569875
MAMDPVLKVALGSAAFAVFWVLAVFPAVPFLPIGRTAGSLLGAMLMVLLGVINADNPTPAVDLPILGLPFGNHGGGALTWERAQLGTGTWGALLFLGGTRAGR

SEQ ID NO: 83920 - DNA, 928 bp, Zea mays
  misc_feature: Ceres CLONE 1569877
  misc_feature: Encodes the peptide sequence at SEQ ID NO. 83921
ctccccgcggtggcggccgctctagaactagtggatcccccgggctgcaggaattcgtctcacccctagaaaaaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgccgcggcccgtcgaggttagcccgcaagcgtggcagctcctctccatctttctctccacaatccggggcgggggcttggccctctcccctggcgcgcatggggcttcctcggggtcaaaaccgccgtcggcactcaaaaggctccctttaacgggcggcttttccgcctttaacaaaaaaaggcatctgggctcaccgtattttcctttcttcttccccgcccggggttcgtaaaaaaaaggcccccggaaaaataaaacgcccccatattttcggaaaagtggctccggagaaaaacaagttgggcctttttcctaggggggttacacccaaaaggagaccggattgtggcccagacgtggcaagataacaagggtaggggcgaagagggggtcccccccattaaaaaaaaagccctcccgttgtggcggtaaaaaatacaccaaacccctcctttgtcgggaaaatgttgggccaaattgggggagaaagccaaccaccgag

SEQ ID NO: 83921 - protein, 181 aa, Zea mays
  misc_feature: Ceres CLONE 1569877
MELHLATIAHRPPLPVPARGHHLRRRLHHLPAPLSFQNTYSPSLSSPHHHRLSPTLRRHLRLPLLASQAPNSNPEPEPEPEPTGAKLLPLVISIAIGLAVRFLAPRPVEVSPQAWQLLSIFLSTIRGGGLALSPGAHGASSGSKPPSALKRLPLTGGFSAFNKKRHLGSPYFPFFFPARGS

SEQ ID NO: 83922 - DNA, 846 bp, Zea mays
  misc_feature: Ceres CLONE 1569878
  misc_feature: Encodes the peptide sequence at SEQ ID NO. 83923
ctggagctccccgcggtggcggccgctctagaactagtggatcccccgggctgcaggaattcgtctcacccctagaaaaagagctcgcagtcgccgtccactccgttgagctttttctcaggcttcgcatggcctgattcatcctacagtctccaacaagccaaggaaacgccgcaccgcgctttctccgcttccttccactcagagggtcagaccccaacgccgggagaataggggattaggagccagacctggcggcgccgggcgtccaagaaacgctgcctaataaaatccctccggcgtctgtcgtcttgaccgcggcgacgcaggcttcttcttttcgctctccacgtaagtctgctacccttcccccccacggttccggcgcttgcccccctgcgggagcgtgtcttggatcctttggttgggaattgggattcgaagccgtcgtcgggattgtctattcccgttcttgaattctagcgcggaggcggattggattcgagctgcgagttttagcttactaatttttctgtgtggtgggtcgagtaatcgaatctggagggcgtccttttctgtgcgatattgtcagttcatagctgttactcagctcgatgatgcaggcagtgagctcaacgtgttcgatgaaatcgcttacccaagttacttatctaaggaaggattgctgcggtcagaattacatcttcaaagttgtagactggcaatggcaactgtgtttccaaacttgaaatttgacggcaggacagccaagaaacaagacacactttagtgctggtttgggaaccagggaaattgggggttcattttctccctcaaccccgttca

SEQ ID NO: 83923 - protein, 44 aa, Zea mays
  misc_feature: Ceres CLONE 1569878
GAPRGGGRSRTSGSPGLQEFVSPLEKELAVAVHSVELFLRLRMA

SEQ ID NO: 83924 - DNA, 996 bp, Zea mays
  misc_feature: Ceres CLONE 1569879
  misc_feature: Encodes the peptide sequence at SEQ ID NO. 83925
  misc_feature (398)..(398): n is a, c, t, g, unknown, or other
  misc_feature (996)..(996): n is a, c, t, g, unknown, or other
ctccccgcggtggcggccgctctagaactagtggatcccccgggctgcaggaattcgtctcacccctagaaaaaatataccactccacaatcacacatttgacaccgccaatccatggccttggcgacgccgctgcggctccgccgccacctcctcctccccgccgggccgtccccggcgacccaccgcgccctgtcgctgcggcggggccgcctcctccccgcaagcctgtcgtccgccgcggcgggcgggcggccgacggtgctggtgacggagacgctgggttccgcggggctggacctgctgcgcgccttcgccaacgtggactgctcctacgagctgacggcggaggagctccgcgccaaggtgtcgctcgtggacgcgctggtggtgcgcancgggacgcatgtgacgcgggaggtgttcgaggccgcgcgcggcaggctccgtgtcgtcgggcgcgccggggtcggcatcgacaatgtggacctccaggcggccaccgaagccggctgcctcgtcgtcaacgcgcccaccgtcaacaccggtctccgccgccgaggacgccgttcgcgcttcctcgccggcggtggcgcgcatttatcgggccggccgacgcgtcgctcaagggcgggaaaatggccaccgtgggcaagtatgtttggtggttacccttggtggggcaaaaaccctagcccgacatggggtttccggcaaaggtcggtcccaaagggggctccgccccccccaaaagagactctgggttggacctgcggcgccccacatacccatacggttgcgccctatttgatccccggtggggctggggctccaacttgggtgttgttttgacgaaggcctgtctcacccgcgggaatttaatttgctgggacagtgccctggtaacccagagacagggtaatctgtcttcacgagtgaattcttctcacagaaacagggagtggtgcgtggatacgcctcgcttttcgcggggcn

SEQ ID NO: 83925 - protein, 245 aa, Zea mays
  misc_feature: Ceres CLONE 1569879
  misc_feature (50)..(172): Pfam Name: 2-Hacid_dh Pfam Description: D-isomer specific 2-hydroxyacid dehydrogenase, catalytic domain
  misc_feature: SWISSPROT Homolog: EC 1.1.1.95 Phosphoglycerate dehydrogenase
  misc_feature (95)..(95): Xaa is any aa, unknown, or other
MALATPLRLRRHLLLPAGPSPATHRALSLRRGRLLPASLSSAAAGGRPTVLVTETLGSAGLDLLRAFANVDCSYELTAEELRAKVSLVDALVVRXGTHVTREVFEAARGRLRVVGRAGVGIDNVDLQAATEAGCLVVNAPTVNTGLRRRGRRSRFLAGGGAHLSGRPTRRSRAGKWPPWASMFGGYPWWGKNPSPTWGFRQRSVPKGAPPPPKETLGWTCGAPHTHTVAPYLIPGGAGAPTWVLF

SEQ ID NO: 83926 - DNA, 956 bp, Zea mays
  misc_feature: Ceres CLONE 1569881
  misc_feature: Encodes the peptide sequence at SEQ ID NO. 83927
tccccgcggtggcggccgctctagaactagtggatcccccgggctgcaggaattcgtctcacccctagaaaaagtcaagtcatagaacggggttgcgaggtagcccaattctacagcactagtctttttcgtctcggtcgccatgtccttcagcgatgacgaaccgatcatcccttctccaaactcaggttcattcgtgaacacgaataaaaattgaaccaaatcatttttgctttgaatcgatttagtttgcgttgcattgctgatatatatcgatggagaagcaagaagagaatgcgtttacatccatatatgcggctgaaatattaacaatggagatgggaatggtgagatgcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacggcctccagacggggctcaaggtccctcgcgaacgcaagctcagctccggtcgcgtcgttggcgtcatgctcatgttcgacggccagcagaaccgggtcgagccagcgccaacgtcaagatcggcaacgtgccggggtacaacttcggttccgccgcggactacgaacccacggtgctgaacgcgggggcaggaaacagatggggagggaccttctcg

SEQ ID NO: 83927 - protein, 166 aa, Zea mays
  misc_feature: Ceres CLONE 1569881
  misc_feature (28)..(166): Pfam Name: VWA Pfam Description: von Willebrand factor type A domain
  misc_feature: SWISSPROT Homolog: EC 6.6.1.1 Magnesium chelatase
MAPLEENTQKVLLELTGGDSTSDRSGLDLVAVLDVSGSMQGEKIEKMKTAMKFVVKKLSSIDRLSIVTFLDTANRICPLRQVTEDSQPQLLKLIDALQPGGNTNISDGLQTGLKVPRERKLSSGRVVGVMLMFDGQQNRVEPAPTSRSATCRGTTSVPPRTTNPRC

SEQ ID NO: 83928 - DNA, 957 bp, Zea mays
  misc_feature: Ceres CLONE 1569882
  misc_feature: Encodes the peptide sequence at SEQ ID NO. 83929
ccccgcggtggcggccgctctagaactagtggatcccccgggctgcaggaattcgtctcacccctagaaaaaagcggaaaagcgccatctcattcttcttcctccatcttgtctctacttgccccgcgccggggagccgcgagcgtcgcgccactcccatcgcctgcccacaactccggcatggagccgtcggcgtgggccgtcgccttcgccgcactctgcatcgtcgcgctcgcgccgccggcctcagggttctacctccccggcgtcgcgcccaatgacttcgagaagaaagatccacttcctgtgaaagtcaacaagctgacctcaatcaagacacaacttccctactcctactattctctcccattctgcaagccggataccatagttgacagtgcagaaaatctcggtgaagttcttcgtggagatcgcattgaaaaactctccctatacgtttgaaatgagggagcctcagatgtgtcaagtagtctgcaagatatctgttggggagaaagaaagcaaagcttctcaaggagaagattgaagatgaataccgggttaacatgattctttgacaacctaccctttagtcgttcctattcaaagaaggggatccagaaagggcatattttctttcaacagggattcccatgtttggggccaaaggaaaaatattcggggaaccaaaaatagaaaaatacttcattccacaaaccatcttttctttttacggggaaatatcccaggggaatgaagcaaggggatggtttcccggattgggggccctttgaagggaaaacattacagcgtttagactgaaattttaaagggcattggaatggataaaaaaacccgcccggaaaagcggtggaccctcagggcccaacggttatattcctttgcccgaatcctcccccagagggccaatattggccaagtaatcattattttttt

SEQ ID NO: 83929 - protein, 93 aa, Zea mays
  misc_feature: Ceres CLONE 1569882
MEPSAWAVAFAALCIVALAPPASGFYLPGVAPNDFEKKDPLPVKVNKLTSIKTQLPYSYYSLPFCKPDTIVDSAENLGEVLRGDRIEKLSLYV

SEQ ID NO: 83930 - DNA, 927 bp, Zea mays
  misc_feature: Ceres CLONE 1569885
  misc_feature: Encodes the peptide sequence at SEQ ID NO. 83931
  misc_feature (833)..(833): n is a, c, t, g, unknown, or other
  misc_feature (845)..(845): n is a, c, t, g, unknown, or other
tccccgcggtggcggccgctctagaactagtggatcccccgggctgcaggaattcgtctcacccctagaaaaaatgccgtaacccgcaggctcccggcatctcgctcttgcctccaaaattcaccttcgccgattgccgccgtgggccgccgcgatggcgttgcggacgcctcgtaccacctccgtcgcattctccgctgactcccccctcggcggcgtcccaatacgctcctcaacagcctgctccgttcccacgccacctcctctcgctccgctgcgaccaccgaggaccaccagagcgggacgtcgcggaactcgtcggccacgtcctggccgtcgcgcatgctgacgacgaggctgttgccctcccgggcgccctcggcgcggagctcgcacgcgtcctgcgagcgcgcggcgccgctgaggcaccgggcgcgccggcggaggaacaagttgaagtaggtccggaacagaggacagggagggacctaaaattcaagcccaaaggaccaaagcccgaagtttcttttcttccccgcaaagaaagaaggcaagagttctcggcttctcgcaagtcgcgacagagaaagaagcggagttgcggagaagatgcagagcagcagcatggaagagggagatcagcgaggcccacgacaccattcgcttcggcatcaacgccggcgtcaaagcgaacctcgccccgccgcacccgaatgaaatccagaaatcatttcttccgttctaaattgtgtgtggtgacagggaagtcttaaaaataggtgtttatagattcatcgcgacacgatccttcaccagaaaaggttacagagaantgcagagaattnttctattggagaagcatcagggcattctgctttgcgtcacaagttcaacccagccaaatcccaggcgaatttccaaaaagga

SEQ ID NO: 83931 - protein, 39 aa, Zea mays
  misc_feature: Ceres CLONE 1569885
MLTTRLLPSRAPSARSSHASCERAAPLRHRARRRRNKLK

SEQ ID NO: 83932 - DNA, 865 bp, Zea mays
  misc_feature: Ceres CLONE 1569893
  misc_feature: Encodes the peptide sequence at SEQ ID NO. 83933
agctccccgcggtggcggccgctctagaactagtggatcccccgggctgcaggaattcgtctcacccctagaaatctctctcacacacacattgtcgcctgccttcccttccttccccagttgagttccccccgcggccccgcccccggtccccttccaccgacccaccatgtcggcgatgaggtgaggttgaggccaggtctactctccgcgaccgtcgccgacgccatcgccaacgagcagtttgctccatcttcgccatctcgcacacgaatacaatacactagttttggtagagatggaggacggcggcaaggcgccggccggcctgggcaccctgcgcgcggtgctcgccatcctccagtggtggggcttcaacgtcaccgtcatcatcatgaacaagtggatcttccaggtttacccgcattatattctagcttccccatccatcttccgccgcggatctggatgtcagatgcttctcctgcccggctgctacttttctcctttggaatatctaactaaattcgtccatactgcttaccattatagatcacggactagagacttggattgggtgggaaacagggtcaaatagacttatagcgtgtttggtctgagaaacgaggtagttatcatcttttcactactcactttttttgtttgtttttggaatggaatgaattgatccatcatttcaatccttgtaggccaataattagtaataatacgagaaatgagttcattccactaaatttgtggaatgaacatatgatgcacccacaccacctcatctgtaatagattggctcttcgaacaaacaccccattagatttgtactacgtactttgggttggggtggtgg

SEQ ID NO: 83933 - protein, 99 aa, Zea mays
  misc_feature: Ceres CLONE 1569893
MEDGGKAPAGLGTLRAVLAILQWWGFNVTVIIMNKWIFQVYPHYILASPSIFRRGSGCQMLLLPGCYFSPLEYLTKFVHTAYHYRSRTRDLDWVGNRVK

SEQ ID NO: 83934 - DNA, 952 bp, Zea mays
  misc_feature: Ceres CLONE 1569897
  misc_feature: Encodes the peptide sequence at SEQ ID NO. 83935
  misc_feature (790)..(790): n is a, c, t, g, unknown, or other
  misc_feature (835)..(835): n is a, c, t, g, unknown, or other
  misc_feature (851)..(851): n is a, c, t, g, unknown, or other
ggagctccccgcggtggcggccgctctagaactagtggatcccccgggctgcaggaattcgtctcacccctagaaaaaaatctagcctgcctgtccttagcgtagtcatgccatggcgggcgatgcgctcatcgtcatcgtcactagcttcctcctcgcgctgccgtcagcgacggcaataggcaaggtctgcggcaacgccggcaactacacggccaacggcaggtaccggtccaacctcgactccctcgccgcggccctcccagccaacacgtcctcgtcccctcagctcttcgccaacgccaccgccggccaggcccccgacgccgtgtacgcgctcgcgctctgccgcggcgacctgaccggcaacctcaccgggtgcagcgcctgcgtgaacggctcgttgcagtacgcgcggagggcgtgcccctacgccaaggccgccagcgtctacgacgacaactgcctcatcggctactccagcgccaacatcctcgtcccggcctataacgccacccgggacacgagcacgctcttcgactactggaacagcatgaccatcgccggcaacggcacactggtggccgcccacgtcgacgacctgctgacgcagactgcccagcatgctgcctccagcccgaagaggttcgtcacggcctacatggacggctccagcaacgccgtcatcccgacgctctactccctggcgcagtgcacgcccgacctgtcagccggcgactgcctggcctgcctcccagcgatcctcggcttgctcaacgccacgacgtcngtgagctttggagggcggggtcctctgctgcggtgcacttcaggntcgagaatacatgttnctcgacgcgcacagatgacccataattaggccgttcgtcaggggctccggcgccaacacaacgtgctcgaagaaaaattaaaggaactggggtggaagcct

SEQ ID NO: 83935 - protein, 255 aa, Zea mays
  misc_feature: Ceres CLONE 1569897
  misc_feature (73)..(129): Pfam Name: DUF26 Pfam Description: Domain of unknown function DUF26
  misc_feature (195)..(249): Pfam Name: DUF26 Pfam Description: Domain of unknown function DUF26
  misc_feature (247)..(247): Xaa is any aa, unknown, or other
MAGDALIVIVTSFLLALPSATAIGKVCGNAGNYTANGRYRSNLDSLAAALPANTSSSPQLFANATAGQAPDAVYALALCRGDLTGNLTGCSACVNGSLQYARRACPYAKAASVYDDNCLIGYSSANILVPAYNATRDTSTLFDYWNSMTIAGNGTLVAAHVDDLLTQTAQHAASSPKRFVTAYMDGSSNAVIPTLYSLAQCTPDLSAGDCLACLPAILGLLNATTSVSFGGRGPLLRCTSGSRIHVXRRAQMTHN

SEQ ID NO: 83936 - DNA, 819 bp, Zea mays
  misc_feature: Ceres CLONE 1569898
  misc_feature: Encodes the peptide sequence at SEQ ID NO. 83937
  misc_feature (624)..(624): n is a, c, t, g, unknown, or other
  misc_feature (668)..(668): n is a, c, t, g, unknown, or other
ctccccgcggtggcggccgctctagaactagtggatcccccgggctgcaggaattcgtctcacccctagaaaaagcttggggaggatgagcacgtcactgaagaaattgtactgagctccttgaggtcggctctggaccagttctcttcactgcaagccagcgatgggcactggcctggtgatttcagcgggattatgttcatcatgcctggtttgatatttgccttgtatgtcactggatcactgaatgttgtcatatcaccagaacatcggcatgagatttgccgctacatctacaaccaccagaacgaagatggtggatggggcacacttatcttgggttcgagcaccatgtttggcacatgctcaaactacatcaccttgaggcttctcggtgaggagccatacgccaacaacagtgtgttggctaaagggcgtgcttggattctatcccatggtggtgcaaccttgattcctcagtggggaaaaatatggctttcggtacttggattgtttgattggtcaggaaataatccaattttccctgaactatggtccattccccagtttcttccatttcatccagggaaattctgggtgcttgcccgtatggtatatctaccnatggcttatctttatggcaagaaatttgtgggaccaatacaccnactatattggcactaagagaagaaaatctatgaacctccttatggaaagaatgactggattgatgcttcgtagtaaatgcccaaaggaggacctcattctgccaccccacacggttgcaaaaggtattttgaacttcccctttaaagggtg

SEQ ID NO: 83937 - protein, 162 aa, Zea mays
  misc_feature: Ceres CLONE 1569898
  misc_feature (24)..(67): Pfam Name: Prenyltrans Pfam Description: Prenyltransferase and squalene oxidase repeat
  misc_feature: SWISSPROT Homolog: EC 5.4.99.8 Cycloartenol synthase
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO 4 in US patent 7135624
  misc_feature (158)..(158): Xaa is any aa, unknown, or other
MFIMPGLIFALYVTGSLNVVISPEHRHEICRYIYNHQNEDGGWGTLILGSSTMFGTCSNYITLRLLGEEPYANNSVLAKGRAWILSHGGATLIPQWGKIWLSVLGLFDWSGNNPIFPELWSIPQFLPFHPGKFWVLARMVYLPMAYLYGKKFVGPIHXLYWH

SEQ ID NO: 83938 - DNA, 906 bp, Zea mays
  misc_feature: Ceres CLONE 1569899
  misc_feature: Translation starting site: 148
tccgcggtggcggccgctctagaactagtggatcccccgggctgcaggaattcgtctcacccctagaaaaaactgccagtgccatcccattcccatccgagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgactaccaggactacaccccctgcaccgaccccaagcgctggcggaggtacggcaactaccgcctcagcttcatggagcggcactgcccgccgccgcccgaccggcatgcagtggctggtgccgccgcccaatgggtacaagccgcccatccggtggcccaagagcaaggacccagtgctggttaccggaacgtccccctacgactggatcaacaagcaagaagtcccaaccagcactgggctccgtcaaagaaggcgaccgccttcccggttcccctgcggcgggcacatgttcccccaacgtcgtcgggcccgtacgtgggaccctgatgcaagggccttggtccccgggaatgcgcgaacagtatccttcgccaccgcgtttcgacaaccggtttggggggttcccccagctgggggggggcgaacttgctggggggcgggggcatcctcaccctggttgcccgtgcgccccag

SEQ ID NO: 83939 - DNA, 824 bp, Zea mays
  misc_feature: Ceres CLONE 1569900
  misc_feature: Encodes the peptide sequence at SEQ ID NO. 83940
tggagctccccgcggtggcggccgctctacaactagtggatcccccgggctgcacgaattcgtctcacacctagaaaaacctctcacctctctcgaaactttccccaatcccatctgctgccgccctctcccaagcctatccacgccggcgccagccctgctcgggtggtgcgcatacatgaacgatccgtcctcgtctttatcctccgtccagccgccgccagactccggtggcggcggccgaggtcacctcccacgcgccaggcttccgctaccatcccgccaacgaggagcactgcttctactagctcaagagcaaggacctcggcagcccgatcatggttgatgacatccccgatgagaacctttagaagctccagttctgggacttgcccccccgctcgcgcctgatgtcgcagaactacgagtggtacttgattcgcatccatccacagcaagcacggggaccgcgtgtactgcgagagcaccatgacgtgagggctctgagactacccgccaaggacagggaggtgcgccctgactccaggcttgtcgggatgaccaagactctggtttgcaagcccgactgaccccacggggaacgcatggatgagtcatgcacgaataccgacgtggagtgcaacacccgggagggtaccgggagagttatatgctgtctgccggaatcttcacaagctcggacaggactctgaaaggcgacatcctgaacacctttagttgagaggaattgggagcagatgcacccatgatgggttgctcccatggaagggtgttgctctgtttaaccctcaggatcccttggc

SEQ ID NO: 83940 - protein, 59 aa, Zea mays
  misc_feature: Ceres CLONE 1569900
MSQNYEWYLIRIHPQQARGPRVLREHHDVRALRLPAKDREVRPDSRLVGMTKTLVCKPD

SEQ ID NO: 83941 - DNA, 858 bp, Zea mays
  misc_feature: Ceres CLONE 1569902
  misc_feature: Encodes the peptide sequence at SEQ ID NO. 83942
  misc_feature (648)..(648): n is a, c, t, g, unknown, or other
ctccccgcggtggcggccgctctagaactagtggatcccccgggctgcaggaattcgtctcacccctagaaaaaaggcgagctcggacgactgctcgtctgttcctttttctcgggttccacttacccgccagctctggaccacccccaactgccagggagtgagagagatctgtgcctgctcgggggcctgatggggcggctgcgttgtgctgcggcgggcggcggccatggccgattcatatagtcacggctaggggccatcactcacgagccatatccagaacctgcagccgcgccctggtccccgcctcaagcccgccatcgagatggaggatctcttcaacctcctccacggatgcgatcccgtccgggtcgagctcatccgcctcaacaaccaactgttttttaaggagaatgagctgggcgatgcgcatgctgagatctatgctcttcgcttgtcggaccgcgcgcgctagaaggccgtacatgatcttaccgaaaaattggtgaaggtggatgggaagctgaagctcgcagagtctctccttgacagcaagatctttgacgcggatatcatcacgatcgaagagaagcatcacttgccgcatagtttgcagctgaggcaacactactgaaggttcatgcngtacttcaggatgatgacgtgcctcctattgaaggcatccttggcgcactggtaggctgagctggaactggcctcgtcagggattcgcccacttgcaggattgacacagggtcattggatcgtcgtaaaaagtcttagggaaacagctttgcttttaatcttaaaagacgggttcagatggccctggcaaaagcctccctggcggaaggg

SEQ ID NO: 83942 - protein, 49 aa, Zea mays
  misc_feature: Ceres CLONE 1569902
MEDLFNLLHGCDPVRVELIRLNNQLFFKENELGDAHAEIYALRLSDRAR

SEQ ID NO: 83943 - DNA, 896 bp, Zea mays
  misc_feature: Ceres CLONE 1569903
  misc_feature (391)..(391): n is a, c, t, g, unknown, or other
  misc_feature (485)..(485): n is a, c, t, g, unknown, or other
tccccgcggtggcggccgctctagaactagtggatcccccgggctgcaggaattcgtctcacccctagaaaaactcccccctcgaccacgcacgcaaatgaaagcgctcccctcgattgggcggcacgtaacccatcaccaccaccaccaacccggacccgtcaagcgctgcgtcgtcccgtgcaaagaccgcgcattccgtgcgtgccgtgtccacgcgcgcgcgcgcggtggcgttaagttgtcgagcgccagaggagcgccactagtcgtcgatcggtttgaccaggcgaggaggcgtaggcgcgtaggggagtgagtctagctagctactggtggtgggtccattattcgctagcttccgacgatggaggtgaagaaggagggcacnaattgcgacgctgccgccggggggtcagtttcccgccgaccgacgagggagctgatcctggactaacctgcggcgggcgcgcgcttggcctccnccgctggccggccgccgtcctaacttcccgggagttccccatttccggggggcaagaaaccggtcccgaacctggttgccccccaggttgaattgtaatgtaaccaaatttgattcccggcccctccaaagggatcccttccccattttcccattttaaaaattgggggcctaaattgggtttttttttccccgggaattgggggggggcgggtgggtccccctgtgtggttggcacagggtttccgggaaaaaaaaaaaccctctcttttttccccctggaaagggggggcacatattctttaaaagggggcggggcgcgaaaaaccccccccccgggggggccggggtctttttaagggccacgcgcacaaaaaaaaccccggggggcgcggggggggcctcccccggg

SEQ ID NO: 83944 - DNA, 867 bp, Zea mays
  misc_feature: Ceres CLONE 1569904
  misc_feature: Encodes the peptide sequence at SEQ ID NO. 83945
  misc_feature (739)..(739): n is a, c, t, g, unknown, or other
  misc_feature (770)..(770): n is a, c, t, g, unknown, or other
  misc_feature (830)..(830): n is a, c, t, g, unknown, or other
ggagctccccgcggtggcggccgctctagaactagtggatcccccgggctgcaggaattcgtctcacccctagaaaaagggcgctgcagtagcgcagcgcagccacgccgcggcaacagcaacaccgcaccatggcgcttcttcttcatccccgcctcccgtcccatcctttccgcgcggcagcccaccaccaccacgccatctcggacgcctcttgcttccttaccctccacggccccggaaggaagcgccgcatgctgctcgcggcggtcacgtgccgcgcagccagggtcaaggagcccgctccgagcgcaggcgcctcgcctccgccgccgccacaggcgctgacgaaggaggcgcacaagtacttcgaccacgccgtggtcaccgtccgcgcgggcgacggcgggcacggcgccgtgctcgccatgccgccggcgccctccgcggacgccgccaagccccgcggcaggttcaaccggggcgagaagaagagcaagaaggtgtcgtacaagcgcaactacgacgggtccgtggcgctgccgacgggcgggcacggcggcgacgttgtggtgtacgccgacgaggccgaggagacgctgctgcggttccacgagaaggcgcggtactgcgccaaacggggagggaacgtgggcgccgctggcggcacgctcagctcgcggatgcacagcgggttcgccggggagacgctcaggatacccgtgcctgtaggaactgntgtgaaacgcaagaagggggctgttctggcngaattggctcatcactgtgatgaagtgctcgttgctagaggtgacaggggcggatcagtnctgatgatgtgcctgaggtacagaggaggaaaggctt

SEQ ID NO: 83945 - protein, 204 aa, Zea mays
  misc_feature: Ceres CLONE 1569904
  misc_feature (38)..(199): Pfam Name: GTP1_OBG Pfam Description: GTP1/OBG
  misc_feature (162)..(162): Xaa is any aa, unknown, or other
MLLAAVTCRAARVKEPAPSAGASPPPPPQALTKEAHKYFDHAVVTVRAGDGGHGAVLAMPPAPSADAAKPRGRFNRGEKKSKKVSYKRNYDGSVALPTGGHGGDVVVYADEAEETLLRFHEKARYCAKRGGNVGAAGGTLSSRMHSGFAGETLRIPVPVGTXVKRKKGAVLAELAHHCDEVLVARGDRGGSVLMMCLRYRGGKA

SEQ ID NO: 83946 - DNA, 875 bp, Zea mays
  misc_feature: Ceres CLONE 1569906
ggagctccccgcggtggcggccgctctagaactagtggatcccccgggctgcaggaattcgtctcacccctagaaaaaccccctggccccctccctctccttcctcacatcttccttcgtcagccgcagatgcgccagcatctctcccacgggcaggaggaggaggagcgagaggcacagtgacagacagagagagagcgcgcgcggggggagcccagcacagcacctacactagctagccaccggccaccaccaccaccaccaccgaccgaatcgggtgcgcgcggcgcgctgctcgtcagctccggccggccggccgctttataaagccacccacccagccccgcccgatcgccatcgccatacccccgcctccgtccacggacacacacccgccttgccagccggcaccctcccggcctcccccacctgtgtcctccggcctcgccgccgcaaaacccgccgcgcaggccggttgctccgattgggagtgccaatcggagccaacagcgagggaagcacatgctgccgttcgtcctagagttcctcattgatgtcgcctgtgatcagtgagatcctcctctcggggtttatgatcaaactcacactccggcgccgcacccacctggtccagtccttctccggcgccttcctcctactgggtctatgtctttcccatgaaccacccgccccccctcttaggcaccgccccttttttttcccaatccctccctcctcccttctttcccctttccatttagggaagcaattttaccgggccccccctcttttttctcccggcgggtaagagtttcttggccctttcgagggagagcgcccgttttttaaaaggccggtttcccccctaataacct

SEQ ID NO: 83947 - DNA, 949 bp, Zea mays
  misc_feature: Ceres CLONE 1569907
  misc_feature: Encodes the peptide sequence at SEQ ID NO. 83948
  misc_feature (685)..(685): n is a, c, t, g, unknown, or other
  misc_feature (856)..(856): n is a, c, t, g, unknown, or other
  misc_feature (858)..(858): n is a, c, t, g, unknown, or other
  misc_feature (882)..(882): n is a, c, t, g, unknown, or other
  misc_feature (890)..(890): n is a, c, t, g, unknown, or other
ctggagctccccgcggtggcggccgctctagaactagtggatcccccgggctgcaggaattcgtctcacccctagaaaaaaactccctcgattccctctccctattcgcgttccccacttccgttcgccgccgacaccgcgtgcgctctctccccccctccgtctctgtgtgcgacgactgggtgggctaccgctgccgccctacccatgtgctgaggcttctgcctacctcttcgccggcgaagagcgcccagcagatccgtcctcgcttccacgctgcagttgaagatttgatcagctatcgccttcgatgcagttgaatatttgatcagctattgacttcgctgctggcctgttttctcctttggagaccaaagaagccatggcgggccgggaggagagatatgtgaggtttcatgactggaaatcagagcaatctgtttctgttatttcagatagggtagtatcagaaaaagggcataacatctttggcttgttaaaggacagaacagcaggagccttttcattcctggggaactcttcacattctgaagccctaaacaaattaggcctaggggagaagtcaaaaacaaaagttcttgatcctcaagggccatttttgcagagatggaacaagatatttgtgatatcatgtctttttgcagtttttgtgggaccattgttnctgtatgtcccagtaattgatggtggcaacaactgcctgtacttgtactagaagtagagacacagcaagtatcctgcgcttttcacagatatcttctatttctccatatactgttcagttcagaaaggctttattgctcccctctctagatggtcggtcggggtgcctggntnaggaccatttgcatagcaagcgantctatcancattggtcctggtggatttcttacggtcgcccctccctcagtgtttgtgttggtgtgct

SEQ ID NO: 83948 - protein, 117 aa, Zea mays
  misc_feature: Ceres CLONE 1569907
  misc_feature (101)..(101): Xaa is any aa, unknown, or other
MAGREERYVRFHDWKSEQSVSVISDRVVSEKGHNIFGLLKDRTAGAFSFLGNSSHSEALNKLGLGEKSKTKVLDPQGPFLQRWNKIFVISCLFAVFVGPLXLYVPVIDGGNNCLYLY

SEQ ID NO: 83949 - DNA, 914 bp, Zea mays
  misc_feature: Ceres CLONE 1569909
  misc_feature: Encodes the peptide sequence at SEQ ID NO. 83950
gcggtggcggccgctctagaactagtggatcccccgggctgcaggaattcgtctcacccctagaaaaagcgatctgctgcggtggccgctgccggcgccgtccatccccaccgcacaccaccgcctccaccacgccaccgactccgcctctcgctcccccctcgccgcgccgcccgaacgccacgatgcgtcacctcctcctctcccgcttcctccgccgcggtggcggcagcggcatccccaacggccactaccaccacctccccctcctccgcgccctctcctcctccccctccccggtctcctcggacgcagagctccgcaagtacgcgggctacgcgctgcttcttctcggctgcggcgccgcgacctactactccttcccgttccccgccgacgcgctgcacaagaaggccgtgccattccggtacgcgccgctgccggaggacctccacgccgtctccaactggagcggcacgcacgaggtccacgcccgcgtcctgctccagccggactcgctcccggccctcgagggcgcgctcgccgccgcgcacaaggagcgccgcaagctcaggcccctcggctccggcctgtcccccaatgggatcgcgctctcccgcgctgggatggtcaacctcgcgctcttgggacaggtgctcgacgtcgacgcctagaataaaaacgtcacggtgcaagctgggatacgggtcgcggagctcgtacacccgcttcgggaaacagggcctcacgctgcagaactttgcggccattcgggagcacaagtcggaagggttcactcaggttggggcccatgggacgggggcaaaattacccccgtgtgtgagagaaagccatttggattgaaaatgggttcccctggccaaggggaaaataaaccgtgccaaggaagaaga

SEQ ID NO: 83950 - protein, 162 aa, Zea mays
  misc_feature: Ceres CLONE 1569909
  misc_feature: SWISSPROT Homolog: EC 1.1.3.8 L-gulonolactone oxidase
MRHLLLSRFLRRGGGSGIPNGHYHHLPLLRALSSSPSPVSSDAELRKYAGYALLLLGCGAATYYSFPFPADALHKKAVPFRYAPLPEDLHAVSNWSGTHEVHARVLLQPDSLPALEGALAAAHKERRKLRPLGSGLSPNGIALSRAGMVNLALLGQVLDVDA

SEQ ID NO: 83951 - DNA, 839 bp, Zea mays
  misc_feature: Ceres CLONE 1569910
  misc_feature: Encodes the peptide sequence at SEQ ID NO. 83952
gagctccccgcggtggcggccgctctagaactagtggatcccccgggctgcaggaattcgtctcacccctagaaaaaacacgcgctcctctctcgccgtcgccaaccatcgccgcctcgcgtccggacccgccgttcctccgaggaaatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacagtcgacccaacagctccagaatttctgccactcccatctttttgagaatgctttccaaggagtaccaaagaatcaagtgaaatcatccacgaggaatcaggtcatgtccctcaggttccattccggagagtccatttgactggagatcagaggcactttgatacatatgacaccagcggtcctcaaaatataagcccaagggatgggactcccaagattaggaaaggatgggattgataggagggaaaaacttgggtagtccctcggtaccccaaaatggaatatgctaaaacgggaattgtaacaaaggaaatgttaacctgggccgaccgggaaaccctaagtcctgaaatttttccgaacaaaaatttccccctggaaaaaacccataatttctttcccaaagaaggggccctgggaatttgaaacccttgatttttgtgaaaaaaaacttcttttgaaggggg

SEQ ID NO: 83952 - protein, 89 aa, Zea mays
  misc_feature: Ceres CLONE 1569910
MAALQPSFSPAMTLKSSCSALKFPKTALLSGFGGIPRLQDAQDRNTSVAYLIPKAASVTDQSIAEPPKTKQNRHTVDPTAPEFLPLPSF

SEQ ID NO: 83953 - DNA, 872 bp, Zea mays
  misc_feature: Ceres CLONE 1569912
  misc_feature: Encodes the peptide sequence at SEQ ID NO. 83954
acccgcggtggcggccgctctagaactagtggatcccccgggctgcaggaattcgtctcacccctagaaaaaaggctcacaatacccacctccatttagctactactactccctcgctgtcttccccaaccaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggtgggggcagggggcggcgcccgaggtgacggcgccgcaggaacccacattgccagccaccggctccggcgctaccggcgcagcggcggtcggagtcaactccaactccgtgctggtggcgctgctggattcgcactacacggagctggcggaactggtggagaaagcgctgctcctgcagacgctggaggacgccgtcgggaagcacaacgtcaccatcttcgcgccccggaacaaggcgctggagcggggactgggacccggagttcaagcgctttctgctggagccgcgcaaacctcaggtcgctgcaggggctggtgcttcaaacaggtcttccctttgggcctggccttccgaattccggggcccgcggggtccccaccccacgctgttttcgggaaaagagggtcaaaattcccccccccctcccggggcccgggaatggggcgtttgggcaaacaccgccctttacacggccccggggagagccctgggttacagggcccccaaaggggtggtatttccccgggggtattagaggggccttccttcgtgggcggggcgttttccggggg

SEQ ID NO: 83954 - protein, 44 aa, Zea mays
  misc_feature: Ceres CLONE 1569912
MGRLGKHRPLHGPGESPGLQGPQRGGISPGVLEGPSFVGGAFSG

SEQ ID NO: 83955 - DNA, 892 bp, Zea mays
  misc_feature: Ceres CLONE 1569914
  misc_feature: Encodes the peptide sequence at SEQ ID NO. 83956
  misc_feature (769)..(769): n is a, c, t, g, unknown, or other
  misc_feature (772)..(772): n is a, c, t, g, unknown, or other
  misc_feature (793)..(793): n is a, c, t, g, unknown, or other
  misc_feature (871)..(871): n is a, c, t, g, unknown, or other
ggagctcaccgcggtggcggccgctctagaactagtggatcccccgggctgcaggaattcgtctcacccctagaaaaaaccccctttccccattcacactcgctcccatatccactgcccccattgccattgctgcccccaaccccaagctccagatctcggtcccaagacctggaatggctgaatccatgcccccaccactatcctcactccgctcgcactcccctgcattgctataaatcccactgcatcttggctctggcccatctaatccgccaaggaaccatggcccgagctcccaaatccgccggcattgccctctccctcctgctgctggcagccgccgccaaagcctcggcctttcctctcctcaactcctcgcaccccgaccccgctgccgtcgtcgccgacttgcacagcaaggtggcgacgtcgcggcggcggatgcaggagtccggcggcggcggcggcggcgggtgcttgacgggcaacccaatcgacgactgctggcggtgcgcggggacggactggcggcaggaccggcagcggctggcggactgcggcatcgggttcgggcgcaacgcgctgggcggcaagggcgggccggtgtacgtggtgacggacccgtcggaccgcgaccccgtgaacccgtcccctggcacgctccggcacgccgccatccaggaaggcccgctgtggatcgtgttcgcgtcggacatggccatccggctgaaacgagagctgctggtgaacagctacaagacgatcnacnggcgcggcgcgcgcgtgcacntgggcggcggcggcgcgtgcatcacgctgcagtacgtgtcgaacgtgatcatcaacaacgtgcacgtgcacgactgcntgccccgcggtaacgccgaca

SEQ ID NO: 83956 - protein, 202 aa, Zea mays
  misc_feature: Ceres CLONE 1569914
  misc_feature: SWISSPROT Homolog: EC 4.2.2.2 Pectate lyase
  misc_feature (162)..(162): Xaa is any aa, unknown, or other
  misc_feature (163)..(163): Xaa is any aa, unknown, or other
  misc_feature (170)..(170): Xaa is any aa, unknown, or other
  misc_feature (196)..(196): Xaa is any aa, unknown, or other
MARAPKSAGIALSLLLLAAAAKASAFPLLNSSHPDPAAVVADLHSKVATSRRRMQESGGGGGGGCLTGNPIDDCWRCAGTDWRQDRQRLADCGIGFGRNALGGKGGPVYVVTDPSDRDPVNPSPGTLRHAAIQEGPLWIVFASDMAIRLKRELLVNSYKTIXXRGARVHXGGGGACITLQYVSNVIINNVHVHDCXPRGNAD

SEQ ID NO: 83957 - DNA, 1202 bp, Zea mays
  misc_feature: Ceres CLONE 1569916
  misc_feature (1182)..(1182): n is a, c, t, g, unknown, or other
  misc_feature (1202)..(1202): n is a, c, t, g, unknown, or other
acttctctatcttttttttctcttttcgcacccttgttatattttttttatttttttttaagctggactcccgcggtggcggccgctctagaactagtggacccccgggctgcaggattcgtctcaccccctagaaaaaacaatctaacgtactccaggctccagctgatttgtccacgcggcatggcgacggccagcgtccgcttcaagctgtcctctgtcccggtcgactgcttatcggccccccgacaaccccttctgggcattgggccctttttcccggggttttcccccaggaaatccccgtaataaaaatgggttttcttggggcacgttgtgggagcggagaacataaaaatttttttgctagtttttgacaagggggtcccccaatgggggggcccatggtttggcgggggacgtgccccttcatcctttttgacaaataaaaaaaaaataacattcctccaccgtactacttccctttccttggagtgggggcgttgtggttgtccccccccccccacttaagtgggggggtgagaaaataaaattaattgtccctctgcatattattataacaccgcgactgtttgaaagcaaaccatctacttgtatgtgatcggggtttaatcgactaagctgccttaagtgtggatttgtctcacttttctttcttacttattatcattcagcaaatatccgctgtagcatctctcttttctctctaccatacgcactcgctcctcagacagaatctagctcttatgtcttatgtctactactaaatgcgaaaatagtcttatatgaatgagggagcacaaatatggaagcacattgaatatgtgactggagttgtggtttttatatgtttgacgaggtatatcatccttataattcagacagctgtgagtagacacctacttgactcatagaacatgatcgacgtatagttatatgatgagttgagagatggagatgttaattagtatggagttgagtacagttgtatgtgtcttccaacgacgtcttcctcattcgtatcgctctatactcgtacgctgcttcgcattgttctggttcggtgatgtattagtaatgtaggaatttcttgtttaattttttttaaaatatatatgcgtggtaatctgggttatatgcagtgatacatgtattagacgnctctatcttatgctagtatn

SEQ ID NO: 83958 - DNA, 955 bp, Zea mays
  misc_feature: Ceres CLONE 1569918
ggagctccccgcggtggcggccgctctagaactagtggatcccccgggctgcaggaattcgtctcacccctagaaaaaccgctccgctctcccttgtcgagttctcagcaccggccgatccatcctcctccgcctccctcggttcggcctctggcctgcacaccatgaactctcgcttccggagcctctggagagccatggctggggctttgcagccgccgtgccgcctcggagctgccgcgtgtagcttgctcgctaagcagcagctatagtagctgagcgagtgcgtccatcgatcggagtcgtccacctccgtctccctttgcgattcggcgtcgtgaactcgtgttcttgagcgtgggggcaaggggcagagcaacaaggagacacttcttcttcttctttacaacaaataagaaagcaacggcaatggagggagctggtctgcagtgacagtgacacgagccatggatcccgagccattcgtgcggctctcagttgggcagctcggtctgaagctccccggcgggtacgctagcaaggctgcctggccggctctgcgactgcgagatccggctgggcgggttccccggtgcagaccgctcccgtgccgcttgttcactccccggggttaacctcgacccattcaccaacgcggcgttttctccctcgaggaatcgactccagggcctggcgggcccggggtgttccggtccccccggcttcctggccttgagtcccgggtataactgggccgtttggggcttcacccgtggggccccccccgcggaaaaacgcctggttgggttttcaggtggaccccccttcccgaaaggggggaaggaaccccgggttgtgccattggggggggggcccccaaaggggggggcaccgggaacccccccggggggaagtggggggtatccccctctttctctctttggaaaaaaaaccc

SEQ ID NO: 83959 - DNA, 1050 bp, Zea mays
  misc_feature: Ceres CLONE 1569919
  misc_feature: Encodes the peptide sequence at SEQ ID NO. 83960
  misc_feature (422)..(422): n is a, c, t, g, unknown, or other
  misc_feature (426)..(426): n is a, c, t, g, unknown, or other
  misc_feature (498)..(498): n is a, c, t, g, unknown, or other
  misc_feature (841)..(841): n is a, c, t, g, unknown, or other
  misc_feature (866)..(866): n is a, c, t, g, unknown, or other
  misc_feature (867)..(867): n is a, c, t, g, unknown, or other
  misc_feature (869)..(869): n is a, c, t, g, unknown, or other
  misc_feature (870)..(870): n is a, c, t, g, unknown, or other
  misc_feature (886)..(886): n is a, c, t, g, unknown, or other
  misc_feature (889)..(889): n is a, c, t, g, unknown, or other
  misc_feature (898)..(898): n is a, c, t, g, unknown, or other
  misc_feature (911)..(911): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
tcaccgcggtggcggccgctctagaactagtggatcccccgggctgcaggaattcgtctcacccctagaaaagtttcagcgagcgagaccgaggggtagagaaagagcggtgcttagccacccatgtcgctgcgtcccagcgagcgggtcgaggtacggcggaacccctaccaggtggcggttgacgccgaagcaggggaggcgccgccgccacgcaaatacaggtgggagaacctccagaagagccgccgagaggagagcctcctcaagaggcgccgtgaggggctccaagcccaaggtccccgccccctcccccctcggggcgagaaaaaaccttggaagccttcccaccttatgggttagtgggggttattttcggatgagaatataaaccccccccctgggccccccccccttgggtnaccnaaaattttttttttttataaaaaggggggttccccccctctctggaaaaaatttttttcaaaaaacaggggntgtgtgtgcccacaaattttttgcgagggtcgtttctccccccccaagggaggatgtattccccccccctcttcccccccaaaagaagtatagaagctgtggtgggctttcctccccacacaacaaaatttttttcttggcgggggcccttggcgcaccagaaaaaaaaataaaagagagggagggtgtatttgtaggacttgagggagggggggtcttcgtcgtcccccaccaatttggagggggggcgcctttcgggggggggtgttgggtcccccctcttgctgtaattagcggagatcaagaactatcacagtggaccaacagtgggacagaccgtganacagggacgcgtaggagtggtgcanncnnacagtcgtctggtgcnccnagaggagtngtaacgtcgaccngnnnnnnnnnnnnnntttttttcagcctaatggtgggttttgagattatatcctttctcttgtcccctccgtataaagagagaagaatactaacctcctcctctcctactcgtggggagggaagcctccttcctcgatt

SEQ ID NO: 83960 - protein, 79 aa, Zea mays
  misc_feature: Ceres CLONE 1569919
MSLRPSERVEVRRNPYQVAVDAEAGEAPPPRKYRWENLQKSRREESLLKRRREGLQAQGPRPLPPRGEKKPWKPSHLMG

SEQ ID NO: 83961 - DNA, 967 bp, Zea mays
  misc_feature: Ceres CLONE 1569921
  misc_feature: Encodes the peptide sequence at SEQ ID NO. 83962
  misc_feature (768)..(768): n is a, c, t, g, unknown, or other
  misc_feature (769)..(769): n is a, c, t, g, unknown, or other
  misc_feature (881)..(881): n is a, c, t, g, unknown, or other
  misc_feature (967)..(967): n is a, c, t, g, unknown, or other
ctccccgcggtggcggccgctctagaactagtggatcccccgggctgcaggaattcgtctcacccctagaaaaaaccgctgaccatggactcgccaccgctccaacccacggtgttctccctgatacttgctctcgttctagtgttatacttggcgctccggcgccgcggcggcggcaagaaccggagctacccgccagtggctggcaccgtgctgcaccagctgttcaacttcggccgcctgatggagtaccaaaccgcgctctcccgcaggtaccgtaccttccgcatgcttaccccgacctgcagctacatctacaccgtggagcccgcgaacgtggagtacatcctcaagaccaacttcggcaactacggcaaggggagcacgctgcacgagctgagcgaggacctcctcggcgacggcatcttcaacgtggacggcgccaagtggcggcaccagcggaaggtcgccagccacgagttctccacgcgggtgctgcgcgactacagcaccggcgtgttccgcgacacggcggcggagctcgcgggcatcgtggccgccgccgccgccgcgggggagaagctggacatgcaggagctgctgatgcggtcgacgctggactccatcttcaaggtcgggttcggggtcaacctgggcgtgctgtccgggtccagcgaggaatgcgccgcgttcgcaaggcgttcgacgacgccagcgagcaggtgctgcaccgcttcttgggaccgttctggaaaggccagaagtccnntgaactgtcgtcggaggcggccatgaagcgctcgctcccgcacatcaacgacttcgtctacgccgtcgtcgacaggaagatccagcagatgggaagaaacaacaggtatttngccagaaagaagactcctgtcaaggttcctggtggaacgggaaagcatcccgctggcttgacaacagtacctgcgggactcatccn

SEQ ID NO: 83962 - protein, 236 aa, Zea mays
  misc_feature: Ceres CLONE 1569921
  misc_feature: SWISSPROT Homolog: EC 1.14.14.1 Unspecific monooxygenase
  misc_feature (229)..(229): Xaa is any aa, unknown, or other
MDSPPLQPTVFSLILALVLVLYLALRRRGGGKNRSYPPVAGTVLHQLFNFGRLMEYQTALSRRYRTFRMLTPTCSYIYTVEPANVEYILKTNFGNYGKGSTLHELSEDLLGDGIFNVDGAKWRHQRKVASHEFSTRVLRDYSTGVFRDTAAELAGIVAAAAAAGEKLDMQELLMRSTLDSIFKVGFGVNLGVLSGSSEECAAFARRSTTPASRCCTASWDRSGKARSPXNCRRRRP

SEQ ID NO: 83963 - DNA, 1333 bp, Zea mays
  misc_feature: Ceres CLONE 1569923
  misc_feature: Pfam Name: SRP54_N Pfam Description: SRP54-type protein, helical bundle domain
  misc_feature (163)..(163): n is a, c, t, g, unknown, or other
  misc_feature (185)..(185): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (967)..(967): n is a, c, t, g, unknown, or other
  misc_feature (1005)..(1005): n is a, c, t, g, unknown, or other
  misc_feature (1008)..(1008): n is a, c, t, g, unknown, or other
  misc_feature (1240)..(1240): n is a, c, t, g, unknown, or other
gtaccaatttaccgagtcggttaatgcgatttagaaaatgatggaaaggatctatagtagagaagggaggggcggagagataatggtgggtttttgattgtgttgtgtgttgtttcgtatgtgtgatggtgtgaatgttgatgttgtgggctggtgggtgggntttgttttgggggctgtggggntnnnnaacaatnnnnnnnntaaatttgtaactccacctcggtggcgagccgctctaaaactagtggatcccccggagctgcaagaattcgtctcacccctagaaaaaattccacacccatcagctctcgtatccgcagcgcccggaatggcggcaccctcccacgtcctcccgttcctgtcccccgccagcgggtgtgccgcctcctccgcccgcgcccactctggctaccgcgctggtctcctgcgctgctcggccgcggccggccaggcgggcttcttcactcgcctcggtcgcctcataaaggagaaggccaagagcgacgtggagaagctcttctccggcttctccaagacccgcgagaacctctctgtcgtcgacgagctccttacttactggaaatttgccgaacaccgaccgcgttcctcgaccaacctcaaggaaagcccttcctggtcctccgaatttcgggccccaaaaaacccaattcccggaaacgtccaaaaaccccccccccaaagaaaaaaaaccccaaaccggcaaaaccccaaaatctctggcccccccaaaaaaaaaaaaacccccccccctaaaaaaaaagttcccaaccccctgaaaaaaccgcccctaaaaaaaaaaacaaaagggcggggaaaaaaacaccccaaaaaaccccccaaaaatctctccggaaaatattcccaagaaaaaaaccccccggggccgttgtcaacaccccccacaaaaaaaaccccccggggggggaaaaaaaataaaaaaatntgcccccccccgggggggggctaaaaaaaaaaaaaagnggncccccccccctccccttatcctatgggggaaaaaaaaaaaaaccctttgggcctctttaaaaaaaagaaagagtttttttaattttaaaaaaaaaaccccccaagaggggggggtgccccccacaaaaaaagaggatttttttttttataaagaagcgccccacaacacaaaaccagggggagaaaaaaaaaaacccccccccctccaaaaaaaaaaaaaagggacgttcgncccttccccctcccttaagatatcaccaaccccaccccaattaaaaaatcaaaaatttttttttgcgcgcccggcccccaaaaaaaaaaaaaa

SEQ ID NO: 83964 - DNA, 999 bp, Zea mays
  misc_feature: Ceres CLONE 1569924
  misc_feature: Encodes the peptide sequence at SEQ ID NO. 83965
  misc_feature (180)..(180): n is a, c, t, g, unknown, or other
gagctccccgcggtggcggccgctctagaactagtggatcccccgggctgcaggaattcgtctcacccctagaaaaaaggcacaagcagagcagaagcagacatggccaccattccgaccaccgattctggcctcgtcctcagttcctccgctctcctccggaggactaggagggccgcnctcatccgatcactcgccagggctggccagcccctttagcccggcgtcgcccgcagctcctcgtgcgtgcctctgccaggagatcgcctttgaccggggtccagagccgcccttcaggccgcgtccagaagctcgctccgccgtcggggttcccctcgaacccaaaggaaggaaatttttctttgaataaatttggaaacccccaaagggggtccatgaaccccaccccccgttgccccgccccttttagaattttcttggtccccccggggaaaaaggcccggggcctctcctctttattcccggaaaatttttgtaaaaaaagaaaaaaaaaaaccccctcgggtgggggggggagggaaaaacccccaacagggcgcccctgtttttttctctcccgggggggggggagtaaaataacaaaaattgtgtggggccggtgtgttgggggcacgcgttttattttttctgttgggggggggggaatataaataccatcgctcgccctctctgagccaaagggggaggggtgtctcttttctaataaatattttttttccctaaaaataatatttggtggggcggggcgctcctctttgggtgaaaaaaaaattattttagcgccccttccccccgggggcgggcggcgggggggggtattttaaaaaaaaaagagtgcggccccgccttcctattttggtaggaagaaaagaaaatatttatttatttttttgggagaaaaaataaagcggccacaacactcttctttatataaagggggggcccccactatgggtagttttcccttccccataaaag

SEQ ID NO: 83965 - protein, 38 aa, Zea mays
  misc_feature: Ceres CLONE 1569924
MATIPTTDSGLVLSSSALLRRTRRAALIRSLARAGQPL

SEQ ID NO: 83966 - DNA, 929 bp, Zea mays
  misc_feature: Ceres CLONE 1569925
  misc_feature: Encodes the peptide sequence at SEQ ID NO. 83967
  misc_feature (929)..(929): n is a, c, t, g, unknown, or other
ccccgcggtggcggccgctctagaactagtggatcccccgggctgcaggaattcgtctcacccctagaaaaacccagcacgtctcgtctccctcccaaaaaaaaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctctaccagcacgagggcaacttcctggcgcagcagcggctcgccgtcgtctccccgctgtccggcgaccagccgctgttcaacgaggaccgcaccgtcgtggtggtggccaatggagagatctacaaccacaagaacgtccggaagcagttcaccggcacacacaacttcagcacgggcagtgactgcgaggtcatcatccccctgtacgagaagtacggcgagaacttcgtggacatgctggacggggtgttcgcgttcgtgctctacgacacccgcgacaggaccttacgtggcggcgcgcgacgccatcggcgtcaacccgctctaacatcggctggggcagtgaacggttccgtctggatcgcgtccgagatgaaaggcgctgaacgaaggactgcgtgcgcttcgagatctttcctggccgggccacctctactccagcgccagcggccgggttccggcgggggtacaccccgcactggttccgggagcaggtgcccccggatgccgttacagccggctcggtcctcagagagggccttccaaaaaggccggtcatcaagaaggttccatgaactgaacatcccgtttcgggggtctttcttcttccgggcggccatcaaattcctttgcttgggtcccctcccagttcaccaaaggagccn

SEQ ID NO: 83967 - protein, 259 aa, Zea mays
  misc_feature: Ceres CLONE 1569925
  misc_feature (2)..(163): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIIPLYEKYGENFVDMLDGVFAFVLYDTRDRTLRGGARRHRRQPALTSAGAVNGSVWIASEMKGAERRTACASRSFLAGPPLLQRQRPGSGGGTPRTGSGSRCPRMPLQPARSSERAFQKGRSSRRFHELNIPFRGSFFFRAAIKFLCLGPLPVHQRS

SEQ ID NO: 83968 - DNA, 796 bp, Zea mays
  misc_feature: Ceres CLONE 1569926
  misc_feature (159)..(159): n is a, c, t, g, unknown, or other
  misc_feature (692)..(692): n is a, c, t, g, unknown, or other
gcggtggcggccgctctagaatagtggatcccccgggctgcaggaattcgtctcacccctagaaaaaattcgcatctctggatccccctcccctcgccctctcccattacccgccgccgccgccgcctcgcgcccgcgaccctacccgggcctcccacnttcgatcccggccccggattccggatttcgtcactgtatcgcgcgcgcggtgggaagacgcgatgctcgtggcggggctctcgcccgcggggtgatctctcctacggtagcctccgcgtgcaagcggagatccgtccaattgggcctaactattccttccttcgatttccccgggttttttggggaccccctgaaccaaaggttggcttttcccccccttcccgccccccaatttaaatttctccccccggggccccggggaggggggccccctcttcccccccccctgtttttttcccggggggttattttcccccccaaaacccgggggggcgttgggttttaaaaaaggggggggggtttcctcccccccccccccctttttttgtggggcctttttgggggggggaaaaaggggtttttttttgggggggccctcctcccagggggggggggggaaaaattttttggggggtttcctccctcaaaaagggggggccccccccccctttttttagggggtgtttttttgnggacacccccccgggggggggtgttgaaaaaaaaaattatttttttttttgggggggggggggggggggggggtggtttttttctttcaccccccctccccttt

SEQ ID NO: 83969 - DNA, 945 bp, Zea mays
  misc_feature: Ceres CLONE 1569927
  misc_feature: Translation starting site: 214
ctcaccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatgggggccctcgggggtcggcaagtccaccctgctcgacgccctcgtcgggcgcctctgcgccaacgccttcctcttcggcaacgtgctcctcaacggccgcaaaggcaagctctccttctgcgccgcggcgtacgtgacgcaagacgaacacctgatcgggacgctgacagtgcgcaaaagatctgctacttggcgctgctgcggctgccggacaaaatgccgcggaagaacaacgcgcgctgggggaggggaccatcttcaaaatggggttgcagaatgcccctaaccgtcatgggaaatggaacccccgggggcacgggggcgaaaagcccccgtcacatcggctcgagtattaatggcccggccccctttctgaagaaccacaaagggcccaaagatgta

SEQ ID NO: 83970 - DNA, 964 bp, Zea mays
  misc_feature: Ceres CLONE 1569931
  misc_feature: Encodes the peptide sequence at SEQ ID NO. 83971
  misc_feature (946)..(946): n is a, c, t, g, unknown, or other
ggagctccccgcggtggcggccgctctagaactagtggatcccccgggctgcaggaattcgtctcacccctagaaaaacacacaaaaaacctcaccttctcattccttcaagcgtcagcagcaaaaccagagcttcccttcaacccagcaagaaaaccaagcgacctagttagcgcagcggcagttatttgtgcagaccccgatctgactgagagaggcaggcggcagctcgatcggcagtgaccgcgcgcgagccatgggactggcctggatggtggcggcggccgtcgcggccgtgctggcgtcgtgggcgttcaacgcgctggttcacctcgtgtggcgtccttacgccatcacccggaggctccgcgcgcagggcgtgcgcgggccgccctacacgttcttcaccgggagcctcggcgagatcaagcggctccgcgccgagggcgccgccgtcacgctggacgtcgacgaccacgacttcatccccatggtgcagccccatctccgcaaatggatcgcgctctacgggcggacgttcgtgtactggaccggcgcgaggccgaacgtgtgcgtggcagacgtgaacgtggtcaggcaggtgctcttcgaccgcaccgggctctaccccaagaacctcatcaacccgcacatctcccgcctgctcggcaagggcctcgtcctcaccgacggcgacgactggaagcgccaccgcaaggtcgtccacccggcctttcacatggacaaagctcagctgatgacggcgaacatgtccgactgcacccgctcgatgatctccgagtgggagcacagctgcagaaaggagatcagagcgggcgcggcgggcacgtcacgtggaagtcgagctgagcagcgcctcgaagaagctcacgcgagtcatctcgcacacgcgttcgggacagctacacgaagggaatcgagtctnctggcacgagggagctga

SEQ ID NO: 83971 - protein, 235 aa, Zea mays
  misc_feature: Ceres CLONE 1569931
  misc_feature: SWISSPROT Homolog: EC 1.3.3.9 Secologanin synthase
MGLAWMVAAAVAAVLASWAFNALVHLVWRPYAITRRLRAQGVRGPPYTFFTGSLGEIKRLRAEGAAVTLDVDDHDFIPMVQPHLRKWIALYGRTFVYWTGARPNVCVADVNVVRQVLFDRTGLYPKNLINPHISRLLGKGLVLTDGDDWKRHRKVVHPAFHMDKAQLMTANMSDCTRSMISEWEHSCRKEIRAGAAGTSRGSRAEQRLEEAHASHLAHAFGTATRRESSLLARGS

SEQ ID NO: 83972 - DNA, 849 bp, Zea mays
  misc_feature: Ceres CLONE 1569932
  misc_feature: Encodes the peptide sequence at SEQ ID NO. 83973
ctccccgcggtggcggccgctctagaactagtggatcccccgggctgcaggaattcgtctcacccctagaaaaagaccgcagccagactactagactcggcatctccgccgctcctctctccacccggcgcgcgcgcacacacagcacagacacctacagtcaccacacgcgccatggccacgcactcggtcgccgccgcgcacgccaccatcgccgcgcgcgcgggcgccgccggggcgccggccccggccgagcgcctgggcttccgccgcctgggctcgcccgccggcggcctgcgctccgcccgccgcgcgcagctcgcggccgcctcccgccgccatcgcgtcgtgcgcgccgccgccgtcgagacgctccagggcaaggccgccaccggtgagctgctcgagaagtcggtcaacacgatccggttcctggccatcgacgccgtcgagaaggccaactccggccacccgggcctccccatgggctgcgcgcccatgggccacgtcctctacgacgaggtcatgcgctacaaccccaagaacccctactggttcaaccgcgaccgcttcgtcctctccgccggccacggctgcatgctccagtacgccctcctccacctcgccggttacgacagcgttaaggaggaggacttgaagcagttcaggcaatggggaagcagaacaccgggccaccctgagaactttgagactccaggaggtgaagttaccaccgggccctcttggtcagggtatcgcccattgccgtggggttggcactttgctggaaaagcacctgggttgcccgcttcaaccaggcctggacagtggagattcgtccaaccacta

SEQ ID NO: 83973 - protein, 225 aa, Zea mays
  misc_feature: Ceres CLONE 1569932
  misc_feature (76)..(224): Pfam Name: Transketolase_N Pfam Description: Transketolase, thiamine diphosphate binding domain
  misc_feature: SWISSPROT Homolog: EC 2.2.1.1 Transketolase
MATHSVAAAHATIAARAGAAGAPAPAERLGFRRLGSPAGGLRSARRAQLAAASRRHRVVRAAAVETLQGKAATGELLEKSVNTIRFLAIDAVEKANSGHPGLPMGCAPMGHVLYDEVMRYNPKNPYWFNRDRFVLSAGHGCMLQYALLHLAGYDSVKEEDLKQFRQWGSRTPGHPENFETPGGEVTTGPSWSGYRPLPWGWHFAGKAPGLPASTRPGQWRFVQPL

SEQ ID NO: 83974 - DNA, 861 bp, Zea mays
  misc_feature: Ceres CLONE 1569933
acccgcggtggcggccgctctagaactagtggatcccccgggctgcaggaattcgtctcacccctagaaaaactttccacctccccccaccccgctgtgctcatccatcgaccgcgacgagcccccgcccgccgattcgactacgtttattttttttatttcatttgatttgattgcaaagcaccgcagcagcaggaggaggggaagggagggatcgttggaccgtcgttcggctggatggtggaggcggttcgtcgatttgagggcaccgggtttcttggacctgcgtaaaaaacaccagccccatttccctctcggccggcggatggacgcgagggaggtgtgaagcctggtcgctaactgatgctcgtggagagattcggaggagaggagcgcgccgtgcggaggcggtggaggaggaagcgccgacgatttggacagcgcagcgactgaaggggagcagcaggcggacgaggagcgagccgccaggaggacgacggccgccgccgccgccgccgccatgggcgagtcgctgctcaccgcgctctccatggacaccgccacagcccaccacccgcaccagggcccctccacctttcctctccatggagaaccgcctcccacgacgactttcgacctctttcctccaagccacaaggggccctttccgccgcttgccttactggccgcgggcggttcggccccccctggacatcaaacttttcccctaggccgggggaacacggttgtcgcgcaaccttgtggggagacagcccgggaagcccaaaggtttgaaacaaggcttaagaaagatcgggatcctcggaggggtgtgggcgaggcgagttagtgatctgcggg

SEQ ID NO: 83975 - DNA, 930 bp, Zea mays
  misc_feature: Ceres CLONE 1569934
  misc_feature: Encodes the peptide sequence at SEQ ID NO. 83976
  misc_feature (749)..(749): n is a, c, t, g, unknown, or other
  misc_feature (882)..(882): n is a, c, t, g, unknown, or other
gcggtggcggccgctctagaactagtggatcccccgggctgcaggaattcgtctcacccctagaaaaaaatttatcttctccaacaaggtccgacatcaacaagtgattgctcgcggccccgcaagcgagagagaacttttcaacccaaacaaacagtccaatccaattcctagggcaatccggtgaacgtgtgcgtgtgtatatacatacacacggccgccgccgccgcaggcctcgctcctaccgccaccggactcccctttcgcgtccgcttctcttgttgttgctgtgctctcctgttaccgggacccggaggaaggcaggaaggaaggaaggaaggaaggcggggatggcggaggagacggtgcgggagctgcgcgcgagcttcgcggcggggcagacgcgcccggccgagtggcgggcggcgcagctcaaggggctcatccggatgatcgacgagaaggaagccgagatcagcgccgcgctccacgaggacctcgccaagccgcatatggagtccttcctccacgagatatcacttacaaagtcgtcgtgcaagtttgcgctcaaggggctcaagaactggatgaagcccgagaaggtacctgcggccataactacattcccgtcctccgcccaaatcgtgccggagcccctcggcgtcgtgctcatcatctcagcctggaactacctttcatactctctatcgacccagtcattggagcatcgctgctggaaaatgctgtgntctgaagcatcagaatagcggcagctacctcgtcactgtagcaagctgctacccgagatgttgacactcctgtattaaagtggtgaaggaagcgtccagaacaacgcactcttgaacaggaattggatagacntctaccaggtatgggactgttagactttgtgatgcagcgcggcaagct

SEQ ID NO: 83976 - protein, 138 aa, Zea mays
  misc_feature: Ceres CLONE 1569934
  misc_feature: SWISSPROT Homolog: EC 1.2.1.3 Aldehyde dehydrogenase (NAD(+))
  misc_feature (133)..(133): Xaa is any aa, unknown, or other
MAEETVRELRASFAAGQTRPAEWRAAQLKGLIRMIDEKEAEISAALHEDLAKPHMESFLHEISLTKSSCKFALKGLKNWMKPEKVPAAITTFPSSAQIVPEPLGVVLIISAWNYLSYSLSTQSLEHRCWKMLXSEASE

SEQ ID NO: 83977 - DNA, 854 bp, Zea mays
  misc_feature: Ceres CLONE 1569935
  misc_feature: Encodes the peptide sequence at SEQ ID NO. 83978
  misc_feature (766)..(766): n is a, c, t, g, unknown, or other
ggagctccccgcggtggcggccgctctagaactagtggatcccccgggctgcaggaattcgtctcacccctagaaaaactgcgcctccacagtccacactcaccgcgctcgccccctcacaacgaaacctagagagtcccgcgcgtgacatggcggacggcgcgggctcggcgtctggtctggtggagaagctcgcggagctttcaacgggcggcgccgggcagaatcctccgccggcgggtgaaggcggagaggagctgcagctctcgaagaacgcgaagaagagagaggagaagaggaagaagctggaagaggagcggaggctcaaggaggaagagaaaaagaacaaggctgctgctgctgctagtggaaagcctcagaaggcatctgctgctgacgatgatgacatggatcccactcaatactacgagaataggctcaagactcttgattcactcaaggccgcaggtgtaaacccctatccacataagtttccagttggcatctctgtagtggaatacattgagaagtacaagaccttgaacaacggggagaagcttacagatgcgacagaatgtttagctgggaggatcatgaacaagagaacatcatcatctaagctattcttttatgatctttatggtggtggcatgaaggttcaagtgatggctgatgccaggacctcagagttggatgaagctgaattctctaagtaccactcaagtgtgaagcggggtgatattgttggcatatgtggttatccagnaaaaaagcaccgtggggagcttagcgtgttcccgaagaaatttgccgtgctctctccatgtcttcatatgatgcctcgacagaaagtg

SEQ ID NO: 83978 - protein, 235 aa, Zea mays
  misc_feature: Ceres CLONE 1569935
  misc_feature (142)..(223): Pfam Name: tRNA_anti Pfam Description: OB-fold nucleic acid binding domain
  misc_feature: SWISSPROT Homolog: EC 6.1.1.6 Lysine--tRNA ligase
  misc_feature (206)..(206): Xaa is any aa, unknown, or other
MADGAGSASGLVEKLAELSTGGAGQNPPPAGEGGEELQLSKNAKKREEKRKKLEEERRLKEEEKKNKAAAAASGKPQKASAADDDDMDPTQYYENRLKTLDSLKAAGVNPYPHKFPVGISVVEYIEKYKTLNNGEKLTDATECLAGRIMNKRTSSSKLFFYDLYGGGMKVQVMADARTSELDEAEFSKYHSSVKRGDIVGICGYPXKKHRGELSVFPKKFAVLSPCLHMMPRQKV

SEQ ID NO: 83979 - DNA, 807 bp, Zea mays
  misc_feature: Ceres CLONE 1569937
  misc_feature: Encodes the peptide sequence at SEQ ID NO. 83980
ctggagctccccgcggtggcggccgctctagaactagtggatcccccgggctgcaggaattcgtctcacccctagaaaaatctcctccctcgctcggctcggctcccaccttcctccgttgcctcctcttccgcggccccgtcgatgggcttggctttaccagtggcgggttcccacacgggggctagacgccgccaccgctgaccccgtctacaccgaatcccccgcgcgatttaacccctcgcatcgctcgccgcctccgcttccatacaaccgcgcactccaaacgcgcacgcgctgttcgttcctcggccgctctctccaccccctccttctccgcccccaacagatctccgccggccgtgcggttccttaattcgccttctccgggactgtcggatctccgcggcggctgaggatgggcaactgctgcgtgacgccgaaagcagccgacgacgccggcggcggcaagaagcccaaggagctgaagcagaagaagggtaagaagccgaaccccttctcgatcgagtacaaccgttcggggcaggcgagcgcgccaaagctggtggtgctgcgggatcccacggggcgggacatcgcggcgcggtacgagctcggcgcggagctcgggcgcggcgagttcggggttacctacctctgcacagaccgcgcctcaggtgaagcgctggcctgcaagtccatctccaagaagaagctcccgcacgccgtcgacctcgaggagtgcgcgggggaaggtgtagatcatgcgccacctccctagcaccccaacatcgtcacgctcaggta

SEQ ID NO: 83980 - protein, 120 aa, Zea mays
  misc_feature: Ceres CLONE 1569937
  misc_feature: SWISSPROT Homolog: EC 2.7.11.1 Non-specific serine/threonine protein kinase
MGNCCVTPKAADDAGGGKKPKELKQKKGKKPNPFSIEYNRSGQASAPKLVVLRDPTGRDIAARYELGAELGRGEFGVTYLCTDRASGEALACKSISKKKLPHAVDLEECAGEGVDHAPPP

SEQ ID NO: 83981 - DNA, 832 bp, Zea mays
  misc_feature: Ceres CLONE 1569938
  misc_feature: Encodes the peptide sequence at SEQ ID NO. 83982
acccgcggtggcggccgctctagaactagtggatcccccgggctgcaggaattcgtctcacccctagaaaaaagcagcacagggggggagaaggggcgggcgctcgagtgaacctccactacactactccgcgtctccctcccctggctacgaggctataataacgagcgcggaagacggccggcggcgcacgcagccatgtccgcgcacctccgcctactctcggccgcccacgtctccgcgcccacacccacctccctccaccgcctccgtggccctcctccttctcctcccgcggcccgcctccggctgctgctgcgaccgccgcggctcggggggagccaggcgcgcttcgccggcgccgtccgctgctccggctcggcgtcggcgccggcggtcgcgcgggttggcgaggacagcgacgcggcggcgggcatatgggagcaggtgcgggatatcgtcgtgttcgccggccccgcgctagggctctggatctgcggtccgctcatgagcctcatcgacaccatggtcatcggccagacctccgcactccagctcgccgcgctagggcctgggacagtgttctgcgattacctaagctacatattcatgttcctctcggtcgcaacatccaacatggtggccacctccttagccaaaaaggatgaagaacttacacaacatcaagtgtctatgttactgtttcttgctcttgcttgtggcataggaatgtttttgttcaccaaggtgtttggtactcaagtattgactgcttttactggatctggggattatgaacttatttcttcggcccatacatatgcccagatat

SEQ ID NO: 83982 - protein, 211 aa, Zea mays
  misc_feature: Ceres CLONE 1569938
MSAHLRLLSAAHVSAPTPTSLHRLRGPPPSPPAARLRLLLRPPRLGGSQARFAGAVRCSGSASAPAVARVGEDSDAAAGIWEQVRDIVVFAGPALGLWICGPLMSLIDTMVIGQTSALQLAALGPGTVFCDYLSYIFMFLSVATSNMVATSLAKKDEELTQHQVSMLLFLALACGIGMFLFTKVFGTQVLTAFTGSGDYELISSAHTYAQI

SEQ ID NO: 83983 - DNA, 970 bp, Zea mays
  misc_feature: Ceres CLONE 1569943
  misc_feature: Translation starting site: 176
  misc_feature: SWISSPROT Homolog: EC 4.3.1.5 Phenylalanine ammonia-lyase
  misc_feature: SWISSPROT Homolog: EC 4.3.1.3 Histidine ammonia-lyase
ctccccgcggtggcggccgctctagaactagtggatcccccgggctgcaggaattcgtctcacccctagaaaaaaagaagagtacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacggggcacacgctgcccgtcggatgtcacccgcgcggcgatgctggtgcgcatcaacacccctctccagggctactccggcatccgcttcgagatcctcgatgccatcacgaagctgctccacaccggggtcagcccctgtcttgcgcctcggggcaccattcacgcggtcgggcgacctggtcccgctcttcctaatcggcgggctcattagtggccgccccaacgcgcatggcgtcaccgtcctacggaaggtaagttggaccccccccaaggctttcaaaatcgccgggaatcaaggggcggttctttcaagactcaccccaaaggagggcctcgcattcttcaaacggaacgttctgtgggctcgcggcctcggcggccaccttgatgtt

SEQ ID NO: 83984 - DNA, 783 bp, Zea mays
  misc_feature: Ceres CLONE 1569944
  misc_feature (294)..(294): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (473)..(473): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (758)..(758): n is a, c, t, g, unknown, or other
ctccccgcggtggcggccgctctagaactagtggatcccccgggctgcaggaattcgtctcacccctagaaaaaacccgttcgcctctcaccttttcgctgtactcactcgccacaacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcantccgttttccaggggcatctgcgtacaggaacccgggcttcaaaatgcacaggggaaagggaagcgacccttcttttcccccggccaaatggggtgccaaagccccccaaagggcccccnnncgcgaaacgccaaaagcccccgggggggtatttccgttccaaaaatccccgggggcnggggagaaagggggccccccacaaattttttttccccccccccccccaaaaaaaaggggggggcccccccttttttttaaaaaccccccccccccccccccttttttttggggggggccccccaaaaaaaaaagggggggggggggggggccccccccccccccccccccccgaaaaaaggggaggganannnnnnngnnnaaaaaaaaagagaggggggggggggcaaaaaaaaaaaaactcttttttgtgggagggggggtgtgnnnaaaaacttttcttctntggggcggggggaggagaaaaaaag

SEQ ID NO: 83985 - DNA, 794 bp, Zea mays
  misc_feature: Ceres CLONE 1569945
  misc_feature: Encodes the peptide sequence at SEQ ID NO. 83986
  misc_feature (272)..(272): n is a, c, t, g, unknown, or other
  misc_feature (310)..(310): n is a, c, t, g, unknown, or other
acccgcggtggcggccgctctagaactagtggatcccccgggctgcaggaattcgtctcacccctagaaaaactcccgttgtcccctccatcagtcccctcgtccttcttccctcttcacacggcgtcgcggctcccctcattcgccggcgtcgactatgaacggaggcagccggcggcagcggtactcctcagagcagctcctcttcgacgtccccgccaatgccggtgccggccggtgggcgcagcagcgtggcggggtgcgtcgcgggnacggggagatctttcgttgtcggttggagcccgctacncccggcccggctgttctgaggggactccgcggcccggggactccccgggacaaaagcagcaactcaatccccgggttggcccacccccctgggggttcaaaaccggagcttttttcccccatttttcaaaggccccgggaatcctttggatggggcccccaaaaaatttggggtcttggggaggggggggcccaaaaaaaaaacccgaaaataggaaattctccccccacaaaaaaaacggtgtataaagaaaaaaaacccccccccctttttttttctccgcggggggggggaaaaacctcttcgggagaggggggccccccccccccccggaaaaaaaaaaaaaaaaagaaggggggggccccccccggggtggtgggcgcaaaatattatctccccccggggtggggggggtggggtgggggctgccaaaaaaaaaaaacaaaaaccccttttcttctttttttttataaaaaaaaagagg

SEQ ID NO: 83986 - protein, 212 aa, Zea mays
  misc_feature: Ceres CLONE 1569945
  misc_feature (39)..(39): Xaa is any aa, unknown, or other
MNGGSRRQRYSSEQLLFDVPANAGAGRWAQQRGGVRRGXGEIFRCRLEPATPGPAVLRGLRGPGTPRDKSSNSIPGLAHPPGGSKPELFSPIFQRPRESFGWGPQKIWGLGEGGAQKKNPKIGNSPPTKKTVYKEKKPPPLFFSPRGGGKTSSGEGGPPPPRKKKKKKKGGAPPGVVGAKYYLPPGWGGWGGGCQKKKTKTPFLLFFYKKKE

SEQ ID NO: 83987 - DNA, 811 bp, Zea mays
  misc_feature: Ceres CLONE 1569947
  misc_feature: Encodes the peptide sequence at SEQ ID NO. 83988
ggagctccccgcggtggcggccgctctagaactagtggatcccccgggctgcaggaattcgtctcacccctagaaaaaatctcagtccggagaaatttccagcctctcgcgcacacggccgccggctctgatctctttatccacgtggccccctcccagtgggcacctcaccaccacctgtcgacctcctcatccccagcggtgcggtgccccccggcccctccccagtgccactgtctcgtcggctcgtcgctccgtagaccccgcgcctccgcctccccgccactcgccggaggctgccgccatcgttatgccatggccgtcatcctctcctccgcggcgccaacgatactgactcgtcccacgcgccctcggaggcagccgaggagcggcctccgcgggggcctcgcgcgcctctcagctgcgctcggcttcgcgcacgcgggcgccggcgccggcgccgcactcgccgcgccgctctcctacgaggagatgctgcgcctctcgtccgactccggcggtgatgttggcgggttcgcgctcccggagctcggcctcgacgggctcgttgacttcgtcaacgataaccctctcgtcgtcgcggcaggcgtcgcggccatcgcagtgccgcttctccttgcgcagcttctcggcggaggcggcagctccaagccctactccgtcctgtccgccaaggcggcctaccagcggctgctcgaggagcccgacgcgcagctcgtcgacatcaggccgctcaaggatgcacgagaggccggcacgcctgatctcaagaggctaagaagaaggctgc

SEQ ID NO: 83988 - protein, 165 aa, Zea mays
  misc_feature: Ceres CLONE 1569947
MAVILSSAAPTILTRPTRPRRQPRSGLRGGLARLSAALGFAHAGAGAGAALAAPLSYEEMLRLSSDSGGDVGGFALPELGLDGLVDFVNDNPLVVAAGVAAIAVPLLLAQLLGGGGSSKPYSVLSAKAAYQRLLEEPDAQLVDIRPLKDAREAGTPDLKRLRRRL

SEQ ID NO: 83989 - DNA, 957 bp, Zea mays
  misc_feature: Ceres CLONE 1569948
  misc_feature: Encodes the peptide sequence at SEQ ID NO. 83990
ccgcggtggcggccgctctagaactagtggatcccccgggctgcaggaattcgtctcacccctagaaaaattccagccgccctctccgcccagcagcagagcacaccatcctctcaactcggatccccaagccctcgcctccagctcttgccacggcatccatcccctgctcggacctccacccggccgcgtcctcgccggtggccagcgccgctgcatcgcccttcctagcgtcggccttggcaccgcttccccgagcgccccagtcgagctcgcccatcctctgctctagccctttctccacgccgtcgctgagctcgcccctcccctcagccatggacacgacgacctgcagcccttcttggtggccaagcccatcttcctgctcgcgccccctcttttccacctctgcgcgtatcagctcgtccaacccccatggtgtttcctccctctcggctcccttgctccctccccatggcgttccccctggatgttggtgatctgttccccacggtgcaggcaaatgttcttttcctccctgcagcagcacccttggtggttgtcgagcagcacgtcgcgcttgcgcagcctcggtcacgacgttgttcaccccgctaaccattggtgtcataccccacgtgtcatgtgttccgccgaatgccctaaacatgaagtctgccgtcgtcttatccacagtcaattttaggcatgggcttccatttgttaggaaatctggccttttaggagacccggaattcgccctaaatgcaaagtacccttgctggtattggaaaggtcacctaaagaacaggggggggtttttgaaggaaatttaaaacttttggagggggattgaacctttaccgggcctagaatttttggcatcgggaaaaacactgtgggcccccccctatttttttggggaaacgtggaaacccccccaggggttcaaaaatg

SEQ ID NO: 83990 - protein, 54 aa, Zea mays
  misc_feature: Ceres CLONE 1569948
MDTTTCSPSWWPSPSSCSRPLFSTSARISSSNPHGVSSLSAPLLPPHGVPPGCW

SEQ ID NO: 83991 - DNA, 840 bp, Zea mays
  misc_feature: Ceres CLONE 1569949
  misc_feature: Translation starting site: 220
  misc_feature: SWISSPROT Homolog: EC 2.3.1.48 Histone acetyltransferase
ctccccgcggtggcggccgctctagaactagtggatcccccgggctgcaggaattcgtctcacccctagaaaaaaaaaaaagccttgccctccctacccagtacccacccccccaccgacccaccccctccgtgttccgccgcctccgccgaaatcaccaaatccccgcctccgatccgccgccgacctcgatccgccgcagccgttgacccgcccagaatggcctctgggactccctcgccgtccggcaaaccctactcccgcaaatctcacgccagctccaaggttcccagcgtcccctccttcgacgcccacaacggccggctcctccccaccgtcaccttcccgctgccctccactaccgcctcccgccgggagctgcggcgccgcctctcctccgagctctcccaggtgcgcgccgcggccaagcgcctgagctccctcccggctcccgcaccttcctcggcgctctccgccaccgacccctccacgccgctcccgccgcacccgccggggtccaagcacaagtccaggaagcccgggggagccccgtacccgcagccgcacctctcggcggaggcgcggcgcaagctctacgcgcccgtgttcaagacctgctccgcgctgctccagaggctgatgaagcacaagcacagctgggtgttcaacactccggtagacgcgagcgcgcttggactgcacgactaccatacgatcatcaccaagcccatgggacctgggcacggtcaagtcaaagctagcggctggacagtacaggtcgccacgggagtttgcaagcgatgtgcgtctcagttccggaaacgcctgacgtacaaccct

SEQ ID NO: 83992 - DNA, 874 bp, Zea mays
  misc_feature: Ceres CLONE 1569951
  misc_feature: Encodes the peptide sequence at SEQ ID NO. 83993
ctccccgcggtggcggccgctctagaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgcgccccttttgcgctttctcgtccctctttctctcaatctctccttattcttctccttccacggcgaagccggcggctggtatggatcccaatggcctcaaaactggagggcttttgctcccgaccatcgagaggcgggtgcacgtcggcctccatccgtcattgtcatcggcgggggcatcttcgggcgttgcaactgcccgggccctctccaattttcatttaaggggactgttttggaatcaaaaaatccattttgcgggggctttcaaccggaaaactggttgggatgccccattaattggggacccctggggctccccgggggtggccaaggaaaccccccggccccccttaaaaacttttttggggcggagggtttccccccccaaggggaaataacccccccttccgtggggcccgggtttttaagaccctttcttttctttttaaaaggggggtaaactgccccccaaga

SEQ ID NO: 83993 - protein, 106 aa, Zea mays
  misc_feature: Ceres CLONE 1569951
MDPNGLKTGGLLLPTIERRVHVGLHPSLSSAGASSGVATARALSNFHLRGLFWNQKIHFAGAFNRKTGWDAPLIGDPWGSPGVAKETPRPPLKTFLGRRVSPPKGK

SEQ ID NO: 83994 - DNA, 954 bp, Zea mays
  misc_feature: Ceres CLONE 1569952
  misc_feature: Encodes the peptide sequence at SEQ ID NO. 83995
  misc_feature (437)..(437): n is a, c, t, g, unknown, or other
gcggtggcggccgctctagaactagtggatcccccgggctgcaggaattcgtctcacccctagaaaaactctctctctcccccctttctgccgctcactctcgctcgctcgctcgctcgctcttctactgcgggctggcggcggcggcggcggcgactgggcgagccgcgagcgcgccgcccttcgccaggtcttcgccggccacttcgcgggcgagggcgaccaccgacgagcatccaccaggccgctgaggaataacaaagatgtccgccggcgaagtcctgagggcagagttatcttccaggacgccgccgttcggcctgaggctatggattgtgattggcatctgtatctggggcgctatcctgttcatcctagggctcatgtgcttctgggtcctacaccggaggaagccggggcagccctgcgacatgttnccgctgtcccaaatccccgacgtctccaaggagatttgcggtggacaagcgcgggagccaactgttggcaaccgcctccgggtgcaggaaacccaccccctgggcgtgcaggaaaaaaaccccgccaaaaagatccggggaaaaagcccccccaactggttagaaccaatccaggcacccaaaaatcttgacccgtggctctccccttccaagggaaaaagggtgggacccctttttcggggaaaaaaggccccgggaatattaagagagaattctctaaaaccccccccccccccggtgggggggcccccaatccccccctaggggggggggctggtgttttttggggggttgggggcgcgccaacaccttttctaagaaattttttagaaaggggggtgtggggtttttccccgcgccccctaaaaggggttggggttaaaaaaaaccccttcaaggggcgaacaaaaaaggggcgggggatataaaatattctccccggaaaatatcccccccc

SEQ ID NO: 83995 - protein, 165 aa, Zea mays
  misc_feature: Ceres CLONE 1569952
  misc_feature (58)..(58): Xaa is any aa, unknown, or other
MSAGEVLRAELSSRTPPFGLRLWIVIGICIWGAILFILGLMCFWVLHRRKPGQPCDMXPLSQIPDVSKEICGGQAREPTVGNRLRVQETHPLGVQEKNPAKKIRGKSPPNWLEPIQAPKNLDPWLSPSKGKRVGPLFRGKKAPGILRENSLKPPPPPVGGPPIPP

SEQ ID NO: 83996 - DNA, 821 bp, Zea mays
  misc_feature: Ceres CLONE 1569953
  misc_feature: Encodes the peptide sequence at SEQ ID NO. 83997
ctccccgcggtggcggccgctctagaactagtggatcccccgggctgcaggaattcgtctcacccctagaaaaagataaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcgatctggagaaatttctaagtcgtcgtcgtcgtcgtcgttcggttcggagcggatctgaggcgacgatggctggaggcggcgggatctcttggtctgcagtcctgcttcacctcgatggatgatgtctctgcgctgataattattggatcaatttcgataattattagtagatctatgagatatgccgcctggaagaggcgaggtaagctgcagcatgtaaaagtctgcgtgcgtcgacagcaaaaaagagaaaaaaagatgtgacatcctagaggaggcctttgccatgatgggtgcgctcgcatggcaggccaggtattaataaaaagatgattattgtgtgccggggggaggagatcgcacggggggtttgatgttttttggccccgggggtctcctccctcactctttgttccgtgtttcctgtatccgtttgtttccggcgcctgtttggtccgctgcgccaccgccggattttttgcatcc

SEQ ID NO: 83997 - protein, 74 aa, Zea mays; identical to SEQ ID NO: 76294
  misc_feature: Ceres CLONE 1569953

SEQ ID NO: 83998 - DNA, 928 bp, Zea mays
  misc_feature: Ceres CLONE 1569954
  misc_feature: Encodes the peptide sequence at SEQ ID NO. 83999
  misc_feature (837)..(837): n is a, c, t, g, unknown, or other
ctggagctccccgcggtggcggccgctctagaactagtggatcccccgggctgcaggaattcgtctcacccctagaaaaataggcaagggaagtcggcaaaacggatccgtaacttcgggaaaaggattggctctgagggttgggctcgggggtcccggccccgaacccgtcggctgctggcggaatgctcgagctgctcgcgcggcgagagcgggccgccgcgtgccggccgggggacggaccgggaacggccccctcgggggccttccccgggcgtcgaacaaccgactcagaactggtacggacaaggggaatccgactgtttaattaaaacaaagcattgcgacggtcctcgaggatgctgacacaatgtgatttctgcccagtgctctgaatgtcacaccgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagcctccgggcgcaagtgaaataccactacttttaacgttatttttacttattccgggggtccggaaggggggcaccgccccttccttttggctccaaggccccgcctcccccgggccgattccgggcggaagaaattgtccaggcggggtagttttggcttggggccggcaccatctgttntaaaaaataaccccagggggtcccataaaagaaccccaacacagaaaccaaaaactctcgtgggggtgaacaaaaaggggaaaaagcctcg

SEQ ID NO: 83999 - protein, 55 aa, Zea mays; identical to SEQ ID NO: 82409
  misc_feature: Ceres CLONE 1569954

SEQ ID NO: 84000 - DNA, 921 bp, Zea mays
  misc_feature: Ceres CLONE 1569955
  misc_feature: Encodes the peptide sequence at SEQ ID NO. 84001
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (334)..(334): n is a, c, t, g, unknown, or other
  misc_feature (337)..(337): n is a, c, t, g, unknown, or other
  misc_feature (339)..(339): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (346)..(346): n is a, c, t, g, unknown, or other
  misc_feature (347)..(347): n is a, c, t, g, unknown, or other
  misc_feature (349)..(349): n is a, c, t, g, unknown, or other
  misc_feature (350)..(350): n is a, c, t, g, unknown, or other
  misc_feature (352)..(352): n is a, c, t, g, unknown, or other
  misc_feature (384)..(384): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (438)..(438): n is a, c, t, g, unknown, or other
  misc_feature (455)..(455): n is a, c, t, g, unknown, or other
  misc_feature (460)..(460): n is a, c, t, g, unknown, or other
  misc_feature (482)..(482): n is a, c, t, g, unknown, or other
  misc_feature (484)..(484): n is a, c, t, g, unknown, or other
  misc_feature (489)..(489): n is a, c, t, g, unknown, or other
  misc_feature (494)..(494): n is a, c, t, g, unknown, or other
  misc_feature (530)..(530): n is a, c, t, g, unknown, or other
  misc_feature (533)..(533): n is a, c, t, g, unknown, or other
  misc_feature (541)..(541): n is a, c, t, g, unknown, or other
  misc_feature (560)..(560): n is a, c, t, g, unknown, or other
  misc_feature (572)..(572): n is a, c, t, g, unknown, or other
  misc_feature (574)..(574): n is a, c, t, g, unknown, or other
  misc_feature (580)..(580): n is a, c, t, g, unknown, or other
  misc_feature (588)..(588): n is a, c, t, g, unknown, or other
  misc_feature (606)..(606): n is a, c, t, g, unknown, or other
  misc_feature (626)..(626): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (755)..(755): n is a, c, t, g, unknown, or other
  misc_feature (762)..(762): n is a, c, t, g, unknown, or other
  misc_feature (788)..(788): n is a, c, t, g, unknown, or other
  misc_feature (812)..(812): n is a, c, t, g, unknown, or other
  misc_feature (820)..(820): n is a, c, t, g, unknown, or other
  misc_feature (823)..(823): n is a, c, t, g, unknown, or other
  misc_feature (824)..(824): n is a, c, t, g, unknown, or other
  misc_feature (826)..(826): n is a, c, t, g, unknown, or other
  misc_feature (827)..(827): n is a, c, t, g, unknown, or other
  misc_feature (830)..(830): n is a, c, t, g, unknown, or other
  misc_feature (865)..(865): n is a, c, t, g, unknown, or other
ggagctccccgcggtggcggccgctctagaactagtggatcccccgggctgcaggaattcgtctcacccctagaaaaactccgcatccgcttgctgctgccgcccctgctccggctgggacgagcgagcctcctctccctccttgtcgcgtcccacataactgtgcctcctcgccgctgcgccccacctctgctcaggcccacactgccctgatcccgccggagtgcccgcacgcgcgcccttgcctgggccggccgccggcgagggagtctgggcggtcggtcgacgtgcccaccccccccccccaaaaannnnnnnnnnnnnnnntnnnatnttntnannnatnntnnanaattttataaattaataaattataataaatanaattttttttaaaattaatataannntaaaaataaataaaannnaaaaaaaatntaaaaaaaaaaaaaaantattntttaaaaaaaaaaaaaaaaatnantatantaaanaaaaaaaaattttaaataaaatttaaaaaaataaanaantaaaattnaaattaatataaaaaaatnaaaaaaataaananaaaaanaaaataanaaaaaaaataaaaaaatnattaatataaaaaaaataanttataaatttaaaaaaaaaaaaaaatataaaaataaatagaaaaaaaagtttaaaatnnntttaatatatataaaatatataatatataaattaaaaaaaataaaataaaaaaatataattattaatanataaaanataaaaaaaaattataaaaaaaaaanataaaggaaaataataaagaaaanaaaatatnatnntnnaanaaataaaataattataaaaaataaagaaaataatntaaaatataaaatataaaattatataaataataaaaaaatatggagaattgtagta

SEQ ID NO: 84001 - protein, 70 aa, Zea mays
  misc_feature: Ceres CLONE 1569955
GAPRGGGRSRTSGSPGLQEFVSPLEKLRIRLLLPPLLRLGRASLLSLLVASHITVPPRRCAPPLLRPTLP

SEQ ID NO: 84002 - DNA, 898 bp, Zea mays
  misc_feature: Ceres CLONE 1569956
  misc_feature: Encodes the peptide sequence at SEQ ID NO. 84003
tccccgcggtggcggccgctctagaactagtggatcccccgggctgcaggaattcgtctcacccctagaaaaaagcacacctccctttacccttccttctctcccatgcaagcaaggaatcgagggagggagggaggaagcaaaaggggaaaagctcgtgcaagacaagccgccctgccctgggaccattcccacccacatcgatcgtcagccagagagaggttcgttagttccagaaggacactggacagttggagacagcgagcgagcgagcgggaggagaggaagaagagctagggggcgatgggcggcgagatgaagcccgggaggggcctcaggacctgggcgcagcgccacctcaacgtcaccttcgccgtcggcttcctcctcgtgctgctcacctacctcgtcgtctcgcggcagctcgccgtcgccgcgcccggcggtgcagcgtcgagggtggtggcgggtaagcaggtggtcgtcagagacgccggagacaacgcagagggcgcgagcaaaaggcggcaggaatggcagccaaaacaggcggcggcggaggaggaggagacgtccggtgccgtcccaacggaggaggaggagtcgtatccgataagagatgaggccgacggcaaaccgtctgcagaggcagagacgacgacgacgacgacgagcaatgccgtgtgcaacacggacgggcccgtgtccgagacgtgcgacctggacggcgacgtccgcaccaacggcagcgccctatctgtgacgttcgtcccggctaagcccttcgacgccgggaagtggtatggtccgccctactcccgcccgaaccatgtgggcgtcgaaagggtcaccgtgacccggctggggtccccgatgacccggggggcccgtgcccggg

SEQ ID NO: 84003 - protein, 198 aa, Zea mays
  misc_feature: Ceres CLONE 1569956
MGGEMKPGRGLRTWAQRHLNVTFAVGFLLVLLTYLVVSRQLAVAAPGGAASRVVAGKQVVVRDAGDNAEGASKRRQEWQPKQAAAEEEETSGAVPTEEEESYPIRDEADGKPSAEAETTTTTTSNAVCNTDGPVSETCDLDGDVRTNGSALSVTFVPAKPFDAGKWYGPPYSRPNHVGVERVTVTRLGSPMTRGARAR

SEQ ID NO: 84004 - DNA, 954 bp, Zea mays
  misc_feature: Ceres CLONE 1569960
  misc_feature: Encodes the peptide sequence at SEQ ID NO. 84005
  misc_feature (768)..(768): n is a, c, t, g, unknown, or other
  misc_feature (850)..(850): n is a, c, t, g, unknown, or other
  misc_feature (910)..(910): n is a, c, t, g, unknown, or other
  misc_feature (916)..(916): n is a, c, t, g, unknown, or other
gcggtggcggccgctctagaactagtggatcccccgggctgcaggaattcgtctcacccctagaaaaagggagtagatcgaggaccatcctcgctaccctgcaggccggcactgcactgcactgcagtctacagaactcgtcagtcacagatcggtgcaggcggtctgcacctgcatcacctaaccaattcctcgattagtctgctgttgcgatttgcgaggcaggtcagctgcaatctttttgcagcagccactaaacctgtaccaagtcttcttgcgtgagggcagaggcaggctccgtcagtcacgccggcggcgtacagatcatggaggactttggcggttggaatatgcagtatgcagcagagctatgcctgccaagccgccgggacgacgacgacgacgacgacggcctcctcggtgacttcctaggcggcggcggtttggacctccgttctgaccatggcggcctcaacctgccctcgtcgcaccctgctgtccagaaccttgtgccctgccacggcggcgcgagtctttccgtttccgacgccttcatgggcctggacacggcggatatgctcgctagcgtcaccggcgcactggactgcagcctcctcgacacgtttgcttgcggttcggacgccgtcgtcgtcgccgccgaagagcccgccgcgcagcccaccgcgtcgagcaacgccttctccggatacagcagcaccacggggcggcattacggcaacatctcctccggcgaaatctacacgtacngcggcagcggcggaaggcatgacaacggagttgcgtcggcgacctgcgcctcgaaagcgaagctgggccggcagtaccctgnctatagcgcgtcggcctcggccacagccacgaacgacaacgggggaagggcaggttgcanccccgncggcttgcacgaaaggggaatccgcgaagtcgtcttct

SEQ ID NO: 84005 - protein, 209 aa, Zea mays
  misc_feature: Ceres CLONE 1569960
  misc_feature (148)..(148): Xaa is any aa, unknown, or other
  misc_feature (175)..(175): Xaa is any aa, unknown, or other
  misc_feature (195)..(195): Xaa is any aa, unknown, or other
  misc_feature (197)..(197): Xaa is any aa, unknown, or other
MEDFGGWNMQYAAELCLPSRRDDDDDDDGLLGDFLGGGGLDLRSDHGGLNLPSSHPAVQNLVPCHGGASLSVSDAFMGLDTADMLASVTGALDCSLLDTFACGSDAVVVAAEEPAAQPTASSNAFSGYSSTTGRHYGNISSGEIYTYXGSGGRHDNGVASATCASKAKLGRQYPXYSASASATATNDNGGRAGCXPXGLHERGIREVVF

SEQ ID NO: 84006 - DNA, 950 bp, Zea mays
  misc_feature: Ceres CLONE 1569965
  misc_feature: Translation starting site: 296
ccccgcggtggcggccgctctagaactagtggatcccccgggctgcaggaattcgtctcacccctagaaaaatgcctgcgcagtactacgagctagcaggctagcagcaccaggaccaggagcctcttcccacacttccgctctccctctctctctttcctctcgagaatggttgtgtaggcgggcgcaggagggaggagagagaggggagctagctagggttttgcgtcgccgccttctgttacccttaggctctgaacccctccggtccagtgcggcggcggattaggctccgatggggaagtctccggcgaagtggatcaagtccgtgctcttcggtaaaaagtcgtcgtcgaggtccggctccaccaaggccaaggatttatcgaagggtaccactaacaaagcggcggctgctgctgctgccgggaaggagcctgcgttctctgagagctctccggtcatctcggagcctgtgcttgttagcgcccacaacaatgagaccgcgcgggaggccgctaagggtgagaattccagcgtgcaagaagtgccagtgactgatgttagtcaagacttggagaagcagggcactgttgggtctgatacgtctaatgatgctgagaggttgaggaaagagcaagcggccgtgaaggcacaagccgcccttccgtggttatctggcacggcgagcattccgtgccctgaaagggatcataagactaccggcactgattcggggacatctttgttaggaggcaagctgtttcaactctccgtgctacaggggtgattgggaaggttccagcccctggtccgggaaaggacgttagactttctaaagttccctttcagcaactacgggacttttcccaaagaacttcggggggtcctaacctggtttcctggagagagaaattgtcttcaaatgcatttggcccgaaagctttccc

SEQ ID NO: 84007 - DNA, 766 bp, Zea mays
  misc_feature: Ceres CLONE 1569969
  misc_feature: Translation starting site: 314
  misc_feature: Pfam Name: Ins134_P3_kin Pfam Description: Inositol 1, 3, 4-trisphosphate 5/6-kinase
ctccccgcggtggcggccgctctagaactagtggatcccccgggctgcaggaattcgtctcacccctagaaaaaactctcctctcctctccgcctcaccttgccctgcccgcacacaccacctgtccccgcacggccgcaccgctccgctcccgaggcttagggctccggccgcgctcccttcccttcccggcattcccgatctctcgccgccgcccgcctggccttgatctcgatcgccctcccctctccgctctcgctccggcaggccggcccgggtttgtctcgccgctattgggcctcggcacgctgcgatggtgtcgggcgtgtgcgtggggacggaggggcaggtggaccctgaggcggtggcgccggctgtcgcggaggaggcggtggtgccggcgcccgcgagggaggtcgtggtggggtacgcgctcacgagtaagaaggccaagagcttcctcccaccccagctccggggggctcgccaggaaaaagggaatcttgtttgtcgctattgatcagaaacgcccattgtctgatcaaagtccattttgacatttgttcctcataagttgactggaaaggggtggccacaattggctggagaaatatggggaggcccccccgaaatttactggttttgaatcaccctggggcaatagcaaacttgcttgatcccccagccatgcctcaaaaagattcggaattggagccccccaaaatggcctggggaaaaaacctgggcccaaacaacattttcgttt

SEQ ID NO: 84008 - DNA, 1175 bp, Zea mays
  misc_feature: Ceres CLONE 1569972
  misc_feature (12)..(12): n is a, c, t, g, unknown, or other
  misc_feature (13)..(13): n is a, c, t, g, unknown, or other
tttttttattcnnttctttttgaatattagggaagaacgacagggaggagggtatgggagataattattttttttttaaagctgggactcccctcggtggcggccgctctagaactagtggatcccccgggctgcaggaattcgtctcacccctagaaaaagcgcgactccgtgcgacggcgaggcctctgtcccgtcctcgtctcctcgaggcccggaggctgcgagtctgtgacacttgaccgtgaggcggacggcgactcggaggacttcaccagcgagtccctcaagcaccgaggccgagccgcccaccgcccgccgccgcctcgcctggcgctagtcgccgttgccgagcctgttcggcacatccgttggggtgccggggcaccgatcaggctgcgcacagccgaagtcggcctccgggtgccccaagctgcagagcagcgcgccagcgcccgtggaccggtgaatcagactacccttgtttcaaatcctgggtccgccattgggggcggtgaggccaccctagtagaggctagaggatgatttacccggcgattcgacacgttcttacctggacagatgaagcaggctccgtggactcctccatccacgggaaaggaatggggatccgaacgaagggccacccctaatacttgcgcccttcccgcggttccttattgtggctgtttgaaccctctcattccccgggtaagtaatggcgggtctattcccattcccattctgggggactatacaccatctctaaataccatatggggataatggggggccccaacacgacgtgatactataggggctcgttttggggtttccccaaagttcggacaatttgtgttttaacgtggcctaacagaaaacaacaccccttgggttctaacctcgccaagatctcataatatgcgcgacaaaagaaaagaaaattttgtacattaagcatatatacatgtggatgtctctctggggcctcttgcccacagtggggaaaaatattgttgggataagtaaataaagctaccccgcccggggataaatatcccaaaggtggaacatcttttcaataggtactgagggacacgactccgctgcatgaaatcaacgcgccaagattggcttgggtcaaacaaaaagaaatatacatttgtgactctaaa

SEQ ID NO: 84009 - DNA, 994 bp, Zea mays
  misc_feature: Ceres CLONE 1569974
  misc_feature: Encodes the peptide sequence at SEQ ID NO. 84010
gcggtggcggccgctctagaactagtggatcccccgggctgcaggaattcgtctcacccctagaaaaaagtaatcactcctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggttctgtacctgacactccggccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctgctggagcggtccgggctgggggaggatacgtgcctgccgtacacgcagcacttcatccccgccgtcgcgcgacctgaagtcctcccgcgccgaagggcgagcctctccatcttctcgggccatcgaacgaactgtctcgccaaaaacggggcgtggtccccccacgggaaattcgaacttcctgagggggaacgagcagcctgtttcgcgccaaatcccttccttcccgcgaactggttctggcgccccgtacagggcttccccgggggaacttcgccatctgtgcacctttccccggatagggtgtcaatcgccggggctcttctcccgtggaaactggcccgaaaacctgctgaaggtgtggccccctgggtgactccccccccgttgggtgtcccggagtacctcacccgccaattttttattagtgtatggagctccctattctttct

SEQ ID NO: 84010 - protein, 271 aa, Zea mays
  misc_feature: Ceres CLONE 1569974
  misc_feature (71)..(269): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MGSSAQLRRLKPLYQLVVNNILTIVAVPLAAAVLLKAAELGPEEILARARALRPAHMLLAGFLPAVATVLYLTLRPRAVYLVDYACFRTNPNCRVPFATFLEHSRVWPGFDERSVRFMTRLLERSGLGEDTCLPYTQHFIPAVARPEVLPRRRASLSIFSGHRTNCLAKNGAWSPHGKFELPEGERAACFAPNPFLPANWFWRPVQGFPGGTSPSVHLSPDRVSIAGALLPWKLARKPAEGVAPWVTPPPLGVPEYLTRQFFISVWSSLFF

SEQ ID NO: 84011 - DNA, 808 bp, Zea mays
  misc_feature: Ceres CLONE 1569975
  misc_feature: Translation starting site: 151
  misc_feature: Pfam Name: tRNA_Me_trans Pfam Description: tRNA methyl transferase
  misc_feature: SWISSPROT Homolog: EC 2.1.1.61 tRNA (5-methylaminomethyl-2-thiouridylate)-methyltransferase
  misc_feature (302)..(302): n is a, c, t, g, unknown, or other
ctggagctccccgcggtggcggccgctctagaactagtggatcccccgggctgcaggaattcgtctcacccctagagtccccaacccgaagagagcacccaatcgagtatcgcgagaagcgctacgcggccggcgaggcgctccccccatatggtgcgcgtcgtcgtctccaccctccccgccctccgtccgcttctccgtcgtggctctctgctaaaccataaacccctgccccgctcgcgccttcagccgtggccgttccgcacgctctcgtcctcgcccgccgccggcgcgcccagcgncgcggtgatagggggaggaggttgcgttggacaagcaccttacccggtgcgcggcggcgggcatagcaccgttgcgggtggcggtgctggtgagcggcggggtggatagcagcgtggcgcttcgcctcctccacgccgccggccatcgctgcaccgcgttctacctgaagatttggttccaggaagatttcaggaacttctggtccgagtgcccatgggacgaggatttgaagtatgcacaagctgtttgtgacaagattgatgtgccattggaggtggtccacctatccgatgaatactggaaccatgtggtatcacatatgatcaatgagtatcgctgtggtcgtacaccaaatcctgatgttctgtgccacacgagaataaagttcggggctttcttagaagcattgaaaatttaggatttgactacatagcttcaggacactatgcacacgtagtacatccttccgctggaaatactgaagcgccatccgtttctcaattat

SEQ ID NO: 84012 - DNA, 934 bp, Zea mays
  misc_feature: Ceres CLONE 1569976
  misc_feature: Encodes the peptide sequence at SEQ ID NO. 84013
  misc_feature (399)..(399): n is a, c, t, g, unknown, or other
gagctccccgcggtggcggccgctctagaactagtggatcccccgggctgcaggaattcgtctcacccctagaaaaagagtccgctctctcgtcttcctcctcctcctcccccttcccgagctcctctctctcgccgtccacgctcgactgcgcgagacactggtcaacgcccgggtggcaggcggctctggtggtgtgttgtgtgtgtgttggtggggtcgggtgagtctagctccgtcgcttgcgccggaagaacgtgtcggggagctgtctctagccctcgggttccatggggaggaacggtagcgtgaagcgctcggcgtcttccagcgctgcgggagctgctgcggggcccccgtccttctctgtgaatcccgccgactatcggttgatgcacnacgcggggtagcgagagaacgccgtcgtgtatcgcacgattttcctgccgaccgaggatgatgttggacgtgaactgccaaggatctcgatcagcaccctaaattcatcggtaaagtaaccacgggaaggctcaaataattagcctttgaaacacccttccaagttgtaaaaaagggtctaacaaacttcctttccgggaggaaccccttccccaacagccgggaaaaccgccgtttttgcaaaaaaggggttaagtttttcctccttaaccaaaaattccaagggcaaaaaaaggtttctcttttgccaaaaaaaatttcctcccctcccccaaaaagcacaaataaagaagggggtggtaaaaacttcccccctcaaagagacaaaaacacctttgggaaaaccgcccggtaaagattttcccaaaaaaagaggttttggtgttttaggcccacaaaaaacatctctttttataccgggggacaaaaaaggggggtccccaaaaaaaagaattgaaaggggtgggaaaatgcg

SEQ ID NO: 84013 - protein, 39 aa, Zea mays
  misc_feature: Ceres CLONE 1569976
  misc_feature (37)..(37): Xaa is any aa, unknown, or other
MGRNGSVKRSASSSAAGAAAGPPSFSVNPADYRLMHXAG

SEQ ID NO: 84014 - DNA, 814 bp, Zea mays
  misc_feature: Ceres CLONE 1569979
  misc_feature: Encodes the peptide sequence at SEQ ID NO. 84015
ctggagctccccgcggtggcggccgctctagaactagtggatcccccgggctgcaggaattcgtctcacccctagaaaaaacccgcgcccgcgcccacgcccacggccgcaccaaccaccagccccgatttcctcctaatcaatcacacccccaaaccaaaacccaaacagcacttctcctgcaatcgccgacgtcgccggaggcttcgccggccggagcagcgccgacggttgttttgccccttcctcgtccggcccagcagcccaggcgagcatgccttcgcttgcgccaccgtcttcctccgtcgctgcgctcacccgccaaccggtgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggttatccagctggcggtgtctcttggaaggacgacactctattgccaaaaagcacaaccattcgtggccagaaccatccggttgctgaccccgtactcccaatggattccatgattacgccagaaatcctctctgctaatgtggaacgtgttatagacatgtttgcagatgatgacactgatactgaacttgatttggatagcccgacagagggcttcgcatcaattgcagaggcattgaggacattcaacaaggaaaaactgggaattgtggttgaatgagaatcaggggaaaaggaaggagatccggaaaatggcggccccccttggttacccccaaagctttgggtt

SEQ ID NO: 84015 - protein, 156 aa, Zea mays
  misc_feature: Ceres CLONE 1569979
MPSLAPPSSSVAALTRQPVQFFKGCSVSKETKGPVRSFFTANSKSTKVKSAGLKVASSFKNDGGYPAGGVSWKDDTLLPKSTTIRGQNHPVADPVLPMDSMITPEILSANVERVIDMFADDDTDTELDLDSPTEGFASIAEALRTFNKEKLGIVVE

SEQ ID NO: 84016 - DNA, 1333 bp, Zea mays
  misc_feature: Ceres CLONE 1569980
  misc_feature: Encodes the peptide sequence at SEQ ID NO. 84017
  misc_feature (1224)..(1224): n is a, c, t, g, unknown, or other
  misc_feature (1316)..(1316): n is a, c, t, g, unknown, or other
aaaatggcagtaggtgatgggaaggcgcctagggaggtcctagcgttctatttgtgggagggaaaaaaaactcaggaaccaacgcggaggcggccgctctagaacagtggatcccccgggctgcaggaattcgtctcacccctagaaaaagtatcatcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctgggaaggcgcccgcctggagctgccgctgctgctgcgtgtggcgctgccggcggtgggtgtatacgagatcaacttcatcatgtccatgtccacgcagatcttctgcgggcagctcggcaacctggagctcgccgccgcgtcgctcggcaacaccggcatccagtccctcgcctaccggcctcatgcttggggatggggcaggcgcagtgaaagaccgctgtgtcgggctaggcggtacggggagcgcctcatagcgaccggcattgctggggggggaggtaaccctgtcaggccggatcgaacagggtggctcggccgggaatggggccaacccgactcggtgggcgccttctaggaacccgctgtgggtggttaacgcccacctttcattccaggggcaggccgggccagtggtgcgtggggtataggcctctcaccttgggagggggacacgagagggagttcccaggggaaaaacagcgaactgcaatatctactgcgactcagagggggggaagtccacgtgccccccctcccaccccggatgggagctcttccgctgcatgggtctataatcgggcggggccactctctcatttgtcgtcccgtggaagagaataaaaccacctctatcatgggaaggtggaaaaaccgccgcgtgggcgacgataaccactttgtgcccccacccaaatctccctgaaggaaaagaatgattcaccatggtgtaggaggaggatgctacacaatatagccatgtttggagcgggggcgcagtcccccacaaacgaggtccatctatacagaatctgnctccgagtgggcgcaccacgcagccctgatgagatcgcagtacataactcgttattggagccgcataaagacactgagggactcacgtcccnctatccaacactaaggc

SEQ ID NO: 84017 - protein, 170 aa, Zea mays
  misc_feature: Ceres CLONE 1569980
MDSTTTTTAPLLQPAAAASSKEEPAPASPHGAGSWELEAVLADASSPVLRRAWEGARLELPLLLRVALPAVGVYEINFIMSMSTQIFCGQLGNLELAAASLGNTGIQSLAYRPHAWGWGRRSERPLCRARRYGERLIATGIAGGGGNPVRPDRTGWLGREWGQPDSVGAF

SEQ ID NO: 84018 - DNA, 818 bp, Zea mays
  misc_feature: Ceres CLONE 1569981
  misc_feature: Encodes the peptide sequence at SEQ ID NO. 84019
  misc_feature (755)..(755): n is a, c, t, g, unknown, or other
  misc_feature (756)..(756): n is a, c, t, g, unknown, or other
  misc_feature (806)..(806): n is a, c, t, g, unknown, or other
  misc_feature (810)..(810): n is a, c, t, g, unknown, or other
ctggagctccccgcggtggcggccgctctagaactagtggatcccccgggctgcaggaattcgtctcacccctagaaaaatcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaaccgctgctgctattgcctatggtnnctgacagaggcaaccagcgtcggtgagaagaatgtcctcatctttgaccntggnaggtggta

SEQ ID NO: 84019 - protein, 188 aa, Zea mays
  misc_feature: Ceres CLONE 1569981
  misc_feature (9)..(190): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGSTIKNAVVTVPAYFNDSQRQATKDAGVIAGLNVLRIINEPTAAAIAYG

SEQ ID NO: 84020 - DNA, 828 bp, Zea mays
  misc_feature: Ceres CLONE 1569982
  misc_feature: Encodes the peptide sequence at SEQ ID NO. 84021
  misc_feature (609)..(609): n is a, c, t, g, unknown, or other
cccgcggtggcggccgctctagaactagtggatcccccgggctgcaggaattcgtctcacccctagaaaaagactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagaccctgatcaggaagctcaccaggggcggcaagcacgcggagctgtggtcgcagcccaagggcggcggcaaccagggccacaagggcaataatggccagcagcagaaacagcagcagccgcagaaacagaaccagaatcaccagcagaagcagaagcaaggtgccaatctcagcaaggatgggcacaacaagaacagcaacggcggccagaaaggactagggtaaccaaggaagaagaggaggggctggggggcctcatgcaggnccttccaggcggtcaagaatcagcacgggcacaagcaccagctccctgagctcagcttcgacgacgatgacctgtttgacgacgaccaccaggaggattttgaccacgacttccaggaggagctccccttcctcggggacaaaataacccacttcgggtttccggcaaccaccgaaacaagaaggggaaaaccctttttttcaccgatacccccgcaag

SEQ ID NO: 84021 - protein, 135 aa, Zea mays
  misc_feature: Ceres CLONE 1569982
  misc_feature (16)..(76): Pfam Name: HMA Pfam Description: Heavy-metal-associated domain
MTKDEEFKLVKIQNHALKVNIHCDGCKHKVKKLLQKIEGVYSVAIDVDNHKVSVTGDVDSETLIRKLTRGGKHAELWSQPKGGGNQGHKGNNGQQQKQQQPQKQNQNHQQKQKQGANLSKDGHNKNSNGGQKGLG

SEQ ID NO: 84022 - DNA, 804 bp, Zea mays
  misc_feature: Ceres CLONE 1569984
  misc_feature: Encodes the peptide sequence at SEQ ID NO. 84023
ctccccgcggtggcggccgctctagaactagtggatcccccgggctgcaggaattcgtctcacccctagaaaaactctcgccattcgctcgaaccccgaagaactggcagtggcaggttactagaggatcactactttgaactcattaaagtgtctaatgatggctgctgttttaaaaacaagtggcagtttttgtagtacacaacagcagcattttcagcaatcaagaagggatcagtttttgcatggttcttattcaaatttcaaacattgcaaaagcaagaagataataaagcctgctccactgtgtgctagagtgacttcctcgaaagtggaactagatgttaaggatccatattggaagcagaagtttcaggaagactgggaaagccggtttgatttgccaagtattactgatatatatgatctgaaaccaaggccaactacattctcactcaagaaaaacagaactcttacaggtgatgaaaatgtggatatgtggaatggttatgttaacaatgatgatcgggcacttttgaaggtgataaagtattcatcgcctacttctgctggagcagagtgtgttgatcttgactgtagctgggtggagcaatgggtgcatcgagcaggaccacgcaaggagatatactatgagccagaggaagtaaaagctgctatagttacctgtggaggtctatgtcctggtttgaatgatgtcatcagacaggtccttatcttaagaagtgtccagacatttctgcatttcaaaaccaaaattcttgacattcatgtcgaacatcaaca

SEQ ID NO: 84023 - protein, 214 aa, Zea mays
  misc_feature: Ceres CLONE 1569984
MAAVLKTSGSFCSTQQQHFQQSRRDQFLHGSYSNFKHCKSKKIIKPAPLCARVTSSKVELDVKDPYWKQKFQEDWESRFDLPSITDIYDLKPRPTTFSLKKNRTLTGDENVDMWNGYVNNDDRALLKVIKYSSPTSAGAECVDLDCSWVEQWVHRAGPRKEIYYEPEEVKAAIVTCGGLCPGLNDVIRQVLILRSVQTFLHFKTKILDIHVEHQ

SEQ ID NO: 84024 - DNA, 857 bp, Zea mays
  misc_feature: Ceres CLONE 1569988
  misc_feature: Encodes the peptide sequence at SEQ ID NO. 84025
ccccgcggtggcggccgctctagaactagtggatcccccgggctgcaggaattcgtctcacccctagaaaaaccccgggccttgcgtggcgatcgagttgccaccagacaactcggctcggctcgtcgtccaccgaccctcctcctcgctccaagcttccctctcccctcctcctccgtcagctggggagctagctagggagcggcgccggcggctgatcgagcggacagacagctgaacgagccggaaatggcggcggggcgcgcgccgtggctcgccgccggcctcgtggcggtgctgatggtggtggccgcgcgcgcgcggttcgtggtggagaagagcagcgtgcgggtgctggcgcccgagcacatccggggccaccacaacaccgccatcggcaacttcggcgtgtccgactactgcggcacgctcaccggcgtcgtcatctacccggacaccaagcccacggggtgcgacgaacttaacgccaagttcaagggcaagtccccgcgcccccgtcatcctcctgctcaaccgggggagaatggtacttcgccgcttaagggggggaaacactcaacgcgcgggcgccggcggccgttgcttaacccggaaaaacgtggaacaaacagcttcttgaacaatgaaaaaccccggaagggttccccggggcacgggagttacatcgacagaagaataaaattcccggtcgggcgctgtggaaaaccccccctttttgggggagtcccttaaaaaaaaatggccccaaaaaggggggcccgggcccgggcaaaaagaagaaggggggggggtaaaaactggaacttggggggggaatccaaatgcctttccaccgg

SEQ ID NO: 84025 - protein, 167 aa, Zea mays
  misc_feature: Ceres CLONE 1569988
MAAGRAPWLAAGLVAVLMVVAARARFVVEKSSVRVLAPEHIRGHHNTAIGNFGVSDYCGTLTGVVIYPDTKPTGCDELNAKFKGKSPRPRHPPAQPGENGTSPLKGGKHSTRGRRRPLLNPEKRGTNSFLNNEKPRKGSPGHGSYIDRRIKFPVGRCGKPPLFGGVP

SEQ ID NO: 84026 - DNA, 839 bp, Zea mays
  misc_feature: Ceres CLONE 1569989
  misc_feature: Encodes the peptide sequence at SEQ ID NO. 84027
ctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcgccttggcgagaacatggtgcgcaccatcgctatggacggcacggaggggctcctccgcggccagcgcgtcctcaacactggctcccccatcaccgtgccttgttggcagggctacccctgggacgtatcatttaattgttatccggtgaagccgaattgatgaggaagggggaaattaaccgaccaaaccactttcccccccctatccaatcgtggaaaccccccggcttttccgttttagccaggccacctgtagcagccaaatggccttggttatctggggaatcaaaggggtcggtggtatctttccc

SEQ ID NO: 84027 - protein, 176 aa, Zea mays
  misc_feature: Ceres CLONE 1569989
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQRLGENMVRTIAMDGTEGLLRGQRVLNTGSPITVPCWQGYPWDVSFNCYPVKPN

SEQ ID NO: 84028 - DNA, 965 bp, Zea mays
  misc_feature: Ceres CLONE 1569990
  misc_feature: Encodes the peptide sequence at SEQ ID NO. 84029
  misc_feature (788)..(788): n is a, c, t, g, unknown, or other
acccgcggtggcggccgctctagaactagtggatcccccgggctgcaggaattcgtctcacccctagaaaaaagcttccacctctgacccaaacccaaccccattcagcagaacatccagttatagcttaattaatccttttctttataccgactccctcgtggcctcgtcgcctcagctccaccaccaccacctccacccgcgcctccaaaatccaaatccgatcgatctccgcggcctccagatcccccggcgggcggagacggcgagctccaggcggccaagaagcccccccctcgcagcgctcctctcctctgcctctccgaatcccttaccagggggaaaaaacattgcctgaaagttcttcaggccctggtgtagcagctgaattacccagtttaatggcgaagaacgagctttagatggtctaaagatggagatgagatagaagcaccacaaagtgtacagtggggtagcaaggatatgactgtcatgatgcctcagcgccaccgggctacagccaagaagcccatgtggataatcgtgctcttgtgcatggtttgcatcgtgctgattggggcttacgtcttcccaccgcggcgcttctctaactgctacctctctgcttcaagtgtatgcgcacctttcaaggattggctcccttctatgggccgtcgggagagaaactgacgagagattatttcatctgtagttattagggatatcctttcaatgcccatgcctatgccaaaaatccaaagattgcccttatgttcttgacaccaggntcattggcccttgagaattgtggggagagtttttacagggacatgagggaaagatactcatccatgtgcacgcatcacgtgaaaagcccgttcaaactagttctttggttgctggccggtaatatccagtgatgccggaattatggggattgaattcaagggtgatgcgaaaaaaaa

SEQ ID NO: 84029 - protein, 68 aa, Zea mays
  misc_feature: Ceres CLONE 1569990
MTVMMPQRHRATAKKPMWIIVLLCMVCIVLIGAYVFPPRRFSNCYLSASSVCAPFKDWLPSMGRRERN

SEQ ID NO: 84030 - DNA, 856 bp, Zea mays
  misc_feature: Ceres CLONE 1569991
  misc_feature: Encodes the peptide sequence at SEQ ID NO. 84031
ctccccgcggtggcggccgctctagaactagtggatcccccgggctgcaggaattcgtctcacccctagaaaaaaacgcctcctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctgggaccctcccgagccacctacacaaagttgaagcagctgctcttctccctcctgctctcccgcaaggacgacgtgatcccccacctttcgctccaatttttctcggtccttgccacccgtggaggcggaactgggccagggcggcaaagggcgaagttcacaaggctcaacgacttggacctccttcgacttcttcgggaaggcctacttcggggggggcccccttcggggaccaaacttcggaagggggggggccaaccaaggggggcacaatgggctcaattgggaaactcccacccccgtggtcacgcttgggcgcctcccag

SEQ ID NO: 84031 - protein, 223 aa, Zea mays
  misc_feature: Ceres CLONE 1569991
  misc_feature: SWISSPROT Homolog: EC 4.2.1.92 Hydroperoxide dehydratase
MASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGYRVCSYLGPSRATYTKLKQLLFSLLLSRKDDVIPHLSLQFFSVLATRGGGTGPGRQRAKFTRLNDLDLLRLLREGLLRGGPPSGTKLRKGGGQPRGAQWAQLGNSHPRGHAWAPP

SEQ ID NO: 84032 - DNA, 949 bp, Zea mays
  misc_feature: Ceres CLONE 1569992
  misc_feature: Encodes the peptide sequence at SEQ ID NO. 84033
ctggagctccccgcggtggcggccgctctagaactagtggatcccccgggctgcaggaattcgtctcacccctagaaaaaactcccccacatcgccatatgtcgccggaggccggaccaatcatgcggcccgccgaccagctactcctcccgttcctcctcctggccgttgcctccgtcgctgccgccggcggctcgtgggagaatggatatgggagcatcctccgcctcccctcctcgtctccgcgccggttcccccgctccgcggccgtcgacctgatccacgcgctcaacctccaccccgccgacgcgtcccctcccctctccaccgccggcgtagagggcgccctcgcccccgcggggaccctcgtcgagaggcccatccgcatcgcgtccttcgcgaacggaggcgccgccacgtcggtggaggacctcggccaccacgcggggtattaccgcctcgccaacacccacgacgccaggatgttctacttcttcttcgagtcgaggggccacaaggacgaccccgtggtgatctggctcacgggcgggcccggctgcagcagcgagctcgcgctcttctacgagaacggccccttcaacatagcggacaacttgtcgctcgtctggaatgattttggttgggacaaggcatcaaatcttatctatgtcgaccagcccactggaactgggtttagttacagctcggattcgcgtgacactcgccacaacgaagctactattagcaatgatctatatgatttcctgcaagccttttttgctgagcacccaagtatgcctaaaatggatttctcataactgggggatcatatgcttgggcatacatttctgccctttgcaagtcgtgtgccccagggaaacagaaacatgagggcattcacatttacttgaaggggtttgctattggcaacggactacagatccagcat

SEQ ID NO: 84033 - protein, 239 aa, Zea mays
  misc_feature: Ceres CLONE 1569992
  misc_feature (103)..(240): Pfam Name: Peptidase_S10 Pfam Description: Serine carboxypeptidase
  misc_feature: SWISSPROT Homolog: EC 3.4.16.5 Carboxypeptidase C
MSPEAGPIMRPADQLLLPFLLLAVASVAAAGGSWENGYGSILRLPSSSPRRFPRSAAVDLIHALNLHPADASPPLSTAGVEGALAPAGTLVERPIRIASFANGGAATSVEDLGHHAGYYRLANTHDARMFYFFFESRGHKDDPVVIWLTGGPGCSSELALFYENGPFNIADNLSLVWNDFGWDKASNLIYVDQPTGTGFSYSSDSRDTRHNEATISNDLYDFLQAFFAEHPSMPKMDFS

SEQ ID NO: 84034 - DNA, 897 bp, Zea mays
  misc_feature: Ceres CLONE 1569993
  misc_feature (229)..(229): n is a, c, t, g, unknown, or other
  misc_feature (237)..(237): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (274)..(274): n is a, c, t, g, unknown, or other
  misc_feature (275)..(275): n is a, c, t, g, unknown, or other
aaagctggagctcaccgcggtggcggccgctctagaactagtggatcccccgggctgcaggaattcgtctcacccctagaaaaaacacacgaccgaggaccgacgggtggagcatatatgagacgcgtacggggggacggtcgctgagctgagctcatggcgatggggaggccaagcaacagccacgggggcgggggcgacgaggagcggctgcccctccgcggcgtgntggagacntnnncgtcccatcacgccgcggtgcaccccccggacnngggaggcgaggctctggggcagcacgctctggtgcgcgtccgttgcgcgcggggcatgactgctctgccttgattaaccgttcccgggccatccatggaaggaggggggggggggggggggggtggcaaaaagacttagccccgccagggggcgcctaccaacattcttggacccaccggggatgggggagagaggcacccccgcctctctaggatgaggctaaagatgacgacgtttggacagaatggaaggttattcaccacccccaccacccacgcaaccggcggtcgttaaccaacctaacatattttacaaattattattttttttttcttactactagagactcgccttttggtggggggtgttgaattgggtgggaggggggtgagggtgtaggtgaagtaacgtcttgcagatagtgtggaagacacacaacgtgccttgaccggccgactgtgatcgcaaatggcggggggcagcaggaaaaggtatgcagctggggggggagtgctcgtgggcagggaagccatggtacgtgttaataaacggggtgagtggcggaggaaacgtgaaacacttgctttgcctggatgagcgatgggggctggcccctcccca

SEQ ID NO: 84035 - DNA, 795 bp, Zea mays
  misc_feature: Ceres CLONE 1569995
  misc_feature: Encodes the peptide sequence at SEQ ID NO. 84036
ctccccgcggtggcggccgctctagaactagtggatcccccgggctgcaggaattcgtctcacccctagaaaaaatctcgcctcccccacagcatcggagaacggagggaaccagggagctccggccgcctagaaccggagctcccaaatagatcgatccatccgtcgttgagcggacacggcaatggaagcccacgcctcgcggggccgccgcaccctggaggagatccggcagaagagagccgccgagaggatgcagcacgccctcccgatcgcggcgtctcacgtcgactctcacgggaaccaaagagccggagctgagcttcttgctcgagttcaagaacttgaaaatgggaacacggaattgattgatgagaagggagttgagaaggatgcccttgtaaaccgtttgaatgatctcgtgagtcaagagtatattgttataggtgctgagctccaggttttggttctcttttttttttggcatgatttgttttctgcaggagcggaatgtagttccgtctttgaaaaaaaacttgaatgacatttctttggagaaagatgctgctgtagttgctaaaggaggatgctctagctcaactcaggagcatgaagaaacggcgtcaagggagcagaagaagaacagtataagggcagggaagactcagcctccctggagaggacaggtaaacaccctggcagcagcaaagtaaggggaccctcctttcggggaatttacaagggggaattccgagggggggaatctggttgccctgggaaaagggggatcccgag

SEQ ID NO: 84036 - protein, 119 aa, Zea mays
  misc_feature: Ceres CLONE 1569995
MEAHASRGRRTLEEIRQKRAAERMQHALPIAASHVDSHGNQRAGAELLARVQELENGNTELIDEKGVEKDALVNRLNDLVSQEYIVIGAELQVLVLFFFWHDLFSAGAECSSVFEKKLE

SEQ ID NO: 84037 - DNA, 914 bp, Zea mays
  misc_feature: Ceres CLONE 1569997
  misc_feature: Encodes the peptide sequence at SEQ ID NO. 84038
  misc_feature (596)..(596): n is a, c, t, g, unknown, or other
  misc_feature (729)..(729): n is a, c, t, g, unknown, or other
  misc_feature (768)..(768): n is a, c, t, g, unknown, or other
tccccgcggtggcggccgctctagaactagtggatcccccgggctgcaggaattcgtctcacccctagaaaaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatccggccaccttcccaagaacaatggcatcaagtggcgcgggaactctggcctgtcagacggctccgacgccaaggacgtcaagggtggcctcgtcggcggctactacgacgctggcgancacatcaagttccacttcccgatgggcttctccatgacgctgctgagctggtcggtgatcgagtacagcgccaagtacaaggccatggggggagtatgaccatgtcagggaagctcatcaagtgggggcaccngactatctgctactcacccttcaactcctctggcttcancatcggacagtttatccgcccaggggggtgctgctaaaatcacggcaggcgggcgggacgacatttctgctgggaaccggcgggaggaatgtggtaccctcgccctttcctgtccgggagcctcgccccctgatcgggttggggaa

SEQ ID NO: 84038 - protein, 198 aa, Zea mays
  misc_feature: Ceres CLONE 1569997
  misc_feature: SWISSPROT Homolog: EC 3.2.1.4 Cellulase
  misc_feature (166)..(166): Xaa is any aa, unknown, or other
MYSANHWGGSFEIADGAAEDDHSRNMDLDRGALSARQHHELDETQQSWLLGPPEAKKKDKYVDLGCVVVKRKLLWWALWCVVAAFVLIGLPIIIAKSIPHKKPGPPPPDQYTEALHKALLFFNAQKSGHLPKNNGIKWRGNSGLSDGSDAKDVKGGLVGGYYDAGXHIKFHFPMGFSMTLLSWSVIEYSAKYKAMGGV

SEQ ID NO: 84039 - DNA, 790 bp, Zea mays
  misc_feature: Ceres CLONE 1569998
  misc_feature: Encodes the peptide sequence at SEQ ID NO. 84040
  misc_feature (326)..(326): n is a, c, t, g, unknown, or other
ctccccgcggtggcggccgctctagaactagtggatcccccgggctgcaggaattcgtctcacccctagaaaaaaaaaggctcacaatacccacctccatttagctactactactccctcgctgtcttccccaaccaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggtggggggcaggggcggcacccgangtgacggcgccgcaggaacccacattgccagccaccggctccggcgctaccggcgcagcggcggtcggaagtcactcccaactccgtgctgggtggcgctgctgggattcccactacacggagctggcgggaactggtggagaaaggcgctgcctctgccagacccctggaggacagccttcggggaaacacaaacgtcaccttctttcgcgccccggaaacgaagcccctggaagcggggacctgggacccgggagtttcaaggccctttccttgggtggaaaccggccaaaccctcagggtcccttgaaaggggcttgcttgctcttaaccaaggtcccttccccttgggggccttggcccctccaaaaatttcgggggcccggggggggtgcccaaaccccaaacctttttcgggggggaaggaagggtgaaaacactcccccccccccgccccccggggg

SEQ ID NO: 84040 - protein, 168 aa, Zea mays
  misc_feature: Ceres CLONE 1569998
  misc_feature (25)..(25): Xaa is any aa, unknown, or other
MGAPVHGALALFLLLLVGGRGGTRXDGAAGTHIASHRLRRYRRSGGRKSLPTPCWVALLGFPLHGAGGNWWRKALPLPDPWRTAFGETQTSPSFAPRKRSPWKRGPGTREFQGPFLGWKPAKPSGSLERGLLALNQGPFPLGALAPPKISGARGGCPNPKPFSGGKEG

SEQ ID NO: 84041 - DNA, 853 bp, Zea mays
  misc_feature: Ceres CLONE 1570001
  misc_feature: Encodes the peptide sequence at SEQ ID NO. 84042
ggagctccccgcggtggcggccgctctagaactagtggatcccccgggctgcaggaattcgtctcacccctagaaaaaacgctgcctcggccggcacctacctcccccacttcgccgccggcgggtggagactactagaagaagacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatccggcaagaccttcccaactctggaccctcgtacaggggaggtgattgctcatgtggctgagggtgacgcagaggacattaaccgtgcagtagctgcggctcgcaaggcttttgatgaagggccatggccgaagatgactgcctatgagaggtcccgtatcctactgcggtttgctgatttgatagagaagcacaatgacgagcttgctgctttggagacatgggacaacgggaagccatatgagcaagcagcccagaatgaagtacccatggtggcccgtcttatgcgttactatgctggttgggctgataagatccaatggctcattgtgccggctgatggcccacacatgtacagatcttgcatgagcccattg

SEQ ID NO: 84042 - protein, 207 aa, Zea mays
  misc_feature: Ceres CLONE 1570001
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQNEVPMVARLMRYYAGWADKIQWLIVPADGPHMYRSCMSPL

SEQ ID NO: 84043 - DNA, 918 bp, Zea mays
  misc_feature: Ceres CLONE 1570002
  misc_feature: Encodes the peptide sequence at SEQ ID NO. 84044
ctccgcggtggcggccgctctagaactagtggatcccccgggctgcaggaattcgtctcacccctagaaaaaagctccagcatcttctagcttcttcattcatgggattcggtctctactaggattaggggtgcttcatttcatccgatccccaacgacttgacctgattctgatctcgacgacgatgcggaagcgggatctgggcatcctgctgctcgccgccttcgccatcttcttctccctccaccacgaaggcgacttctccttccgggagtcctggtaccacctcaccgacgaggacttccccatcaagtacgaggccgaccgcctgcccccgccgctcgtcgccgatctcaacggcgacggcaagcccgaggtcctcctccccacccacgacgccaagatccaggttctccagccgccccacgcccgccacctcaacgatgactccgccttccaggaggcccgtgtcatggccgacatctctctcctccccgacaacgtccgcctcgcctcggggaggcgccccatcgccatggccgtcggcaacgtcgaccgctcctacagacctggcgaggtcaggaagcaggtgctcgtcgtcgtcacctcccgatggtaagtcatgtgcttcgaccataacctcagaagctgtgggagcacaactccaggacgaatttccctcattccgcccaacaccgcgaggtcgcaatctccttatccaattataccccccagcatggaaatagcaggcctcgtcctcctttggaggaaaggagggagattgccctttccttccgcgtgattttcttccgaggaatttgttgattccctgaaccacacaagggatggatcccccgtccaagccgccgagcaaaaaatcagggcccttctagagtggggtatgtcccaaccccccc

SEQ ID NO: 84044 - protein, 144 aa, Zea mays
  misc_feature: Ceres CLONE 1570002
MRKRDLGILLLAAFAIFFSLHHEGDFSFRESWYHLTDEDFPIKYEADRLPPPLVADLNGDGKPEVLLPTHDAKIQVLQPPHARHLNDDSAFQEARVMADISLLPDNVRLASGRRPIAMAVGNVDRSYRPGEVRKQVLVVVTSRW

SEQ ID NO: 84045 - DNA, 829 bp, Zea mays
  misc_feature: Ceres CLONE 1570003
  misc_feature: Encodes the peptide sequence at SEQ ID NO. 84046
ctggagctccccgcggtggcggccgctctagaactagtggatcccccgggctgcaggaattcgtctcacccctagaaaaaattcctccccgtcccgcgtcgcgtcccacgccgccgcacctccgcggcagcgctactcctcgccgtgacgtcggggaggcctcgctcgggggagggctgcctgcctgcctggctgggtgtcagtcggccgtagaggaggaggggggcggaggagcttgatctggggcacctgccccccctcccctgcgccgtcgggatgtacatgccgccgccgccgcccaccggcggcgccggcgagcagcctaggctttaccaggtctggcggggaagcaacgaattcttcttgcagggaagatttatatttgggcctgatgtgagatctctgtttctcactatgatcctcatcatcgcaccagtggttgtcttctgtctgtttgttgcaaggcatctcataaatgatttccccgatagctggggaatctcagtgatggtaagtagtggttgccttcactatttatgatttgacgttgcttctttgtacctctggtagagatcctggtataataccccggaattcctctccctcctgaaacctgaatcccttggatgggatcaacgaacccggggtgttcaaactcccacaaaaatttcgttttggcctcccgcaaaaggaagtaccttggtaaatggggatccgtggtacaggggccaaaaaccggggaaaccctggaagggcgggggcccaacccacctcgtatggcccccaaaggggttcccatttgggaaaataaccgggtggtgggaaaaag

SEQ ID NO: 84046 - protein, 87 aa, Zea mays
  misc_feature: Ceres CLONE 1570003
MYMPPPPPTGGAGEQPRLYQVWRGSNEFFLQGRFIFGPDVRSLFLTMILIIAPVVVFCLFVARHLINDFPDSWGISVMVSSGCLHYL

SEQ ID NO: 84047 - DNA, 853 bp, Zea mays
  misc_feature: Ceres CLONE 1570006
  misc_feature: Translation starting site: 259
  misc_feature: SWISSPROT Homolog: EC 5.2.1.8 Peptidylprolyl isomerase
  misc_feature (612)..(612): n is a, c, t, g, unknown, or other
  misc_feature (614)..(614): n is a, c, t, g, unknown, or other
  misc_feature (622)..(622): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (647)..(647): n is a, c, t, g, unknown, or other
  misc_feature (654)..(654): n is a, c, t, g, unknown, or other
  misc_feature (655)..(655): n is a, c, t, g, unknown, or other
  misc_feature (662)..(662): n is a, c, t, g, unknown, or other
  misc_feature (663)..(663): n is a, c, t, g, unknown, or other
  misc_feature (666)..(666): n is a, c, t, g, unknown, or other
  misc_feature (667)..(667): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (674)..(674): n is a, c, t, g, unknown, or other
  misc_feature (676)..(676): n is a, c, t, g, unknown, or other
  misc_feature (684)..(684): n is a, c, t, g, unknown, or other
  misc_feature (686)..(686): n is a, c, t, g, unknown, or other
  misc_feature (687)..(687): n is a, c, t, g, unknown, or other
  misc_feature (726)..(726): n is a, c, t, g, unknown, or other
  misc_feature (815)..(815): n is a, c, t, g, unknown, or other
ctggagctccccgcggtggcggccgctctagaactagtggatcccccgggctgcaggaattcgtctcacccctagaaaaaattagggttctacttctagcccgggccgactccactccaatccaatcctggggcgagcgactgcctccttccctcgatctattccccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccncnagtgtggnggnnnnnnnnnnnnnnnnnnnnnantgaaaannaggtggnnatnngtnnntngntgcgggtntnncaagaaaaagggcggaacacaaaccagtaccccctcagnttcgcgccacggggccaccccaaaaagaaaagccgggctcccgtccgtcctcccttcttgcttcgcggggcggcaagggttaaccgtgnacctgaatccaagccaacaagaaggctagctagcctag

SEQ ID NO: 84048 - DNA, 856 bp, Zea mays
  misc_feature: Ceres CLONE 1570007
  misc_feature: Encodes the peptide sequence at SEQ ID NO. 84049
  misc_feature (581)..(581): n is a, c, t, g, unknown, or other
  misc_feature (657)..(657): n is a, c, t, g, unknown, or other
ccgcggtggcggccgctctagaactagtggatcccccgggctgcaggaattcgtctcacccctagaaaaaaccgttctcttctccctaatcctggtaatcagtagtagccactagcgctgctgccgttctcttcccctacccgacacaagctccaccacctctatctaccacacgccaccactgtaggagctcctccacgatcatcccgccctagagccataataattcgttgaagaggagggggttcttagaaccagagggcggctacctgtgaaggatacccgtgctgctggctgctgctgttcctcgagctagagccgtgtgtgggctgtgcagattgcagagcgcagcttccagtctcagcattgctttcaatggggaggcactcctgctgttacaagcagaagctgaggaaggggctctggtctcctgaggaagatgagaagctcatgaaccacataaccaagcacgggcatggctgctggagcactgtccccaagcttgcagggcttcagaggtgtggcaagagctgcaagctgaggtggataaattacctgaggcctgaccttaaaagagtgcnatctctgaagaagaagaagactcatcgtcgaacttcatgctgtactggggaacagtgggctcagattgcaacaggntgcctggaagactgacacgagatcaagaactctgggactcgagcatcagaagaagctccggcaaaaagcattgtacccaacaccaccagacgctccttggccgaggtgaaacccaccaccagctccaagaccagtaccgaggacctccgagtccaagatgtgaccctcaagtggggcggactgggaactcagccatctt

SEQ ID NO: 84049 - protein, 98 aa, Zea mays
  misc_feature: Ceres CLONE 1570007
  misc_feature (14)..(61): Pfam Name: Myb_DNA-binding Pfam Description: Myb-like DNA-binding domain
  misc_feature (69)..(69): Xaa is any aa, unknown, or other
MGRHSCCYKQKLRKGLWSPEEDEKLMNHITKHGHGCWSTVPKLAGLQRCGKSCKLRWINYLRPDLKRVXSLKKKKTHRRTSCCTGEQWAQIATGCLED

SEQ ID NO: 84050 - DNA, 801 bp, Zea mays
  misc_feature: Ceres CLONE 1570009
  misc_feature: Encodes the peptide sequence at SEQ ID NO. 84051
ctggagctccccgcggtggcggccgctctagaactagtggatcccccgggctgcaggaattcgtctcacccctagaaaaaagtgcggacaggcctcactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcaggactaccccttggacgtatcattaatgttatcggtgagccgattgaatgagaagggtgatataacgactaaaccacttcctccctatccctcgtggaggcccctgcttttcgttgaagcaggccactggagcagtcaac

SEQ ID NO: 84051 - protein, 167 aa, Zea mays
  misc_feature: Ceres CLONE 1570009
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRTTPWTYH

SEQ ID NO: 84052 - DNA, 989 bp, Zea mays
  misc_feature: Ceres CLONE 1570012
  misc_feature: Translation starting site: 257
  misc_feature: SWISSPROT Homolog: EC 1.10.3.2 Laccase
gcgctctagaactagtggatcccccgggctgcaggaattcgtctcacccctagaaaaaactacttttaacgttattttacttattccgtgggtcggaagcggggcacagcctctcatcgccaactcggagaccttgagaggaaagccatcgcgcgctagggcctagggcagggcacgagcaaaggccctcccgcgggttccattggagcgcgagcgaacggcgccgacgcggcaacacacgttagctttattcgctatggcatcgccatcgtcgtcgtcctggctgctgctgctgctctcgtgcctcgcgcttgccctgctcgcggcggacgccgaagtgcaccaccatgagttcgttgtccaagagacgccagtgaacaggctgtgcaagacgcacaacgtcatcacggtgaaacgggcagttccccggggccgacccctggaggccagggaagggcgaccccctggggaatcaacgtcgttcaaccggggcgcagtacaaccgtccccatccacctgggaacgggatttcgggtataatgaaaaaccggggggggccggaacggggcccggaatttcttgtaacccattggccccattcaggggccccgggcgggagttctcaaagttacccgggtctccccttctcaaggggggcagggagggccccccctttgggttgggccacccccacacagctccctgggtcccaggggcaaaccgtttttagggggggtcgctcttttttcccgcccccggggggaaaaaggggacctatcccccttttcacaagacccttctgccgaaatccccccttttcccttttgggggaggggggggggcacctaaccctcatcgtatttttcccgcgagagggcccaaagaaaaagggggcggcccccccaattgtttcctgagggtgtttctacaaagagaggacccccgggtgcgctttgaaaatgttccctcaaaaaagaaacaacgcgccc

SEQ ID NO: 84053 - DNA, 904 bp, Zea mays
  misc_feature: Ceres CLONE 1570013
  misc_feature: Encodes the peptide sequence at SEQ ID NO. 84054
  misc_feature (256)..(256): n is a, c, t, g, unknown, or other
ctggagctccccgcggtggcggccgctctagaactagtggatcccccgggctgcaggaattcgtctcacccctagaaaaagccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgagngtcgttatatgggcccgggcctcatggcgtgccgcgccgagttcggcccgtccaagcccttcgccggcgctaggatctcggggtctctccacatgaccatccagaaccgccgtcctcaatcgaagacccctcaccgcggctcgggcgcccgagggtcccgcctgggttgcttccctggcaaaacatcctttctccacgcagggaacaacgcccgcccgccgcccatcggcggcggcgaacttcgggccggcccctggtttccccccggggaaaatgggggggaaaccccccccgcagggaaaattactgggtggggaagaaacccaaaagcgcctgccccttccaacctgggggggccaaaaggccggggggggggtcccccccaaaccctctattcgtgtctaaaaaaaaagggggggggtgaaaacccccacaccctttgtgttttttctccacacaagggggggtttctaaaaggcccccaaagggaagaggattactccccaaaaaaaaaacccgggggcgaaaaaatttcctcccccgcaaccccccggggatgaggtccccccccccaaaaaaaaaccccttgggagtagattttaaaaaaaacatggtgggagccaaccaaacacaaaatattttcgcgag

SEQ ID NO: 84054 - protein, 219 aa, Zea mays
  misc_feature: Ceres CLONE 1570013
  misc_feature (12)..(201): Pfam Name: AdoHcyase Pfam Description: S-adenosyl-L-homocysteine hydrolase
  misc_feature: SWISSPROT Homolog: EC 3.3.1.1 Adenosylhomocysteinase
  misc_feature (34)..(34): Xaa is any aa, unknown, or other
MALSVEKTSSGREYKVKDLSQADFGRLEIELAEXRYMGPGLMACRAEFGPSKPFAGARISGSLHMTIQNRRPQSKTPHRGSGARGSRLGCFPGKTSFLHAGNNARPPPIGGGELRAGPWFPPGENGGETPPAGKITGWGRNPKAPAPSNLGGPKGRGGGPPQTLYSCLKKKGGGENPHTLCVFSPHKGGFLKGPQREEDYSPKKKPGGEKISSPATPRG

SEQ ID NO: 84055 - DNA, 882 bp, Zea mays
  misc_feature: Ceres CLONE 1570016
  misc_feature: Encodes the peptide sequence at SEQ ID NO. 84056
  misc_feature (706)..(706): n is a, c, t, g, unknown, or other
  misc_feature (855)..(855): n is a, c, t, g, unknown, or other
acccgcggtggcggccgctctagaactagtggatcccccgggctgcaggaattcgtctcacccctagaaaaaatcacggcctcccctcccctggtactatacgcgtgttccgccgcgagctccattagcgcggctagctcccatgctcatcgctttcgctgacctttgagagccatattctgttcctcctcctcctcctcctccttcagttggtagcgctcgtcatcattccaggcagcaagatcgcatgacacacagctgaagctcggctttggcgcttcttggtgaccgaagcacgcgcagcatccatccgccatggagagtgccggcggacgaccagaggcggcggcggcggcggtgctcaaggtcaagggaagagacgccggaagaagaccgaacggggctcactcgtcttcttcctgcctgcaacaccgacactccagaagaacaacgagcgcgtcgtacgtaaatgctcccgacgtgtcgccgcgactctccgccggtcacatacctgcggccatcagtcgcagtgaggtgctcgacgacacaaggcgttcgctcgacctccctgaccagtttcccgagcatcgcgtcgccgcagccacagagagagctgaaagaagcggttcgaagtctgccgcggacctggcctgggagatagccgtcctggatgagcaagtcgtccgcaaggagctgcacctgctgntcctgtacagagccgcgttcgaccagtacctcggcgtctcccctcgcgcgtctgctcatgtaccgcgccatgagcgcagcagcagaagggctactgctgctgacgacgaaggcgcccttcgcctgaggaagcatcaggagtctgcgtcntacagcctatcaacgctctccgattct

SEQ ID NO: 84056 - protein, 189 aa, Zea mays
  misc_feature: Ceres CLONE 1570016
  misc_feature (131)..(131): Xaa is any aa, unknown, or other
MESAGGRPEAAAAAVLKVKGRDAGRRPNGAHSSSSCLQHRHSRRTTSASYVNAPDVSPRLSAGHIPAAISRSEVLDDTRRSLDLPDQFPEHRVAAATERAERSGSKSAADLAWEIAVLDEQVVRKELHLLXLYRAAFDQYLGVSPRASAHVPRHERSSRRATAADDEGALRLRKHQESASYSLSTLSDS

SEQ ID NO: 84057 - DNA, 831 bp, Zea mays
  misc_feature: Ceres CLONE 1570017
  misc_feature: Encodes the peptide sequence at SEQ ID NO. 84058
  misc_feature (831)..(831): n is a, c, t, g, unknown, or other
ctggagctccccgcggtggcggccgctctagaactagtggatcccccgggctgcaggaattcgtctcacccctagaaaaaagcccctccattgcctcattataaccaccaccgtctcttccttgtgtcttctcctcctttccctcccggccacttctctcgtttcgccctccccctcgagcaccccgccggctagggttacggccaccgccttccacgcctcccccacttcccgtaggcggaggctggtcggcgtgcacgcgaccgcggcggcggagatggacccggacttctcgcccgggggcggggggcccagctttgaattcgccttcaacgaggtcaacttctccgaccgggaattgcgtatcgaggtcgtcgccggggatgactacgctccggggtccagcggcgccggtgccggaggaggtggcctcgccgactgggcgcgccaccgcaagcgtcgccgtgaggagctcctcaaggagaaagaatctacaactcacatgtcagaccaaacaaattgcaatgaagttgaagcagaagagtgtgatgcgtatgaagaaaatcaagaggaacctgtagcaatggtagaagaatctccacccgatgttggccaagatggtgatgatgggcaaggtattgattcgtcttggactgtggttggtacaccagttttacgagtcaagacaatttatatcagttcagcgattcttgctgcgaagagtcctttctttttcaagcttttctcaaacggcatgaaagaatcggatcagagacatgcaacccttagaattactgactcagaagaaactgccctcatggagcttttagn

SEQ ID NO: 84058 - protein, 184 aa, Zea mays
  misc_feature: Ceres CLONE 1570017
MDPDFSPGGGGPSFEFAFNEVNFSDRELRIEVVAGDDYAPGSSGAGAGGGGLADWARHRKRRREELLKEKESTTHMSDQTNCNEVEAEECDAYEENQEEPVAMVEESPPDVGQDGDDGQGIDSSWTVVGTPVLRVKTIYISSAILAAKSPFFFKLFSNGMKESDQRHATLRITDSEETALMELL

SEQ ID NO: 84059 - DNA, 941 bp, Zea mays
  misc_feature: Ceres CLONE 1570019
  misc_feature: Translation starting site: 323
  misc_feature: SWISSPROT Homolog: EC 1.1.1.86 Ketol-acid reductoisomerase
ctggagctccccgcggtggcggccgctctagaactagtggatcccccgggctgcaggaattcgtctcacccctagaaaaactctctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtggggagggatctgttcccgctgttaccggaggccttcaagggaatcaaacagatcggtgtaatcggctggggctcgcagggtcctgcacaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgatatctgattctgctcaggctgataactacgagaaaattttctcgcacatgaaaacaaacagtattcttggtttgtcacatggattttctcctggacatttgcaatctccggggttttgatttccctaaaaacatcagtgtggttgctgtatgccccaaggaattgggcccatcagtcagatgaacttaatgtcagggcaaagagatcaatggggctggtatcaagctagctttgctgttccccagaatgtgtattgaaaggcaaca

SEQ ID NO: 84060 - DNA, 805 bp, Zea mays
  misc_feature: Ceres CLONE 1570020
  misc_feature: Encodes the peptide sequence at SEQ ID NO. 84061
  misc_feature (805)..(805): n is a, c, t, g, unknown, or other
ctccccgcggtggcggccgctctagaactagtggatcccccgggctgcaggaattcgtctcacccctagaaaaaacctggaacacacgcaccgtcccaagttaacctctcgtgctcgggcactttctttttccttcccccctgtgcgctcggccgcctccgccgctgcctcgctccctccgcgcccaccacggaggcgcacgcgcgggcgcagcgtccctcgcgtgcctcgccttccgcactgctctgtccgcccgcctggctcctgcctcctcctcctcctcctcctctagggttagggcacgcgtcgcgggggcccgtggcgcccggcgcaatgcggaggccgtcgggggccggcgtgccgagccgccgccgccgcgcgatccaggtgctcgtggcggtctccctcgcctacgcggtcgccgtgctgctcctcgagtcgcccctcgtgtccacgtcgctgcccggggcgggggcgtccgccgcggcgtcgcggaagctccacctcgacggcgcgtgggagggcgcgggacgagcagcgccggcgcgccccgcgaagcacccgcacagggagaccctctcggcggacgcggggcggggacgggcgcgccggttggcggggatcgtctctggcctcgagctccgccacctcaactccacccgctccggctcgctccgcaaggtcgccgcggaggccgccgagtcaggggcccgcgtgttctccgacctggaggctctagcgacggccttgactttctcgggcgattcgtcaggggaaggaggaggagaagacaagtgcccgcacn

SEQ ID NO: 84061 - protein, 157 aa, Zea mays
  misc_feature: Ceres CLONE 1570020
MRRPSGAGVPSRRRRAIQVLVAVSLAYAVAVLLLESPLVSTSLPGAGASAAASRKLHLDGAWEGAGRAAPARPAKHPHRETLSADAGRGRARRLAGIVSGLELRHLNSTRSGSLRKVAAEAAESGARVFSDLEALATALTFSGDSSGEGGGEDKCPH

SEQ ID NO: 84062 - DNA, 912 bp, Zea mays
  misc_feature: Ceres CLONE 1570021
  misc_feature (912)..(912): n is a, c, t, g, unknown, or other
ggagctccccgcggtggcggccgctctagaactagtggatcccccgggctgcaggaattcgtctcacccctagaaaaaaagactcaatacacaagcagagctcaaacaattcttgcttcccgctagctagctcgcaagaaataatggctccacttcttcttgcttctcgcacagcctgtcgtcctggccttacaagccgccatgcccatgataatggccggcacggcctgtcttcttcaccaccaggaagtcgtagtaagcgaagccgtagccttagcttgaggccacgagctgaaaagacgacgacaggcggtgggggtcatgttgtgagcgaaaagctgagcccctggccaaatcccaggagggagtgggtcccccctagctttatctttggggctgcccacttcagcataccaaatttgaaggggcttgggaaaccaagggtggaaaagggggccaagcactttggggacagaatttctgcccaaaccattccggaaagggaaaaccggaaccgggaacacatggggggaatttttgaaaccaaaaaccctatctttttttgttatagggggggggacactccaaaatatcttttaaaaggaaaataggggatttgggacccccctacaggggtttcccctatttttttgggggccccaaaaattttgccccaagggggggaaccccccgggggggggcgttttttccccataggggggcctccgggggtccgcacaaaaagggggggtgtaccctttttgtttaaaaaaaaaaaccgccctatataaaaacctattttgggaacctatttttttccccggggggggagaacaacccccccaccacctggggtgggggaaaacacactcccgggggggggtgtctccctaaaaaataaaaagaaagagn

SEQ ID NO: 84063 - DNA, 1053 bp, Zea mays
  misc_feature: Ceres CLONE 1570032
  misc_feature: Encodes the peptide sequence at SEQ ID NO. 84064
caccgcggtggcggccgctctagaactagtggatcccccgggctgcaggaattcgtctcacccctagaaaaaccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacacccccccttgatgccatgtgtctctttggcaagagggtttattgatgcctcctgtccagaatgatatttaagctgggggtctcttcagggtctttcctggggcccggggagaagcccaatgaaaatgggtccccccacaaggggggagggataaaacagaatttgtgctcccgaagaaggatttccctcccttgggttgccctttcaagaaagtgcggggaataatactgttagatgcttttactcctgtgggcgcgccaccggcaccctaatatatctctttgatggtactgcgtggtatctcctgtccactcccttgttaatcagaacactataatggttggtgcagtggctactcaacacggacgagcggggagggtggaattcgatgtttgagttatggacgtagcagggggtatagctctcatgacaggccacccaacagcttggcgctgtctgcggaggcggtagttgctcgcgctcgagataagaacatcacacgagtgagtgtgttggagcagtagtgcactgctacttcgctaggcctggctggggtgtggtatacccactagagtaggtatggactactgaagtcagaagagatcataagaattccaacacgtcgtggcgacacacctgcttacagaaatttataattggt

SEQ ID NO: 84064 - protein, 71 aa, Zea mays
  misc_feature: Ceres CLONE 1570032
MAGKGDGPAIGIDLGTTYSCVGVWQHDRVEIIANDQGNRTTPSYVAFTDSERLIGDAAKNQVAMNPINTPP

SEQ ID NO: 84065 - DNA, 788 bp, Zea mays
  misc_feature: Ceres CLONE 1570033
  misc_feature: Translation starting site: 193
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtcagtgcagagtgacatgaagctatggccgttcaaggtcatcccagggcctggtgacaaacccatgattgtagtcaactacaagggcgaggagaagcagtttgctgctgaggagatctcctccatggtcctcatcaagatgaaggagattgctgaagcctaccttggtttcaccatcaagaacgcagtggtgaccgtgccgggctattttcacgactcgcagaggcagggcaccaagggacgcccgtggtatttgcgggccctcaaggggaatgcgttttcatcaaacgagcccactggctggggggcttttggccaaaggggctttgacaaaaaagggccccccct

SEQ ID NO: 84066 - DNA, 827 bp, Zea mays
  misc_feature: Ceres CLONE 1570038
  misc_feature: Encodes the peptide sequence at SEQ ID NO. 84067
  misc_feature (101)..(101): n is a, c, t, g, unknown, or other
tccccgcggtggcggccgctctagaactagtggatcccccgggctgcaggaattcgtctcacccctagaaaaaaaactgtaaaaatcgaggggttcaaacnagaaaagtgagccccaaaccctacaccctcatggaagcgtggccacctctcgcccccgcggcggccactccggcctgtgccttggcgtggggagcagcagcaacggcgcagcggaaggccgtggagcaggagtcagcggcgcaggcggtgagccgcatcgtggcgagctgcgccaactcccagcgcgtggcagtcgccgtggtggacgccaaacgcgtcatctccgggcgctccgctctctccacttccgcggggcgccttgtcaccgtgcccaaggactcgaggaggtccgggaaccaacccccccgggggggcccttggggctccttcccgtttccctttaaaaccctttaaaccctgcccccggatttcgtttaaaaaaatttcccaatttttccccggggaaacaggggaaaattcccaaaccttttcaaaatgtttgaaaaaaaaaagaaattttgcttttgggccctacccggttaaaaaagcgtaaaaaatccccggggggatctcccctttttggaagaaaaccccccccccccccctcttgtggggggggaagttttaaaaaaaatttttttaaaaaaccaaaaaaggcggggggggggggtctttatggcgccccccccccgaaaaagggggggaaaatatgttcccaaattttctcccccgggggggggagaaaaaaaatattttgaaaaattctctccgagaagaaaaggagaa

SEQ ID NO: 84067 - protein, 107 aa, Zea mays
  misc_feature: Ceres CLONE 1570038
MEAWPPLAPAAATPACALAWGAAATAQRKAVEQESAAQAVSRIVASCANSQRVAVAVVDAKRVISGRSALSTSAGRLVTVPKDSRRSGNQPPRGGPWGSFPFPFKTL

SEQ ID NO: 84068 - DNA, 849 bp, Zea mays
  misc_feature: Ceres CLONE 1570040
  misc_feature: Translation starting site: 218
  misc_feature: SWISSPROT Homolog: EC 1.6.99.5 NADH dehydrogenase (quinone)
  misc_feature (794)..(794): n is a, c, t, g, unknown, or other
agctccccgcggtggcggccgctctagaactagtggatcccccgggctgcaggaattcgtctcacccctagaaaaaaggaggcggctggcctccgtccgcgcatcctcttctggcgaggagctcccccacgcagccgctgctctctccacgtcctctgttccttcccctccccgatctcccccaatccgaccaaaccggcagagccggggggcggcgatggcgctgcgacgggcgctcctcagatcggcagagttctctttcgaacgcaaggctgcaattgagtacactcattctttatcaagggcacagcctgctcgttctctcaatggtgctggcctttgtcctgctagtagatcacttagcacccaggccgccactacgtcaagcacaccacagcctccgcctcccccaccccctccagagaagactcactttggtggcctcaaagatgaggatcgcattttcaccaacctctatggtctgcatgaccctttcctgaaaggcgcgatgaagagaggtgactggtataggaccaaggatttggtgatcaagggggcagactggatagttaatgaaatgaagaaatcaggtcttcggggtcgtggaggtgcaggttttccttctggtctcaaatgtcctttatgcccaaggtttcagatggacgcccttcttatcttgtcgttaatgctgatgagagtgagcctggaacttgcaagatagagaaatcatgcgccatgacccccacagcttctggaaggatgctttattgctgggagttgaatgagggcatccnctgcttacatctaccttaaagggggatacgtggatgagcgtctcaaccttgagaa

SEQ ID NO: 84069 - DNA, 999 bp, Zea mays
  misc_feature: Ceres CLONE 1570042
  misc_feature: Encodes the peptide sequence at SEQ ID NO. 84070
gcggtggcggccgctctagaactagtggatcccccgggctgcaggaattcgtctcacccctagaaaaaatttgctcgcgatttataacctcccctcgccttcgcctctcctttctgcttgtcttttttccccagtggggaggttagcacccggcacaagcaaagcgccgggttcttgtcgcagtttctgcgcgctcgctcgctttttgcccgtaagatctgatacaaagaggagagggagagccaagagaggagaggttctcgtgtggaattcttcggcgatgaggtccgacgcccgtctggattcggtggtcttccagctcacccccacccggaccaggttcgatttggttctgatagcgaatggccggaaggagaagtttgcatctggtttgctgaaaccgttcgtcgctcacttgaaggccgcccaggatcagattgccaagggagggtactcgatcacacttgaaccaagctcagggttcgatgtgccatggtttactagaggcaccgtggagagatttgtgcgttttccgtgagtactacccggaggtccttgagcgagtcagaacactggaatctgagaatcctgcagctcgaggatgccattgctatccatagcaaaccataagtcttggattaaaatctgccgaagaaccatgtaaaaaaagttgactgaaaacaatggaagggggacgtgccaattatgatcctggaattcccgccacagcaattgttggtttacaagccctggaacaaattccaacgcccccaatattcgaaatgaaacctgccccccaggagggaaaattcaaaaattcaaatttgcctaaaattgcttgaaaaccctcaaaaatttgtgttaaaaaaaagacaggcctaagggtcttccctccatgactgatactccatggggtttaaattctacaaatttgggggttattgtataccacattccgaaaagcgcttgtgtgtgctacaacctcattataataaattg

SEQ ID NO: 84070 - protein, 85 aa, Zea mays
  misc_feature: Ceres CLONE 1570042
MRSDARLDSVVFQLTPTRTRFDLVLIANGRKEKFASGLLKPFVAHLKAAQDQIAKGGYSITLEPSSGFDVPWFTRGTVERFVRFP

SEQ ID NO: 84071 - DNA, 959 bp, Zea mays
  misc_feature: Ceres CLONE 1570044
  misc_feature: Translation starting site: 462
  misc_feature: SWISSPROT Homolog: EC 2.7.11.1 Non-specific serine/threonine protein kinase
  misc_feature (959)..(959): n is a, c, t, g, unknown, or other
ctccccgcggtggcggccgctctagaactagtggatcccccgggctgcaggaattcgtctcacccctagaaaaagtccgtctcccacggtttccgcgtcccacccatcccttccacactttctcacccccgcccttctcaccccccgaaaaaattcccccggaaatcagagacgcgaatccctccctcgccccacgtccgaggtcgctcgccaattcgatccgcctcatcgtcgcccgcccgcccgtccgccggtcgaccttgactgctccgtcgcacgtggcgtttcgcagcgcggaatctaccctgggttgggttgggagatccggggaaacccttgttcccgggcgctccgggctcgaatctcgctgcagacgggcaatgtgagcgctctccatcagagagggacgatctgcggggcggttgttggccgggtgaatcgtgcggtgcggggttgcgggaatggagcacgtgatcggagggaagtttaagcttgggaagaagatcgggagcggatctttcggggagctctatctcggtgtgaacgtacagagcggcgaggaggtggctatcaagttggaatctgtaagatcaaggcatcctcagcttcattatgagtcaaaactatacttgcttctccaagggggaactggaattcctcatttgaaaaggtttggagtggatggggagtacaatggcacggtgcatggatctttctgggccaaggctcgaagacttgttcaactacgggaacagaaagttcctctttaaacaggaccttttgctagctgatcagattgatatctgggggaaagtacatggcacccgaggggggttccttccttcggtgtatcaggcaggaaacttcctcatgggctttaggcggaaaacagagccaggtttttgtcattggctaggggccttggaaaaaatttcgggacctccgaaccctgaggaccn

SEQ ID NO: 84072 - DNA, 813 bp, Zea mays
  misc_feature: Ceres CLONE 1570049
  misc_feature: Encodes the peptide sequence at SEQ ID NO. 84073
ctccccgcggtggcggccgctctagaactagtggatcccccgggctgcaggaattcgtctcacccctagaaaaaacttccacctgaactttgccctgccttctctcgacgactcccctgtccccgccgccgccgccgccgcaaatccccttccgcgtctgtctggcctctggggcttctaggttagcgcgtgcgaccaccatggccgaggaggtccaggctccactttccgccaccatggcgaaggaggcccagtcgccgccgtccgcaaccatagcggaggcgacggcgccgccgcagctcttattatttaactcctttacgaagagggaggagccattccagccccgggtagaggggaaggtagggatgtacgtctgtggcgtcactccctacgactttagccacatcggccacgcgcgtgcctacgtcgccttcgacgtcctctacaggtaccttaaattcttggggtatgaagttgaatatgtccgtaatttcacggatattgatgacaagattattaagcgtgccaatgaacgcggtgaaacagtaacaagcttgagtagccagtttatcaatgaatttcttcttgacatgactgagctccagtgcttgcctcctacctgcgagccacgggtaacagaacacattgagcatattataaagttgagaacacagataatggagaaaggcaaagcctatgctattggaaggagatgtttacttttcagtttgaaagttttcctgaaatatctcagttttatctggaagaaaaatttgaatcaaaatcagggcaggtggcacgggtttgcta

SEQ ID NO: 84073 - protein, 204 aa, Zea mays
  misc_feature: Ceres CLONE 1570049
  misc_feature (46)..(204): Pfam Name: tRNA-synt_1e Pfam Description: tRNA synthetases class I (C) catalytic domain
  misc_feature: SWISSPROT Homolog: EC 6.1.1.16 Cysteine--tRNA ligase
MAEEVQAPLSATMAKEAQSPPSATIAEATAPPQLLLFNSFTKREEPFQPRVEGKVGMYVCGVTPYDFSHIGHARAYVAFDVLYRYLKFLGYEVEYVRNFTDIDDKIIKRANERGETVTSLSSQFINEFLLDMTELQCLPPTCEPRVTEHIEHIIKLRTQIMEKGKAYAIGRRCLLFSLKVFLKYLSFIWKKNLNQNQGRWHGFA

SEQ ID NO: 84074 - DNA, 891 bp, Zea mays
  misc_feature: Ceres CLONE 1570050
  misc_feature: Encodes the peptide sequence at SEQ ID NO. 84075
  misc_feature (891)..(891): n is a, c, t, g, unknown, or other
caaagctggagctccccgcggtggcggccgctctagaactagtggatcccccgggctgcaggaattcgtctcacccctagaaaaacttttccgctccagacacagcagcccctcttgtaccagtaaaccgtgctgctatcccccgctagccgccgcgctgctgcggctcgcctccctcctccccagtccccaagccccgccgccaccgccgccacctcctctcgctccctccttttaccccgagcttaagctcgcgcgtacctgcctacctatccgtaggagaggaagaggggacaaggcccggtcggtcggtcggtcggtcggggggctctcggatctcgccgctgcctccccgttcgttcgttcgttcgttgggatctcgcgccatggccgccgtcgcgccgcccccggcccccgcgccggcaccggttcctgctcctgctcctgccaccggccctgtcgcggatcaaaccacggatctgctgcagaagctgtcgctcgactcgcagcccaagccggcggacgcaacacagcctgctgctgccaccgccaaaaagggcgccgcggcgagccagccgctgagcgtggcgatcccgccggagccgtccatcaggccggtgatccaagactttacggatccccacccgttttatctaccaggcgtattactacgggaggctacgaacagttccattgagcgaatggggaagatttatccggagatatcttaaattccgaatggaaatgggaagaatggcccccagccggttaaccgggagaaattttattggggcaaatgggggcaaggctccccccgaccggggggcaataactctgtctctgtggcagaactgtcgcacactggattcctcaaaataacttttgtgaagn

SEQ ID NO: 84075 - protein, 114 aa, Zea mays
  misc_feature: Ceres CLONE 1570050
MAAVAPPPAPAPAPVPAPAPATGPVADQTTDLLQKLSLDSQPKPADATQPAAATAKKGAAASQPLSVAIPPEPSIRPVIQDFTDPHPFYLPGVLLREATNSSIERMGKIYPEIS

SEQ ID NO: 84076 - DNA, 997 bp, Zea mays
  misc_feature: Ceres CLONE 1570052
  misc_feature: Encodes the peptide sequence at SEQ ID NO. 84077
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
tgtgatccgattttgtcctttatttaaccggcgaggaacgccacacatagggggnnnnnnnnnnnnaaaaactggagctccccgcggtggcggccgctctagaatagtggatcccccgggctgcaggaattcgtctcacccctagaaaaagcacgcaccccaccccctcctgccgtcctcgatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccactcgccgcgctggcggccaccgccgcggccctcgtcgcggggctgcttattatcgctgtctggttccgatccggaggcgggacgccgtccaagccggtcgccacgccggtacggccaccgccggtcaaggtggacgccgacgcccaccttgatgacggccggaagcgcgtcaccatcttcttcggcacacagactggcaccgccgaggggttcgcaaagtccatggcggaggaggcgagggcgcggtacgagaaggccgtgttcaaaggggtggatctggaatgactatgctccaggaggacgaggaaatacgaggaaaagcttgagaaaagaaactgtgggtgctgttccttcctagcaacatatgggggatggggaagccaaatgaaaatggagcacgaattctccaaaagggttttactgagggagaaaaaaaaaagaaattttggtttaaaggatcttaaaaaatggggatttttttggcctttggaaaaagggcaaaaaccgaaattttttaaaaaaggtttccaaaggggggtaaataaaactcttttaaaggaaaccgggggggggaaaacttcttgttctccttttggccctcttggaaaaaaaaaaaatacggggttttttgagagaatattttcccccgccctgggaaaaaacaactatgtgtgg

SEQ ID NO: 84077 - protein, 121 aa, Zea mays
  misc_feature: Ceres CLONE 1570052
  misc_feature: SWISSPROT Homolog: EC 1.6.2.4 NADPH--hemoprotein reductase
MAALEAAREWAGSVIPPELAAAAGGDPLAALAATAAALVAGLLIIAVWFRSGGGTPSKPVATPVRPPPVKVDADAHLDDGRKRVTIFFGTQTGTAEGFAKSMAEEARARYEKAVFKGVDLE

SEQ ID NO: 84078 - DNA, 844 bp, Zea mays
  misc_feature: Ceres CLONE 1570054
  misc_feature: Encodes the peptide sequence at SEQ ID NO. 84079
aaagctggagctccccgcggtggcggccgctcttcaactagtggatcccccgggctgcagtgattcgtctcacccctagaaaaaagagcgagacgcgtcgcctcctcccttcccccaccccgccgccgccctcgcgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgctctgttcactgcactctttagcactgtgtccttcttgcttggagccatcacctctctggtctctggtttccttggcatgaagattgccacatatgcgaatgccagaactaccctggaagctaggaagggtgttggcaagggctttatcactgcttttccgctctgggcgctgttaagggggttcctgccttgcatccagggggacatgtgggctctggtacatccacaatttaagtgtatttaaagttggttttaccgggggaatgaactgggggaggggta

SEQ ID NO: 84079 - protein, 211 aa, Zea mays
  misc_feature: Ceres CLONE 1570054
  misc_feature (6)..(212): Pfam Name: H_PPase Pfam Description: Inorganic H+ pyrophosphatase
  misc_feature: SWISSPROT Homolog: EC 3.6.1.1 Inorganic diphosphatase
MAILSALATEVLIPVAAVIGIAFAVVQWVVVSRVKLSPAASGGSGGKAGYADSLIEEEEGLNDHNVVVKCAEIQNAISEGATSFLFTEYQYVGIFMAIFAVVIFLFLGSVEGFSTKSQPCTYSKDKYCKPALFTALFSTVSFLLGAITSLVSGFLGMKIATYANARTTLEARKGVGKGFITAFPLWALLRGFLPCIQGDMWALVHPQFKCI

SEQ ID NO: 84080 - DNA, 884 bp, Zea mays
  misc_feature: Ceres CLONE 1570056
  misc_feature: Encodes the peptide sequence at SEQ ID NO. 84081
ggagctcaccgcggtggcggccgctctagaactagtggatcccccgggctgcaggaattcgtctcacccctagaaaaaagctcgctcgtatctcctctctggacgaacagatcctctctggacgaacagaaaggttaccagcagcaccacggcgagatctccccttggcgggccaaaaccgacggcgagcttcaccggcgttggtcggctccaatctcttcgccgttttattttcctcccaggttaaggttgcaggcttttagcttgggattctgaaagatggggacctcttctggcgcgaatttccatcagcaacctcctccgacccaggggatgttgcctccaaggcatggtccacgcccctcagggttgcagacctcgctctcgctggcctcttcggagcaggttggctcgcctgacatgcaggagcctggttcaaactcggagccagggcatgattccgccactgagagcgccagttccaaagacacatggccagctgagccgaaccagagcaatggtggggtggctgccagtgatgttgtgagtaaggcggcggagaaggaggtggcaaatggtgtatccaagccgcatgttatccatggaccctcctcccgtgtgagtgggatgcttctgcgggaggttgcacgggaagaggttgatctggtcgctgagaagatgaagatgatgtcggatgagcacctagaggaggtcaagaatgagctcaggtcgatttctggaggcactgggaggtctcaccacatcgaggagttcttgtacctgcagagcttgtccaggaacagcatgatttgacaccttccatggcttcagtggcacacatgtgccagctgagatccttgttgcaatcaagactgggatcaggc

SEQ ID NO: 84081 - protein, 177 aa, Zea mays
  misc_feature: Ceres CLONE 1570056
MGTSSGANFHQQPPPTQGMLPPRHGPRPSGLQTSLSLASSEQVGSPDMQEPGSNSEPGHDSATESASSKDTWPAEPNQSNGGVAASDVVSKAAEKEVANGVSKPHVIHGPSSRVSGMLLREVAREEVDLVAEKMKMMSDEHLEEVKNELRSISGGTGRSHHIEEFLYLQSLSRNSMI

SEQ ID NO: 84082 - DNA, 825 bp, Zea mays
  misc_feature: Ceres CLONE 1570059
  misc_feature: Encodes the peptide sequence at SEQ ID NO. 84083
ctggagctccccgcggtggcggccgctctagaactagtggatcccccgggctgcaggaattcgtctcacccctagaaaaaacacaccaccactccttccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaagctactggtgcctccatcttgacagcgagccataacccaggtgggtcctaagaaggacttcggggatcaaatacaccatggggaaatggtggggccggctccggaatctggttaccgacaaaaattttcccaaattaaacgacaatccccgaaatacctcatccctggaaaacactacccaaaaggggaaattttcggggtgggccgggggcccccccctttcggtgggaccccaaaaggccccttttgaagggggaaatttttttaaacccccagagt

SEQ ID NO: 84083 - protein, 130 aa, Zea mays
  misc_feature: Ceres CLONE 1570059
  misc_feature (16)..(131): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATGASILTASHNPGGS

SEQ ID NO: 84084 - DNA, 930 bp, Zea mays
  misc_feature: Ceres CLONE 1570060
  misc_feature: Encodes the peptide sequence at SEQ ID NO. 84085
  misc_feature (568)..(568): n is a, c, t, g, unknown, or other
  misc_feature (833)..(833): n is a, c, t, g, unknown, or other
ctccccgcggtggcggccgctctagaactagtggatcccccgggctgcaggaattcgtctcacccctagaaaaaaaaaattctcgtggtatccagagtcagtctctagaccgccatacggaggttgggccgggcgtccgacgcgcgccggcggtgcttccagagcccctgcccccctgcggcgcgtccccctccgacttcacccgtgagtcttcttcttcccggtcatgccccttcttccctgagtaggaggcgacagatcagaatcctcctagctcgtgcggcaccgtgcgaggagcacggctcggctccggtgcccccacgcgtggaaggagcgcgggcgaggtgttggcggctccggcggcgcggtgtgcaaggcgagcgcgtctctgggctgaggccaccggaggtcgagcgcgcaggagggctatctgcttccgcgtgcggagctcttatctcagcacgacccacccctcccgacgggatagagtattgaagtacacaagtgcatatgcagctggatttggagtggtaaagacgggaaccgaagagctggtggatcagaggtngtggggagatgtaccgtgggggccttgaccgcttcaagaaggcacagaccttggagcccctctcagtgaagtctgagtcaggcaccaagaatgcacctgcagctgcaggaacagctaaagcactggctccgttgacactgccactgaatttctaattttgtgcaggtcagaaccaccaagtccccaaggaccatctccagggtggctgggcaaggtgtgatgctccaggtcatgttggtaccaggtcgggggattgcagtcgacntggcacctccagactgggcgttgagccgcgccagtggtctacatcctgatgtttggaaagatggggaggcattgacagatcatttggacaacagagc

SEQ ID NO: 84085 - protein, 48 aa, Zea mays
  misc_feature: Ceres CLONE 1570060
MYRGGLDRFKKAQTLEPLSVKSESGTKNAPAAAGTAKALAPLTLPLNF

SEQ ID NO: 84086 - DNA, 913 bp, Zea mays
  misc_feature: Ceres CLONE 1570063
  misc_feature: Encodes the peptide sequence at SEQ ID NO. 84087
  misc_feature (748)..(748): n is a, c, t, g, unknown, or other
  misc_feature (754)..(754): n is a, c, t, g, unknown, or other
  misc_feature (775)..(775): n is a, c, t, g, unknown, or other
  misc_feature (815)..(815): n is a, c, t, g, unknown, or other
acccgcggtggcggccgctctagaactagtggatcccccgggctgcaggaattcgtctcacccctagaaaaaatcccgcgccccgaatttccggagccaactccgccctgccctgtcgctttcccttccactcgcgccgttcgctttgatcgatcaggcaggcatggccgacgagacgaagcaagaagccgccgcccccgcggccgaggtggtcgtgacggaggatgagaagaaggcagaagagaccgccccggtggcggaggaaaaggccgtggaggcggctgtagagaaggccgcggaggcggaggcgggggcggaggaaaaggtctcggaatccgactcggaggaggagaagaacgcggacgaggcctacgaggccgcctcgggggatgacgcggcggtgatcgatagcactgggtcgatcaaagaggagaataaccaggagtacgagctccccgaccctgagcgcacagcgctcgcgcaactcaagggagctcgtcgccaccgcgctcgctaacggggagttcaacctggcgccgccggcagccaaggatgaggccaagaatgatgagccggcaaaggaagatactccggcggacaaggatgacgagcccaacgcacaggatgcggctgcccatgaacccgctcaggatgtaggccatgctgaggagccaatactgatgcgccggcgggagcacgccccgaggagttaaggacgagacacctgtgcggtagagactagactgangctccngcgccggaagaacccaaggcngatgagcctgccaaggtagactcaaagctcaggcgcgacngagacgtcccgtagaaacaacactttaaacccgggccggaggagaagaaaaaacagcctggtgcccaagagagcccacaaagggggaagcattgagga

SEQ ID NO: 84087 - protein, 117 aa, Zea mays
  misc_feature: Ceres CLONE 1570063
MADETKQEAAAPAAEVVVTEDEKKAEETAPVAEEKAVEAAVEKAAEAEAGAEEKVSESDSEEEKNADEAYEAASGDDAAVIDSTGSIKEENNQEYELPDPERTALAQLKGARRHRAR

SEQ ID NO: 84088 - DNA, 835 bp, Zea mays
  misc_feature: Ceres CLONE 1570064
  misc_feature: Encodes the peptide sequence at SEQ ID NO. 84089
  misc_feature (790)..(790): n is a, c, t, g, unknown, or other
ggagctccccgcggtggcggccgctctagaactagtggatcccccgggctgcaggaattcgtctcacccctagaaaaagctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggtgatataacgacaaaccacttccctccctatccatcgtgaagcccctgcttttcgtgagcaggccactgagcagcaaattcctgttactggaaatcaagtccgtggatcttcnttgcacccttacaaagagggtggaaaaattggtcctattcggtga

SEQ ID NO: 84089 - protein, 190 aa, Zea mays
  misc_feature: Ceres CLONE 1570064
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDITTNHFPPYPS

SEQ ID NO: 84090 - DNA, 820 bp, Zea mays
  misc_feature: Ceres CLONE 1570066
  misc_feature (387)..(387): n is a, c, t, g, unknown, or other
acccgcggtggcggccgctctagaactagtggatcccccgggctgcaggaattcgtctcacccctagaaaaaagacccctaaccttttcgcagctccaggctccagcgcacagccgccgccgtttcttcatcttcttcgcagagccggcgctccatcttcggctccctcccttacttgcgctcggcacgcaggcggcggcggcggcgctgtggctcgggatctcagtgacggcatcagcggcttcccctcccgcctctcgccagtcgcctccgggtcctccgcaaccggccggtgatctctccctccgcctcggtggatcgcacgaccccggcccggcggctgcgcgcgcgcgtcctgaggcagctgcagcgctgctccacaatgcngtcgcgccgcttgggagcggtttatgccccaaagtgaagcgtgctcctagtgccgctcttgggaaccctggctaccggctgtttattgggtcaaaccttcagtcattctaggcactgccaagttttgatccccccaacccgatttttgggaaaccaaaaaacggggcccctgtttcccgcccttttttcagattccaaaacccccaaagttaaacccccctgggaaaaaacccccggaaaaaaggggggtctttaagggggggggggggggaaaacccccaaaatccccccctttttttggccccccccccccaaaaagcccccccccccgggggggaaaaaaaaaataaaaagggtgtttttaacaaaaaaaacaccccatatgggggggtcccccgcggggggccccccttttcccccaaaaaagaaaaat

SEQ ID NO: 84091 - DNA, 857 bp, Zea mays
  misc_feature: Ceres CLONE 1570067
  misc_feature: Encodes the peptide sequence at SEQ ID NO. 84092
aagctggagctccccgcggtggcggccgctctagaactagtggatcccccgggctgcaggaattcgtctcacccctagaaaaaaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggagacgccggtgcttggctggatcgtgctcggcgtcctcaagagggacaacctcgtctacaagctcgtctcggacgctgagatcccggagccgccgctgttcacggccacccacacatggcaagcgatccgggagcagagcgtgcgcgtgacggagccgaggctgtcgccggcggagcgcgtgcaggaggccgtcgcctgcgtcccagctgctgcccaggcccagctggagccggcggcggggtttaggcgctggacggtgcgggacttccacagggcgtacagatcaggacaggctacccctaccatggtggcgcggcgattcctggcagccgtggaggaatgttcagggcccggacctgacatggggcttcttcatcagctgcgaccctggcgacgtgctgcggcagggccaaggactccacccgcagataccagcaaggggcgcccgctgtccgcccatggaccggattgctgggtcgcccgtcaagggacgagcttcgactggcctgccggtacccgaccagcgggcggcaacaacggggggcctggggtcccgggccccggcggtgcccccggccg

SEQ ID NO: 84092 - protein, 242 aa, Zea mays
  misc_feature: Ceres CLONE 1570067
MGFFIPPPKVYKPAAEVDLGPDSDEHYISPNVKAPRVAGFLVKMLAWVLETPVLGWIVLGVLKRDNLVYKLVSDAEIPEPPLFTATHTWQAIREQSVRVTEPRLSPAERVQEAVACVPAAAQAQLEPAAGFRRWTVRDFHRAYRSGQATPTMVARRFLAAVEECSGPGPDMGLLHQLRPWRRAAAGPRTPPADTSKGRPLSAHGPDCWVARQGTSFDWPAGTRPAGGNNGGPGVPGPGGAPG

SEQ ID NO: 84093 - DNA, 795 bp, Zea mays
  misc_feature: Ceres CLONE 1570068
  misc_feature (577)..(577): n is a, c, t, g, unknown, or other
  misc_feature (581)..(581): n is a, c, t, g, unknown, or other
ctggagctccccgcggtggcggccgctctagaactagtggatcccccgggctgcaggaattcgtctcacccctagaaaaatccccgagagccgcttcttctttctccgtgactcggagctgtctacctcaccctcactgcctctgcgtgcgtgcgtcactgccggtctgccgtgccgctgcgcccgctcccgcaataaataaactcacctctctctgttctccgttctcacctccctcctcatccatccagggacgcgccttgacttctcacgtcgtgtcgtgtgtgagcgcagcggtgctgctgatctgcgattcctccacgccacaccctacctgaccacccgacagggaatcctactccctcttgcgcgccgcggcggcggcggcggcatcttcggtctccgtgcgggtgtttccgttcggcgtttactggccgggcgagcgcggcattggaggagtcgggaggagggagacaggaggcgtgatcgatggggaactgcgtggcgagcgggggcgcgacgacggtcacggcggcaggtgaggacgggaggcggcggggaatgtaagttggaaggncccncggggaggagcacctcggctcggtcccccggccggatcttctccaacgacggccgcagccgcaccgccgccgtgttcacgcagcaggggccggaagggggtcaatcaggacgccatgctcgtctgggaaaggggtcccgcgggggaggaagaactcccggctgtggtgggggggggtccaaggggcaacagcccgtaatggggcaccctgggtg

SEQ ID NO: 84094 - DNA, 838 bp, Zea mays
  misc_feature: Ceres CLONE 1570069
  misc_feature: Encodes the peptide sequence at SEQ ID NO. 84095
agctccccgcggtggcggccgctctagaactagtggatcccccgggctgcaggaattcgtctcacccctagaaaaaaaaaccacccggctccaaaccctagccacctcccccgtcctgtccccagatctcgctgccgtctgacccgcctcgcttcgatgtgacccggccctagggtttgagacgtgttgcggtaggggtgttctcaaggattcacgacacgagagagattcggggaggcgtcgacggtgcgagcacacatgaaggacccggcgcaccgcacgaaggtggtgctccggcggctgccgccggcgatcgcgcagcaggccgttgtggaccaggtcgacttgcgcttcgctgggcggtacgactgggcgtgcttccgccccgggaatgccagccaaaagaaccatagacattctcgactttaccttaatttcaagcgccccgaggatgttgttgagttcgctgaggtcttcaatgggcacgtatttgtgaatgaaaagggtgctcagtttaaagctttcgtggaatatgcaccatcacaacagggtccaagtcactatcagaaggatggcggtgaggactattatgaagatcggagtactggagtttcttggagtatttcaaagcctactgacatctgctagtgctgaattcagctcaaaggaaaaaactaaaagggcacctgcttggaaggagggccttgttggtgcaccctctttaagaaggattttcccccccccaaaggggccacttaaaaaatttgggtttccaaaaacctgtggaagtaaactttttccgaaaaaaccttgcaaaggtgttgtaaagaagatttca

SEQ ID NO: 84095 - protein, 129 aa, Zea mays
  misc_feature: Ceres CLONE 1570069
  misc_feature (1)..(129): Pfam Name: Smg4_UPF3 Pfam Description: Smg-4/UPF3 family
MKDPAHRTKVVLRRLPPAIAQQAVVDQVDLRFAGRYDWACFRPGNASQKNHRHSRLYLNFKRPEDVVEFAEVFNGHVFVNEKGAQFKAFVEYAPSQQGPSHYQKDGGEDYYEDRSTGVSWSISKPTDIC

SEQ ID NO: 84096 - DNA, 1293 bp, Zea mays
  misc_feature: Ceres CLONE 1570070
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (951)..(951): n is a, c, t, g, unknown, or other
  misc_feature (1293)..(1293): n is a, c, t, g, unknown, or other
cttccgtttccccctcttcttcttccccccccccctccccatccccaaacatnnnntttannnnnnnaaaaactggagctccccgcggtggcggccgctctagaatagtggatcccccgggctgcaggaattcgtctcacccctagaaaaagtgctgcgctgatcttctgtgagtagtgcgcgcggcgtggtctcccttcgaaccgatgcccatctgctgaatccgatcggatcgggcgattcggcgccacgccacggcccgcgggggaagcgtgggtctccgggagggaagccaccttttcccgcccgggtttagcctctaatggattcccgggggcccggacgccccccaaaaaaaggaatgggaaccccttccccccccgaagggggaagaggccccccgccggggggggctctaacaggtccaaaaattgggaagggggccccccccccctcccccccccctttccggaaaggggggtggtttccccccccccccctccttcctttttttttacaaaaaaaaaatgtttctggcgccccccggggggagaaaagaattcgggggagtccccttcgtttcttgggggccccctcctttgcctcaaaaggggcgtcttctctgggggtgggggggacctcccccggttttttttttccccctctcccccaaaatttggggggatatattctctttgagggggtggttctccctcacatataaaactattctgtggtaatatgtggtttttttttcattgttgtctcaaatctcttctttcttcttggcgggtgcatataactgcggtgtgtgggggaaagaaaataatcccccacctccccggcccccgtaagtgggggtgggtctcccctcttactctctactcatgacgtattttgttgtaggacggagaggtttctttccgtggaccattcgatcgctgcttgttntgtggtgaagaacgattcatgcactcccttcttccttctctggcagggagtgggctgtatttatttctttttagcgatatccgtctcccgacacttattttaggtgtggtgccttattcttagctagactgcttgtcccagattactagtatctctattgcacacggtgttactgtgtggacggtgtcgttttgtggtgttattatgctcgtgcttgtcctctgtttgttgtcgtgcggtgtgtgttgtgataatatgtgttttagcatctgtatgatctgcgacttcgtgtcctctcttatgattgctttgttttgtaccgcgtctgtgttttacgtcagn

SEQ ID NO: 84097 - DNA, 867 bp, Zea mays
  misc_feature: Ceres CLONE 1570071
  misc_feature: Encodes the peptide sequence at SEQ ID NO. 84098
caaagctggagctccccgcggtggcggccgctctagaactagtggatcccccgggctgcaggaattcgtctcacccctagaaaaaaagtccgcaaacccctctcgatcgacacacgcagccgcgacccatcgagacctgacccgatcctcccgaggccgccagccttatcctctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggcccttgctcaggggctgattgctgagggtgttaaaggggggagcagctggtgcttaatcccgttcagaattactcgcgggtaatggaaaaaaacggctaaaagcacctagttgaaggaattaagggaaagtttgtttaaacggaagggtgaaaaaataaggaagccttcgcaaaaatggtggctgccaggttaaggtgctgtgggcaaacaagcgcatgaaaaaattgggtaaaaccgtcatatagccgagaagggcgcgcgt

SEQ ID NO: 84098 - protein, 154 aa, Zea mays
  misc_feature: Ceres CLONE 1570071
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVALAQGLIAEGVKGGSSWCLIPFRITRG

SEQ ID NO: 84099 - DNA, 860 bp, Zea mays
  misc_feature: Ceres CLONE 1570072
  misc_feature: Encodes the peptide sequence at SEQ ID NO. 84100
ctccccgcggtggcggccgctctagaactagtggatcccccgggctgcaggaattcgtctcacccctagaaaaaagacgcatcaaaccgccctcctctgtccctccctctcccgtctgccccctcgcatccccaaattaagccccgcgcgcaaggcagcaaacgcgccgcgcaccggaaggccccggggagctgcacgaggtggccccattgcggcatggctgctacggccgccgccgctggcgtcgagttcccgctcattggcgttgccgtggccacgctcatcgtgacggtccttgtcgcggccgtgatgcgccgccgccgccgtccctggcaccaggcgcctctggtggaggggaaacccgcaccagaggcaggctgcgcggtcagcgatggcgggacggacgtcatcatcgtcggcgccggggtagctggatctgcgctggcatacacgctcggaaaggatggccgtcgggtgcatgtcatcgagagggatctgacagaacctgacagaattgtgggcgagctggtgcaacctgggggttaccttgaattaattgagctgggcctccaagattgtgtggaaagaaattgatgcccaaacgcgtgcttggttacgcattattccaaagatggaaggaacacaaagctttggctatccccctgggagaaattcccattcctgaaggttgcctggtaaggaaccttttcccaatggggaaggttttataccaaagggaaggcggtcaaagaaagctgggcgtccttttgcccaaatggttccaaatttagaaagcaaagggaaaaggggttttcccccccctttcccttggaaagaaaaaaatggtgaacctcggttaa

SEQ ID NO: 84100 - protein, 125 aa, Zea mays
  misc_feature: Ceres CLONE 1570072
  misc_feature: SWISSPROT Homolog: EC 1.14.99.7 Squalene monooxygenase
MAATAAAAGVEFPLIGVAVATLIVTVLVAAVMRRRRRPWHQAPLVEGKPAPEAGCAVSDGGTDVIIVGAGVAGSALAYTLGKDGRRVHVIERDLTEPDRIVGELVQPGGYLELIELGLQDCVERN

SEQ ID NO: 84101 - DNA, 1027 bp, Zea mays
  misc_feature: Ceres CLONE 1570078
  misc_feature: Encodes the peptide sequence at SEQ ID NO. 84102
  misc_feature (695)..(695): n is a, c, t, g, unknown, or other
ctccccgcggtggcggccgctctagaactagtggatcccccgggctgcaggaattcgtctcaccccctagaaaaagagtacaatctaaatcccttaacgaggatccattggagggcaagtctggtgcctgcagccgcggtaattccagctcctatagcgtatatttaagttgatgcacttaaaaagctcgtagttggaccttgggccgggccggccggtccgcctcacggcgagatccgaccggctcgacccttctgccggcgatgcgctcctggccttaactggacaggtcgtgcctccggcgccgttactttgaagaaattagagtgctcttagcaagccatcgctctggatacaggagcatgggataacatcataagattccacccccattgtgttgggcttcgggatcggagtaaagaattatagggaacagtcgggggccattcgtaatttcctagtcaagaggtggaaattacttggattttattgaaagaacgaaaaaactgtctaaaagcattttgggccaaggaaggtttttcccatttatgccaaaaaaccaaaaattttggggggctctccaaaatcaaactaaaataaacccggcgctttggctatccaaccttgtttaatgggatggcccttattcaccggagaaaaaaggagggggggtttcccacaataaaaagagaaancccccacgtgggggacacccttatagaaaaaaacaaaaacatactcctttgtgggttccccaggggggtagaaattttggcccccaaaacggtttataaaatctttataagaaattatattgtaaaaggggcaccccaccacggtgtggagaagcccgggccgcttttttttctccccacctttgggtgataaacttcacgatgtccccttttgtgcaaaggttttttatctgaggaaagccccttctcttttatacaataaggtggagcaacaattgtgtttttattgtcgagaagaaattgccccctcttttattttctaacacaaatac

SEQ ID NO: 84102 - protein, 55 aa, Zea mays
  misc_feature: Ceres CLONE 1570078
LPAVAAALELVDPPGCRNSSHPLEKEYNLNPLTRIHWRASLVPAAAVIPAPIAYI

SEQ ID NO: 84103 - DNA, 826 bp, Zea mays
  misc_feature: Ceres CLONE 1570079
  misc_feature: Encodes the peptide sequence at SEQ ID NO. 84104
  misc_feature (21)..(21): n is a, c, t, g, unknown, or other
ctccccgcggtggcggccgcnttccaactagagatcccccgggctgcattacttcgtctcacccctagaaaaaactccgcctccgctccccgctcgccgccgcgattgctggattggctgccgccagcgccccggtgctagctcccgttcctcgcggtggtcactggactagcctggacgccgcggcccgccgcctggtcgaagagatggactcggtcatggccgcccccgactcgccgccgcagactgtcgtgctcgtctctgccggcgccagccactccgtcgcgctcctcacgggcaatgtcctgtgctcgtggggcaggggcgaggacgggcagctcggccacggcgacgcggaggaccggctcgtgcccacggtgcttagcggcttcgacgcgcccgcgatcacgtccgtcatctgcggcgccgaccacaccaccgcctactccgaggacgagctgcaggtctacagctggggctggggagactttgggaggctggggcacggcaactccagcgacgtcttcacgccccagcctgtcaaggcgctgcaggggctcaagatcaaacagattgcctgcggggacagccattgtcttgccgtcaccatggccggagaagtgcagagttggggccgtaaccaaaacggacagctaggccttggaaccactgaagactcgctgctcccacaaaagaatcaggctttttgagagtgttttgcgtgaaaatgattgctgccggtgcccgacatactgctgcagtactgaacggactctcgatgggtgggtcgaatgaactagtctgtgacgtatgcgttgctctgaat

SEQ ID NO: 84104 - protein, 167 aa, Zea mays
  misc_feature: Ceres CLONE 1570079
  misc_feature (84)..(133): Pfam Name: RCC1 Pfam Description: Regulator of chromosome condensation (RCC1)
  misc_feature (30)..(80): Pfam Name: RCC1 Pfam Description: Regulator of chromosome condensation (RCC1)
  misc_feature: SWISSPROT Homolog: EC 2.7.11.1 Non-specific serine/threonine protein kinase
MDSVMAAPDSPPQTVVLVSAGASHSVALLTGNVLCSWGRGEDGQLGHGDAEDRLVPTVLSGFDAPAITSVICGADHTTAYSEDELQVYSWGWGDFGRLGHGNSSDVFTPQPVKALQGLKIKQIACGDSHCLAVTMAGEVQSWGRNQNGQLGLGTTEDSLLPQKNQAF

SEQ ID NO: 84105 - DNA, 778 bp, Zea mays
  misc_feature: Ceres CLONE 1570081
  misc_feature: Encodes the peptide sequence at SEQ ID NO. 84106
  misc_feature (675)..(675): n is a, c, t, g, unknown, or other
  misc_feature (678)..(678): n is a, c, t, g, unknown, or other
  misc_feature (679)..(679): n is a, c, t, g, unknown, or other
ctccccgcggtggcggccgctctagaactagtggatcccccgggctgcaggaattcgtctcacccctagaaaaaaatgcggcgcctccactttgcgatgcccgcgtcctcgctcccctcaccatcctcctcatctactaccgtgctctccattccccacccgctcccaccgccgctcgcagatgccgcccaaggtggtcgccgtcgccgcgggcgaggcccacacactcgccctcacgggtgacgggcaggtgtactcctggggcagggggccgttcggtcgcctcgggaacggccgcgaggacgacaagctggtccccaccgcggtggcgcccgcggtctctgccagcgggataccgcggcccaggttcgtcgccgtcgcggctggtgcctaccacagccttgcgctggacgatgaaggttcactctggtcatggggttacaatctctatggtcaacttggctatggggaccagaattccctttttccatgtttcgttgagcaatttcaggatttaggttctcctgaaacactgaatgatgaagaccagaacacacgtggtcgcacttgtttgaagctgtcttctgtcacagctggtggcatgatgtcgcttgcccatagacagttggggagcctttggatgtggggggaagtgcccacagcagactgatgccngannagttttgtatttcaagtagctctatcccactaccctgtgtgggatttccatggacacaccgttggtaaagtttgccgtggtaaccaacatgtagtaact

SEQ ID NO: 84106 - protein, 162 aa, Zea mays
  misc_feature: Ceres CLONE 1570081
  misc_feature (21)..(76): Pfam Name: RCC1 Pfam Description: Regulator of chromosome condensation (RCC1)
  misc_feature: SWISSPROT Homolog: EC 2.7.11.1 Non-specific serine/threonine protein kinase
MPPKVVAVAAGEAHTLALTGDGQVYSWGRGPFGRLGNGREDDKLVPTAVAPAVSASGIPRPRFVAVAAGAYHSLALDDEGSLWSWGYNLYGQLGYGDQNSLFPCFVEQFQDLGSPETLNDEDQNTRGRTCLKLSSVTAGGMMSLAHRQLGSLWMWGEVPTAD

SEQ ID NO: 84107 - DNA, 1055 bp, Zea mays
  misc_feature: Ceres CLONE 1570086
tccccgcggtggcggccgctctagaactagtggatcccccgggctgcaggaattcgtctcacccctagaaaaactccagtgctggctgccggccagctccgcccccggggtccttgagctggaggtggcggtggatgaccagctctcggagttttctgaggcgaggatcggagggcgttgcgttaggtccgcggttggtgagcggcggtcggagcggtctcgcgcgcggcggggtcgttcgatgacgcaggaatcgcgctctgggagggtgggaatacctcgcgctcgcgctcaaggtgctcgattaatttactgcctgagtgcttagggggggggcgccccctgtgaagcttaacccgttcccgcttgcacttggcccctcgagctcgggggaaaacgccctggggagcggtggcctccgtctatggggatctggttccccggggggggtaaattggggttggggtcccccgcgaggaacaggttttggaaaaatttttccccggggtttctctcgcaaaattcgggaggggggaccctttcttcaaaaatatttcactactcttccgctcccccggcggcgtgggggggggaaaatttttttttctgcccgccttttttttaagggagggtgcgcgttgtggggttgtttttttttgggggggaatcaggggtgcgtaaatatataagagtgtttggggtgggagtcaccccccccgtgggcatatatatggtgggtgtctcacccctctctccctcccgcggagaaaacaccactctgttgtagggggggtgtgcactatatccccccgcggagtggggagagggttgttcttctctaggtcccctctctttatccggctcgtgttgtgcctcctcccatcatattagagcctttgaagtggttggggcgggctcttgacgtaaagcgccaccctctctctcgtttttttctgtaaaaataattatacttctgtggaggtggtgtgcttcgtcccttcttgatatatgtattataaatatggtcctcccctcctcctctccctccatctggg

SEQ ID NO: 84108 - DNA, 997 bp, Zea mays
  misc_feature: Ceres CLONE 1570091
  misc_feature: Encodes the peptide sequence at SEQ ID NO. 84109
aaaagctggagctcaccgcggtggcggccgctctagaactagtggatcccccgggctgcaggaattcgtctcacccctagaaaaaacacggcacacacaccacaccacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggaccaaccaggggctgcactgggccccaagtctggtcatttgaagtgccgcaaagggttgcacatttcctttgaacgttttttggggaattcagaattggggtccccttggacccgggaaagtttggggatggctaatggtcccgcgtttggttttctgtgagtggaagcgtcgtttttcagagcagtcccaggtggaatggacccgctccgggatagtaatttgttattggaagaaaagtttattctcaaatctttccagagcgttgtgatacattctgtatagccttttgcctatcggagagcggccgggtgatgtccccctcacaatttgttgaccgtagggggactgtttttaggccccgctattctccccttgagagggggaaaagctctgtgtgaaaggagtgggcgcggggcaacccccccccggggcccctgggcgaggagggaaatctccgacgccgcgggaaaatagccacggctggataatggtgttacgtcttgttatggcgtggtgtgtggagggtgattg

SEQ ID NO: 84109 - protein, 107 aa, Zea mays
  misc_feature: Ceres CLONE 1570091
  misc_feature: SWISSPROT Homolog: EC 2.7.7.9 UTP--glucose-1-phosphate uridylyltransferase
MATTAVSVDEKLDKLRAEVAKLDQISENEKSGFISLVSRYLSGEAEQIEWSKIQTPTDEVVVPYDTVASPPEDLEETKKLLDKLVVLKLNGGLGTNQGLHWAPSLVI

SEQ ID NO: 84110 - DNA, 957 bp, Zea mays
  misc_feature: Ceres CLONE 1570092
  misc_feature: Encodes the peptide sequence at SEQ ID NO. 84111
  misc_feature (416)..(416): n is a, c, t, g, unknown, or other
  misc_feature (421)..(421): n is a, c, t, g, unknown, or other
  misc_feature (462)..(462): n is a, c, t, g, unknown, or other
  misc_feature (475)..(475): n is a, c, t, g, unknown, or other
  misc_feature (476)..(476): n is a, c, t, g, unknown, or other
  misc_feature (479)..(479): n is a, c, t, g, unknown, or other
  misc_feature (535)..(535): n is a, c, t, g, unknown, or other
  misc_feature (552)..(552): n is a, c, t, g, unknown, or other
  misc_feature (553)..(553): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (568)..(568): n is a, c, t, g, unknown, or other
  misc_feature (586)..(586): n is a, c, t, g, unknown, or other
ctccccgcggtggcggccgctctagaactagtggatcccccgggctgcaggaattcgtctcacccctagaaaaagtctctctcctctcctcgcctaaggtttcgcctcctgtgatcccgtctcgccgtcgtcgccatgggggacaactacgacgacgaaggcgagccaatcgtggacctcgacgaacgggagccctctcctgagccacagccctacgaagatctcgatgacgacctcggcgacggcggcgattggacccgcagccgctccccgacccccgtccacggcgacgacggtgaggcggggtcctccgccaagccccggaagcgcctcctcagaagggcggcggtggcggcatgcccggcgacgacgggctcgatgactttgggttggaggacgaggacgcgaccccggcnttgangcgaggaaagaagaaggggtcctcggcgctgagggacctcnccaggggcgggcnnggncaaagagaagaaggaaaaaaaaggcggaaggtagacacgggagggaagatatgggnaattggttgaggacagnnccggaaannnnnntntaggggaggaccccgggngtggggggaggacccagaaatgatggggggaaaaggggaaatccccggggcccctggggaaccctttgggggggggggggcctcaggaggaggaccaaataaggggtgtctgaccccccgaagaggagggattttttcttttgggacccaccgggggtgtatccccctctatatttttttcgcagttaatattagaaggggctctttcccgggggtttttgtctccccctcttagagggcgttgtggtgtttattaaaattccgacccccctcccgggggggtgtaatataaaaaaaaataaattttctccccctccgcataatttttctttattagtaaaaaaattcttgtgtgggttttggtggcgcct

SEQ ID NO: 84111 - protein, 93 aa, Zea mays
  misc_feature: Ceres CLONE 1570092
MGDNYDDEGEPIVDLDEREPSPEPQPYEDLDDDLGDGGDWTRSRSPTPVHGDDGEAGSSAKPRKRLLRRAAVAACPATTGSMTLGWRTRTRPR

SEQ ID NO: 84112 - DNA, 864 bp, Zea mays
  misc_feature: Ceres CLONE 1570095
  misc_feature: Encodes the peptide sequence at SEQ ID NO. 84113
aaagctggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatctggcggcctcgccgcccgaattgtagtctggagaggcgtcctcagcgacggaccgggcccaagtgcaatcatctcaaacaagctcaggggcaagacgtgcattgctaccatggcgctccactctgctgcagccgccgccgctctctcggccctcctgatgctctccttctcaggccttacgctctccgacacgacgccgtccacgccggtgtcaccgtcggccgcgtgcaacgccaccactgacccgaccttctgccggtccgtcctcccgccgcgcggcaagggggacctctacaagtacggccgattctcggtggccgagtccctggcgggcgcgcgcatgttcgcggccctcgtcgaccgctacctcgcgcggcaccgggacctctcctcgagcgccatcggtgcgctgcgggactgccagctcatggccgacctccacgtgggacttccttacgggcggccggcgccacaattaagaaccccggaccaccttcctggaacccccaagggccgaacaacgtgtgaccacccctgcctggtcgggggaatccttgacccaacccaggcggaacgttgcctttctgaacgggccttgcaagggtcccgctttaagggggtgccggggggtccccaaacccacgggggggggacccg

SEQ ID NO: 84113 - protein, 182 aa, Zea mays
  misc_feature: Ceres CLONE 1570095
MALHSAAAAAALSALLMLSFSGLTLSDTTPSTPVSPSAACNATTDPTFCRSVLPPRGKGDLYKYGRFSVAESLAGARMFAALVDRYLARHRDLSSSAIGALRDCQLMADLHVGLPYGRPAPQLRTPDHLPGTPKGRTTCDHPCLVGGILDPTQAERCLSERALQGSRFKGVPGGPQTHGGGT

SEQ ID NO: 84114 - DNA, 1064 bp, Zea mays
  misc_feature: Ceres CLONE 1570097
  misc_feature: Encodes the peptide sequence at SEQ ID NO. 84115
  misc_feature (1064)..(1064): n is a, c, t, g, unknown, or other
ggagctccccgcggtggcggccgctctagaactagtggatcccccgggctgcaggaattcgtctcacccctagaaaaaaggggaagagctctttccttcagctgtgccgtgcacaacgcacggcacgctggtttggtttgcatcgcccccgccaagaaagacgctgccatgagcgggctgagcgggcgggaagcagcagcaggcgggcgacatgccgagcggcagcgtgttctccgggtcggtgaacctcaagcacgtcaagctggagtaccagtacctggtgaaccacttcctgacactgctgctggtgccggtgatggccgccccggcgcctgaactggcgcgcctcgccccggccagctgctcctgctgtgacgccccctggacttggacttgccccccatcctttgctccccgtttcctggccgttcttctacgggacccgggaccgtaaatgtccggccccctgccccggggtccctggggggatcaacaccctggtttaaaagacccccccccacgttgggcccgggggccccttttccccccttttttgggaggaaaaacgcggccctctttattgggagaaaatagaaaaaaggggggggggcccttccccaaaacaaagaatccccttggagacccctctgtgggggtcccccgcgaaaagaaaaacagggggccctttccgcgccgccccaaagaaaacaatataaatttgccccgtccctaacaccccccatatgtggggggaggcctctctctccccgcaacgagagagcgcccatcttttatgatttttttctccccgcccgataacaatgaaacaacttttacggcccccactgggggggcgttccccaccccacgcggatagataactcgctcctctgcgagcgataaaaaatcacaccttttttcttattaaggaagccctcctcttttccccctggtagttgttcatcttaatggacattgcctcggcgcacaaagaataaagccgcgcctccttttattccctgctattgagagtttatgaattaactccctactccgcccctccn

SEQ ID NO: 84115 - protein, 80 aa, Zea mays
  misc_feature: Ceres CLONE 1570097
MPSGSVFSGSVNLKHVKLEYQYLVNHFLTLLLVPVMAAPAPELARLAPASCSCCDAPWTWTCPPSFAPRFLAVLLRDPGP

SEQ ID NO: 84116 - DNA, 812 bp, Zea mays
  misc_feature: Ceres CLONE 1570098
  misc_feature: Encodes the peptide sequence at SEQ ID NO. 84117
ggagctccccgcggtggcggccgctctagaactagtggatcccccgggctgcaggaattcgtctcacccctagaaaaaattccttccacttccactctctctttgcttccccgccctctccgccgcgcttttgctgatccgtgtgctgtgtgtgtgtgtgtgcgcgcgcgcgcgcttcaacttgaagaagcgcgggcgatcgagatggcgcacgaccccagcctgggcttcgcggactacttctcggcggcggcggcggctgcggcggcgggcgccacggcgatggacgacgacgtcggggcgccggagctctatggcctgcatgccgacgacatggagttcctcggcatgcgtggcctggccgccatgccccctgccgcggcacaccaccaccaccaccaccatcacggccacagcaaggccggtgcgctcctcgacgacgacgacgcgggggtggggccagacgtcagcggctccgcggacgacgccaccatgcgcttcctgagcgagcagcagcagcagcagcagcaccaggcgccgctgtcgctgtcgctgtgccggccggacgtgacgacgacgttgcacgagcagcaccacctcgccggcggcggctcctcgtcccggtaccatcaggagcagcagccggcggcgtgggtgcagcagcagcagcacgactactcgccgtcgccgcagcagcacgcgtggcacctgcgcagctccaggttcctcgtcccggcgcagcaggtcctgcaggagttctgcagcctccccgtggacagcagcagcgctgccgccctcatgcagcgcgccaa

SEQ ID NO: 84117 - protein, 202 aa, Zea mays
  misc_feature: Ceres CLONE 1570098
MAHDPSLGFADYFSAAAAAAAAGATAMDDDVGAPELYGLHADDMEFLGMRGLAAMPPAAAHHHHHHHHGHSKAGALLDDDDAGVGPDVSGSADDATMRFLSEQQQQQQHQAPLSLSLCRPDVTTTLHEQHHLAGGGSSSRYHQEQQPAAWVQQQQHDYSPSPQQHAWHLRSSRFLVPAQQVLQEFCSLPVDSSSAAALMQRA

SEQ ID NO: 84118 - DNA, 915 bp, Zea mays
  misc_feature: Ceres CLONE 1570101
  misc_feature: Encodes the peptide sequence at SEQ ID NO. 84119
ggagctccccgcggtggcggccgctctagaactagtggatcccccgggctgcaggaattcgtctcacccctagaaaaaccactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctggccaagtccggcatcggcgacgagtcgtacatgccgcgctgcgttgtcgagcccatcgcagctgcgcaccatgaatgaagggccgcgcgaggcgtccacgggcatgttcgccgcgctggacgagctgttcgacaagtggggcgtccgggccaagaactggggcgtgctggtgttcaatgcagcctcctcaaccggagccttcctgtgtcgccaggatcgtcaa

SEQ ID NO: 84119 - protein, 191 aa, Zea mays
  misc_feature: Ceres CLONE 1570101
  misc_feature (115)..(190): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVVEPIAAAHHE

SEQ ID NO: 84120 - DNA, 837 bp, Zea mays
  misc_feature: Ceres CLONE 1570103
  misc_feature: Translation starting site: 680
ctccccgcggtggcggccgctctagaactagtggatcccccgggctgcaggaattcgtctcacccctagaaaaaacggacggggcatgggattgacccacacacccgccctccgccccgcaagccaaatacgccgtggcacgcgtcgccatgccgccccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgacgtggggggaggggggcgctggcgccccgcggcggctcgtcctggaggagctaccctgggaccattccttcgtccgcgagctgcctggcgacccgcgatcggacactatcccgcgggaggtcctgcacgcctgttactccagggtgtctccctctgccaaagtggacaaccccaagctggttgcgtggtctgattccgtggccgatctactcgatctggatcacaaagagtttgaaagacctgatttccctcagtttttctcaggagcaactccactagtggggagtttgccctacgcacagtgctatggaggacatcagtttggtgtatgggctggtcagttggggggatggaagagcgatagctcttggagaagttgtcaactctcgaggtgagagatgggagttgcagctcaaaaggtgtggaaagatccctaccgcagatttgctgatggtcttgctgtc

SEQ ID NO: 84121 - DNA, 917 bp, Zea mays
  misc_feature: Ceres CLONE 1570104
  misc_feature: Encodes the peptide sequence at SEQ ID NO. 84122
  misc_feature (864)..(864): n is a, c, t, g, unknown, or other
agctccccgcggtggcggccgctctagaactagtggatcccccgggctgcaggaattcgtctcacccctagaaaaaacgaggagaacctacggtcggcatgtgcgcagctgcggcatgccatgtccgaatctgacggcgatggcgccatggagaaggttctgggaatggactggagtaggaagcccggagattctgtcgacccggccgttgacgcggagtggatcgcggggatagctaggctggggctcgacactaacttcgtcgtcgtgcacggggccgggtcttttggccactttcaagcaagtagatctggagttcataaaggagggttacattcgacactggtcaaggctggctttgttgctacaagaatttcagtgacatctctcaaccaggaaattgttagagccttagcaagagaaggaataccatctgttgggatgtcaccatttgcttgtgggtggtctacccaacaaagaaaacttgcatcagcaaatgcttctcaaataattcagtcactccatgcaggttttgtcccagtaagttgttgtaccaaaggttttgaaccgctattccttcagaatttcatatttatcaaaaatagggcctggtgcagtggtagtctctccacttgctgtttggagatccttgaaaaattaacaagggtaaggaactaaggatgtataaaagttctcttccccatacccttttctctgtgggagcttttggcactgggtacacacacctgaaagtgttggcatgagcgatatagttaatcaccccatatttgacagcatatggtgctactggaaacatgtatcatattgttatttttttatgctgcactatttttggtactcctngatagtgcttttctgtattgcacgttgaacgcctaaacaaggtccatttgaat

SEQ ID NO: 84122 - protein, 185 aa, Zea mays
  misc_feature: Ceres CLONE 1570104
MSESDGDGAMEKVLGMDWSRKPGDSVDPAVDAEWIAGIARLGLDTNFVVVHGAGSFGHFQASRSGVHKGGLHSTLVKAGFVATRISVTSLNQEIVRALAREGIPSVGMSPFACGWSTQQRKLASANASQIIQSLHAGFVPVSCCTKGFEPLFLQNFIFIKNRAWCSGSLSTCCLEILEKLTRVRN

SEQ ID NO: 84123 - DNA, 974 bp, Zea mays
  misc_feature: Ceres CLONE 1570108
  misc_feature: Encodes the peptide sequence at SEQ ID NO. 84124
ggcggccgctctagaactagtggatcccccgggctgcaggaattcgtctcacccctagaaaaagcgcccagatctgctactagacggcaccgctgcagcgcgtcgtgtcgcgggggttggtggcaggcagcgagagcttgccgttcctctctctcaggtcctaggctcacctcaccggctcccagcccgcttctatttcttcctccccgaccccgtgcaggtggcagtccagtccacgccaccaaccgcgaggcgaaccaaaccaacccactctccccaatcccgcgcgcccaggccgccagccctaccaaccatcggcgtcggcaatggcggccatggcgaccaaggccgccgcgggcaccgtgtcgctggacctcgccgcgccgtcgcgccgccaccaccgcccgagctcggcgcgcccgcccttccgccccgccgtccgcgggctgcgggcgcctgggcgccgcgtgatcgccgcgccgccggcggcggcagcggcggcggcggtgcaggcgggtgccgaggagatcgtgctgcagcccatcaaggagatctccggcaccgtcaagctgccggggtccaagtcgctttccaaccggatcctcctactcgccgccctgtccgaagggacaacagtggttgataacctgctgaacagtgaggatgtgcactacatgctcggggcccttgaggactcttgggctctctgtcgaagcggacaaagctgcccaaagaactgtaattgttgggctgtggtggaaaaatccccggtggaggatgcctaaaaaggaagtgcagcctctcctggggggatggctggaaacctgcaaggcggcccttggaacacaaccctgttcactgctgcctggttgggaattgcacacttaccgggcctgtgtgggaggtcccacggaatggagggagagagacccctttgggccacccttggttgtgtccgagatttgtaacacccc

SEQ ID NO: 84124 - protein, 152 aa, Zea mays
  misc_feature: Ceres CLONE 1570108
  misc_feature: SWISSPROT Homolog: EC 2.5.1.19 3-phosphoshikimate 1-carboxyvinyltransferase
MAAMATKAAAGTVSLDLAAPSRRHHRPSSARPPFRPAVRGLRAPGRRVIAAPPAAAAAAAVQAGAEEIVLQPIKEISGTVKLPGSKSLSNRILLLAALSEGTTVVDNLLNSEDVHYMLGALEDSWALCRSGQSCPKNCNCWAVVEKSPVEDA

SEQ ID NO: 84125 - DNA, 803 bp, Zea mays
  misc_feature: Ceres CLONE 1570110
  misc_feature: SWISSPROT Homolog: EC 1.6.99.5 NADH dehydrogenase (quinone)
ctccccgcggtggcggccgctctagaactagtggatcccccgggctgcaggaattcgtctcacccctagaaaaaatggccccttctatatggtaccagttgttgtttcattgaatttgcttcattaataggctcacgattcgactttgatcgttatggattggtaccaagatcaagtcctagacaagcggacctaattttaacagctggtacggtaacaatgaaaatggctccatctttagtgcgattatatgagcaaatgcctgaaccgaaatacgtcattgctatgggagcctgtactattacagggggcatgttcagtacagattcctatagtactgttcgaggagttgataagttaattcctgtggacgtctacctgccgggttgcccgcctaaaccagaggctgttatagatgccctaacaaaacttcgtaagaagatagcgcgagaaataattgaggatcgaactctatgtcaaagtcaaaagaaaaatagatcttttactacccgtcacaaactttatgttcggcgcagtactcacactggaacttacgaacaagaattgctctatcaatcaccatctactttagatatatcttctgaaacttttttcaaatccaaaagttcagtatcttcctacaaattagtgaattaggaggggttcttttgtgcagaaaaagaaagaaaagagcagtacaatctttcaaacttgcatttgaaatgtgaaatatttatacaaagggggagagatcaagacaatgcagcagggttggttatctaattggctagttaaacatgacg

SEQ ID NO: 84126 - DNA, 942 bp, Zea mays
  misc_feature: Ceres CLONE 1570115
  misc_feature: Encodes the peptide sequence at SEQ ID NO. 84127
ccccgcggtggcggccgctctagaactagtggatcccccgggctgcaggaattcgtctcacccctagaaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcacccttgaggtcgagtcttctgataccatcgacaatgtcaaggccaagatcccagacaaggagggcatcccctcggaccagcagcggctcatttttgccggcaagcagctcgaggacgggcgcacgctggccgactacaacattcagaaggagagcaccctccacttggtgctgcgtctcaagggtggcatgcaaaacttcggtgagaaccttactggcaagacgatcacccttgaggggggagtcctcgggacaccatcgaaaatgttcagggctaagattccggaacaaggaaggc

SEQ ID NO: 84127 - protein, 264 aa, Zea mays
  misc_feature: Ceres CLONE 1570115
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(226): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIPDKEGIPSDQQRLIFAGKQLEDGRTLADYNIQKESTLHLVLRLKGGMQNFGENLTGKTITLEGGVLGTPSKMFRAKIPEQGR

SEQ ID NO: 84128 - DNA, 852 bp, Zea mays
  misc_feature: Ceres CLONE 1570116
  misc_feature: Translation starting site: 108
  misc_feature: SWISSPROT Homolog: EC 2.7.7.49 RNA-directed DNA polymerase
  misc_feature: The sequence is a functional homolog of SEQ ID NO 1433 in the 10/374,780 US patent application
  misc_feature: The sequence is a functional homolog of SEQ ID NO 1519 in the 10/412,699 US patent application
tggagctccccgcggtggcggccgctctagaactagtggatcccccgggctgcaggaattcgtctcacccctagaaaaattcatgtcatgttctgaatagaattcctatgggcaaagaagagaaaaccccttatgagaagtgggttgggagaaaaccatcactttcatacttgcgcacttgggggtgcatggcgaaagtcaatgtaccaattaataaaaagcgcaagcttggtccaaggacagtggattgtgtctttcttggatatgcttcgtgtagcatagcatatagatttttagtagttaaatctgaagttcctgatgtgtatgttgatactattatggaatcacgtgatgctactttctttgagcatatatttccaatgaaagacattcatagcaattctagatactcttctgagataattcctgaacataatacacctattgagagttttgaacagccacatgaaattgtcctagaggaggatgacaatgatgctcctaaaaggagcaagagacaaagggttgaaaaatcctttggtaatgatttcattgtgtaccttgtggacgatactcctactaccattgcagaagcatttgcatctccagatgcagatgattggaaagaagcagttcataatgagatggactctattctttcaaatggtacgtgggaagtcactgatcgaccctatggatgcaaacccgtggggttgtaagtgggtgtttaaaaagaagctcaagcctgatggtacaattgaaaagtacaagggttggtggtaacttggagttctaggcggaagtttcacttaacagtctctgctgaaaaactagtatattaaacagtagtga

SEQ ID NO: 84129 - DNA, 901 bp, Zea mays
  misc_feature: Ceres CLONE 1570117
  misc_feature: Encodes the peptide sequence at SEQ ID NO. 84130
  misc_feature (771)..(771): n is a, c, t, g, unknown, or other
aaagctggagctccccgcggtggcggccgctctagaactagtggatcccccgggctgcaggaattcgtctcacccctagaaaaagctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgcaccgccccccgatgagatcagctcgcgaagagcgcgcgcaggagattcggcgcggatctttacgccgcagaggcaagcggtctcgcgtcgacaacggcgacgatgacagcggcgggtttcggtgtagggctgggggcagcactgggtggggggggggccccattcggggggggggaaggaattcgggctttctctggctcctctgtcccgggggggggggggaaccggggggcttttttttttccccccaaaatttttttcttttctctcgggaaggcagcgggcacccccttccagagaaacctcccccctctttaaggggggggggggaaaaatatagggggggggttcacagggcgcacaaaagaaagtatttggaaaaactctccccaaaattgggaaaggggggtttggggggggttattactacctttggggaaagaaaacgccgggggggaaaaatattttttgggggggtttattcccngccctttctaatacgcgggggggacacaaaaagtcctcttgggtctccacaaggagaaacaccctgggggggcggtaaacccgggggtggcgccgctacacagaggggagatttgggagcgcttttctca

SEQ ID NO: 84130 - protein, 71 aa, Zea mays
  misc_feature: Ceres CLONE 1570117
MTAAGFGVGLGAALGGGGAPFGGGEGIRAFSGSSVPGGGGNRGAFFFPPKIFFFSLGKAAGTPFQRNLPPL

SEQ ID NO: 84131 - DNA, 943 bp, Zea mays
  misc_feature: Ceres CLONE 1570120
  misc_feature: Encodes the peptide sequence at SEQ ID NO. 84132
ctccccgcggtggcggccgctctagaactagtggatcccccgggctgcaggaattcgtctcacccctagaaaaagaagcttcctcctcgcagcgcgccgcgcgtcgtcgcctctacccaccggacttcgcgcgccacgacgagcctgcgagccatcagcccatcacccacccacccccccgccacgcagatctagggagcttaccctcccaccgggcggtcattcttccgtcccatcaccgatgcggacgccggcgatgctccggtgggccgcggcgctcgcggtcctgctcgctgtcgccgcgccggccgccgggttctacctccccggcgttgccccgagcgatttcgcgaagggtgatccgcttccagtgaaggtgaataagttgacatctatcaacactcaactcccgtatacatattattcccttccgttctgcaagccagataccatagtcgacagtgccgaaaatcttggggaggtacttcgtggcgatcgcattgagaactctccttatgtgttcaaaatgggagagcccaagatgtgtcagattgtctgcagagcaccgatcactgagaaagaagccaaggagctcaaggaaaagattagaggacgaataccgagtgaacatgatccttgacaacctcccgctagttgttcctgttacaggcaagataaaaacagtattgcttatcaaggtggatatcatgttggtgccaaaggcctgtattctggaacaaaggatgagaaatacttcatacacaaccatttgtcatttacggtgaagtatcacaaggacgataatttgggaacattctaaaatagggggattggaggtcaacccacccaggtgcaagccccagggtggcacataaaatggatgggtgtagacaccccgcttggagcacttggtgaacctcaaggcggccaaatagtgaaatat

SEQ ID NO: 84132 - protein, 132 aa, Zea mays
  misc_feature: Ceres CLONE 1570120
MRTPAMLRWAAALAVLLAVAAPAAGFYLPGVAPSDFAKGDPLPVKVNKLTSINTQLPYTYYSLPFCKPDTIVDSAENLGEVLRGDRIENSPYVFKMGEPKMCQIVCRAPITEKEAKELKEKIRGRIPSEHDP

SEQ ID NO: 84133 - DNA, 869 bp, Zea mays
  misc_feature: Ceres CLONE 1570122
  misc_feature: Encodes the peptide sequence at SEQ ID NO. 84134
ctggagctccccgcggtggcggccgctctagaactagtggatcccccgggctgcaggaattcgtctcacccctagaaaaacttatatttgctgattcggttggagcatggggcactccattggtttcagttgaacgtcctccaggcatcaatgatattggcatcgttgcttggaacatgaagctgtccacgccagaattcccacgtggccgggagattatagttgttgccaatgatgtgacatttaaagctgggtcctttggtccaagagaagatgcattttttgatgctgttaccaatcttgcctgtgagaggaaacttcctcttatctatctggcagcaactgctggtgccaggcttggtgtagcagaggaaataaagtcatgcttccatgtcggctggtctgattatgagagccctgaacgtgggtttcagtacatttacctcactacacaagattactcacgtctaagctcttcagtaatagctcacgagctgcaactaaaaaatggagaaaccagatgggtggttgataccattgttggtaaagaggatgggacttggttgtgagaatctccaccggcagtgggggcgatgccagcgcatattctaaggcatacaaagagaccttttactctgacatttgtgactggaaaagctttttggcattgggggcttatcttgctcggtttaggcatggaggtgaatacaacgtcttggatcaaccaattattttgaacggggttttcggcacctaacaaagttcctgggggggggggggggggtacaggttcctcaaaaggcaaatttggggtgggccccacaaaatacagtggcctcaaaatgggggggttggtcccacccaaaacg

SEQ ID NO: 84134 - protein, 188 aa, Zea mays
  misc_feature: Ceres CLONE 1570122
GAPRGGGRSRTSGSPGLQEFVSPLEKLIFADSVGAWGTPLVSVERPPGINDIGIVAWNMKLSTPEFPRGREIIVVANDVTFKAGSFGPREDAFFDAVTNLACERKLPLIYLAATAGARLGVAEEIKSCFHVGWSDYESPERGFQYIYLTTQDYSRLSSSVIAHELQLKNGETRWVVDTIVGKEDGTWL

SEQ ID NO: 84135 - DNA, 940 bp, Zea mays
  misc_feature: Ceres CLONE 1570124
  misc_feature: Translation starting site: 320
  misc_feature: SWISSPROT Homolog: EC 3.2.1.4 Cellulase
gcggtggcggccgctctagaatagtggatcccccgggctgcaggaattcgtctcacccctagaaaaaaccacaccacgcagtgccgtgccgcactgctgtcctgcaatctcccataaactcactcgcctcgcctcgcctcgcctcgcccacccgcccgcctgtccctccccaaggccgcagctcactcgtgtcgtgcacccgtcccctcccacccgccaagaactagcattgccgccgccggtgccagggggcggaggagaggccgcggcggcgagggagcggcaccaggcgcagggggtcaggagagccgccggcaggatgttcgggcgggacccctggggcgggcctctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaccgcaagatcttcatgtggaccgtcggcaccatcctcggcctcggcgtcttcatcggcttcatcaatgatgatccgtcaagctcgtcccgcacaagcgcccgccgccgccgccgcccgacaagtacacgcaggcgctgcacaaggcgctcatgttcttcaacgcgcagcgatcccgtccgctgccgaaacataacggcgtcagcgggagggggaattcctggcatgaaggatggcctcctcggaaagaaccgtccgccgggacttggtccggaaagcttctacgatgcggggggaagcccttcaagttcaacatcccagtgggcctggtccaagaacctagctctagctgggggtgtgcttcagagaacggggcgaaagtattgaagcccattggggaaaccccgacctatataa

SEQ ID NO: 84136 - DNA, 1288 bp, Zea mays
  misc_feature: Ceres CLONE 1570125
  misc_feature: Encodes the peptide sequence at SEQ ID NO. 84137
  misc_feature (75)..(75): n is a, c, t, g, unknown, or other
  misc_feature (76)..(76): n is a, c, t, g, unknown, or other
tttttaatagtgttgtgggtggtgggtggggggtggggtgtggagagggcatggacgtgagcacccccagtgagnngggaagctgggactcaccgcggtggcggccgctctagaactagtggatcccccgggctgcaggaattcgtctcacccctagaaaaaacactcgtccactcaccccctctttgctctgcctcgccgcgccgcagagcagagcatggcgcccccacgccctctcctcgccgccgtcttcctcgccgcggcgggtctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccgggatcaaggtggtaatacctctgcccaacgagcaggtcgcggcggccccctctggcgcgtcctacgcggctgctgtgggggtgcgccgggaacaggggcgtgcgtaccaccccggggccacgcagaatcccaggggccatcgcccgttggggcagacgaagttgtttcggcggtccgtcctaagaaacgttggaacggcccccatggctggggtccccgggcccaattgggcccaaaacgttggtaaccgccccaccgtctttgaggcccgagggggcgttcggggccccttcgcgaacgggggggggctcagagtatcaaaaggggtgtggtttcccattagtcagcccccacacaaatcgagagaaagtgcttgtctcaaaccggtgtggccggaaccttcttccggggcccgagatttcccgttttgtccccccatatacgccccgcggggagaccgcgctatgtccccataagcagagggaggctccctgccccatttctttcccccgcgcgggaggaaaaagggaaaacacctcatcgcagcctagagcaaagaggaagcccccccggtttttatagtggggataatgcaccccgccactagtgctcccctccgatacccttgtgcccgcgtgggggcccgcaccgataaaaccgcgggggggggccgcggggataccccctctccatgggggggggggaaaggccacgccgttgaccaccccagaggtgccagttccgcgcgtgttaacatacgcgggtgcaattggcgcggtggaagaagaaatcttccctcccccctacgaataaatacggtgccgatagtgtcccgccccgccaacaag

SEQ ID NO: 84137 - protein, 232 aa, Zea mays
  misc_feature: Ceres CLONE 1570125
  misc_feature: SWISSPROT Homolog: EC 3.2.1.39 Glucan endo-1,3-beta-D-glucosidase
MAPPRPLLAAVFLAAAGLLLLSPAEAGTVGVNYGRVANNLPNPAAVVQLLKQQGVAQVKLYDADPTVLRALANTGIKVVIPLPNEQVAAAPSGASYAAAVGVRREQGRAYHPGATQNPRGHRPLGQTKLFRRSVLRNVGTAPMAGVPGPNWAQNVGNRPTVFEARGGVRGPFANGGGLRVSKGVWFPISQPPHKSRESACLKPVWPEPSSGARDFPFCPPIYAPRGDRAMSP

SEQ ID NO: 84138 - DNA, 840 bp, Zea mays
  misc_feature: Ceres CLONE 1570127
  misc_feature: Encodes the peptide sequence at SEQ ID NO. 84139
  misc_feature (537)..(537): n is a, c, t, g, unknown, or other
agctccccgcggtggcggccgctctagaactagtggatcccccgggctgcaggaattcgtctcacccctagaaaaaatctcttgcaagcacaactgcacaagggaacaggaggaaaaaagagcgagaactcgcagctgacgcgcacacggcaagccccaatcggagccgcggaccggatcagaactaggtctcgaggcgatggcaagcggaggcgagggcgcagggagcggcgaatcccctcccgccgcctcagtggaggcggcagcggtcgaggcgacgctgcacatccggtgcgcgaacggctccaagttcacggtgcagacggacctgggcgccacggtgggcgcgttcaaggaggtcttatccggtagctgcggcgtgccagcaccgcagcagcgcctgatctacaagggccgcatcctcaaggacgagcaaaccctagacagctatggcgttgagaaggatcacacaattcacttggtgcgaggtgtcgccccaccagctgcatccagtgcacctgctgctgccaacccccnttactcatttactcctagtagtggccctgcaggtggcctgggagggctatttccaggtgttgatgctccaggaaatgacagggcatcaggtatttttaggcccagatttccagatttggagcagttggagcaacatttagccaagaatcccaattggtggagggaaatatgaatttgcgggcatggaaaattccctgattaaccccgattaaatcgtaatttggcctggaccaccccccaaggccggaattctgggatcggaacccgattttggcatgggttaaaaaaccaagggtcctccca

SEQ ID NO: 84139 - protein, 169 aa, Zea mays
  misc_feature: Ceres CLONE 1570127
  misc_feature (31)..(99): Pfam Name: ubiquitin Pfam Description: Ubiquitin family
  misc_feature (113)..(113): Xaa is any aa, unknown, or other
MASGGEGAGSGESPPAASVEAAAVEATLHIRCANGSKFTVQTDLGATVGAFKEVLSGSCGVPAPQQRLIYKGRILKDEQTLDSYGVEKDHTIHLVRGVAPPAASSAPAAANPXYSFTPSSGPAGGLGGLFPGVDAPGNDRASGIFRPRFPDLEQLEQHLAKNPNWWREI

SEQ ID NO: 84140 - DNA, 951 bp, Zea mays
  misc_feature: Ceres CLONE 1570133
  misc_feature: Encodes the peptide sequence at SEQ ID NO. 84141
gcggtggcggccgctctagaactagtggatcccccgggctgcaggaattcgtctcacccctagaaaaaacccgaggcgtggaagacaccgtcgctctcctcgcgtgcgagcgccgccactgcatcttcccatcgatctccgccgaccccgcatcttcccatacgagctgtgtttctccaagttcgctgctggccatatcgacgtcgtcatcctcgatccagacgagtgcgtgtgccatctccacgggtcttcgacagatttagcaagaatgtttggaagaggatctcctaggatgaacttgatccaagctgcaactatgaaaaaaatatcccccagatctactactaacaagcgcaagaagagaacatcaccaaaagttggtcgtcttagagcaaactggaatagtggactagaaaagggtttagttgaaattcttcaagatcacaacaatgattgttataagggtcaaaatgggtggtcatcggaagcatggaatagaattgtcaagttattccatgagaaattctcttatgtcacatttacaaaatgccaaatccaagataaagagaaagagttaaagagagactacaaggctcttaaagaggcaaggcaacaaagcggggtatcatgggatgagaggttgtgtagaatagaagcagatgaacccatttggaataacctcaccactagtaacgagagacttaagaagtttcggactaaatcttcccactatttgaggctttaggagagctatatgatggtaatattgctgaggggacatggaatttacttctattgagccttctcgaccctctggtacacaaccttggcaggtgctgctaccagccttctcaagctggcttccaacttaccaaccttctaaaatggctttcaacaaccttctctagctgctttcgacaactttctggaacggctttagacaccttccct

SEQ ID NO: 84141 - protein, 158 aa, Zea mays
  misc_feature: Ceres CLONE 1570133
MFGRGSPRMNLIQAATMKKISPRSTTNKRKKRTSPKVGRLRANWNSGLEKGLVEILQDHNNDCYKGQNGWSSEAWNRIVKLFHEKFSYVTFTKCQIQDKEKELKRDYKALKEARQQSGVSWDERLCRIEADEPIWNNLTTSNERLKKFRTKSSHYLRL

SEQ ID NO: 84142 - DNA, 775 bp, Zea mays
  misc_feature: Ceres CLONE 1570134
  misc_feature: Encodes the peptide sequence at SEQ ID NO. 84143
ctccccgcggtggcggccgctctagaactagtggatcccccgggctgcaggaattcgtctcaccccctagaaaaaaccctagaaaaaaagactcaatacacaagcagagctcaaacaattcttgcttcccgctagctagctcgcaagaaataatggctccacttcttcttgcttctcgcacagcctgtcatcctggccttacaagcagccgccatgataatggccggcacggcctttcttcttcaccgggaagtagtagtaagcgaagccgtagccttagcttcataccacgagctgaaaagacgacgacaggcggtgagggtcatgttgtgagcgaaaagctgagcccctggcaaatccccaggagggagtggttcccccctagctttatctttggtgccgccacttcagcataccaaattgaaggcgcttggaacgaaggtggcaaggggccaagcacttgggacgacttctgccacaaatatccggagtggatagcggacgggagcactggggatgttggagcgaactcctactacctgtatagagaggatgtcagattgctgaaggagatgggtatggacgcctacaggttctctatcgcttggtccagaatactgccaaaggggacgctcgagggaggcattaaccataaaggcatcgagtactacaaaaggctcatcaacttgttgaaagagaacggcatagaaccatatgtgacacttttccactgggacacacctcaagcgctggtggacagctacggtggcttctt

SEQ ID NO: 84143 - protein, 207 aa, Zea mays
  misc_feature: Ceres CLONE 1570134
  misc_feature (71)..(207): Pfam Name: Glyco_hydro_1 Pfam Description: Glycosyl hydrolase family 1
  misc_feature: SWISSPROT Homolog: EC 3.2.1.21 Beta-glucosidase
MAPLLLASRTACHPGLTSSRHDNGRHGLSSSPGSSSKRSRSLSFIPRAEKTTTGGEGHVVSEKLSPWQIPRREWFPPSFIFGAATSAYQIEGAWNEGGKGPSTWDDFCHKYPEWIADGSTGDVGANSYYLYREDVRLLKEMGMDAYRFSIAWSRILPKGTLEGGINHKGIEYYKRLINLLKENGIEPYVTLFHWDTPQALVDSYGGF

SEQ ID NO: 84144 - DNA, 869 bp, Zea mays
  misc_feature: Ceres CLONE 1570139
  misc_feature: Encodes the peptide sequence at SEQ ID NO. 84145
  misc_feature (565)..(565): n is a, c, t, g, unknown, or other
  misc_feature (567)..(567): n is a, c, t, g, unknown, or other
  misc_feature (568)..(568): n is a, c, t, g, unknown, or other
acccgcggtggcggccgctctagaactagtggatcccccgggctgcaggaattcgtctcaccccctagaaaaagctccagttcgtctctctcctctcctcgcctaaggtttcgcctcctgtgatcccgtctcgccgtcgtcgccatgggggacaactacgacgacgaaggcgagccaatcgtggacctcgacgaacgggagccctctcctgagccacagccctacgaagatctcgatgacgacctcggcgacggcggcgattggacccgcagccgctccccgacccccgtccacggcgacgacggtgaggcggggtcctccgccaagccccggaagcgcctcctcaagaagggcggcggtggcggcatgcccggcgacgacgggctcgatgactttgggttggaggacgaggacgcggaccccgcggctgaggcgaggaagaggaaggggtcctcggcgctgagggacctcgcgaggggcggggcgggcaaagagaagaaggagaagaaaaggcggagggaggacgacgggaggggaagtgatagtgggattggtgagggacagncnnggagccaagaagggagggactcaggcggggggggaggaccaggatgatgggggagaggggaatccaggagctctggggataccattgcgggggggtggctcagaggattgaccagaaggggttagaaccctagaaggaggataatttccttgatgaccccgggggttgatccagctgattctttttggcgtggattatgagggggcttttacctggggctttatgcccccgctttaaggagggttagggtggattatttacattgggaggactctcttctggggtggtaagaaaaaagaag

SEQ ID NO: 84145 - protein, 156 aa, Zea mays
  misc_feature: Ceres CLONE 1570139
  misc_feature (141)..(141): Xaa is any aa, unknown, or other
  misc_feature (142)..(142): Xaa is any aa, unknown, or other
MGDNYDDEGEPIVDLDEREPSPEPQPYEDLDDDLGDGGDWTRSRSPTPVHGDDGEAGSSAKPRKRLLKKGGGGGMPGDDGLDDFGLEDEDADPAAEARKRKGSSALRDLARGGAGKEKKEKKRRREDDGRGSDSGIGEGQXXSQEGRDSGGGGGPG

SEQ ID NO: 84146 - DNA, 851 bp, Zea mays
  misc_feature: Ceres CLONE 1570145
  misc_feature: Encodes the peptide sequence at SEQ ID NO. 84147
ccccgcggtggcggccgctctagaactagtggatcccccgggctgcaggaattcgtctcacccctagaaaaaacctccctcgcactccattggatttgggggagctcggggggcgcgggccactgatgatccccggaacgagcaccgatccgtggcgaggaaactccaccgggtagccggcccgggagcgcggggcacggcgatggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataagcgcgaccatcatgacgtttgctccatcattcactgtgcttatgatagggaggctccttgctggggttggcattggcttttgggccagggaatcctggagtgttccttggcggaaatctccccccgccgggggccccgaagggaaccctcccctcccctttcctgaaaatctgccttcaaatttttggggaacccttccttggggctacggttttcccaaatattggccctttcttcaggggcctttttttggagaaacag

SEQ ID NO: 84147 - protein, 216 aa, Zea mays
  misc_feature: Ceres CLONE 1570145
MAGAGAAANGGRNKYAVLDRSEERQTDARTERRRRPLAPESERGRRERFVYACAVFASLNAVLLGYDVGVMSGAIIYMQKDLHITEFQQEILVGCLSVVSLLGSLSGGRTSDAIGRKWTMGLGAIVFQISATIMTFAPSFTVLMIGRLLAGVGIGFWARESWSVPWRKSPPAGGPEGNPPLPFPENLPSNFWGTLPWGYGFPKYWPFLQGPFFGET

SEQ ID NO: 84148 - DNA, 843 bp, Zea mays
  misc_feature: Ceres CLONE 1570146
  misc_feature: Encodes the peptide sequence at SEQ ID NO. 84149
ctggagctcaccgcggtggcggccgctctagaactagtggatcccccgggctgcaggaattcgtctcacccctagaaaaaagttttggctcgagaaccaaaatcgccattctcttctctccttttcttatcctctctcctgagctcgctcgtatctcctctctggacgaacagaaaggttaccagcagcaccacggcgagatctccccttggcgggccaaaaccgacggcgagcttcaccggcgttggtcggctcccatctcttcgccgttttattttcctcccaggttaaggttgcaggcttttagcttgggattctgaaagatggggacctcttctggcgcgaatttccatcagcaacctcctccgacccaggggatgttgcctccaaggcatggtccacgcccctcagggttgcagacctcgctctcgctggcctcttcggagcaggttggctcgcctgacatgcaggagcctggttcaaactcggagccagggcatgattccgccactgagagcgccagttccaaagacacatggccagctgagccgaaccagagcaatggtggggtggctgccagtgatgttgtgagtaaggcggcggagaaggaggtggcaaatggtgtatccaagccgcaggttatccatggaccctcctcccgtgtgagtgggatgcttctgcgggaggttgcacgggagagggttgatctggtcgctgagaagatgaagatgatgtcggatgagcacctagaggaggtcaagaatgagctcaggtcgattctggagggcactggaggttctcaccacatcgaggaagtcttgtacttgcagaagcttgtccaga

SEQ ID NO: 84149 - protein, 173 aa, Zea mays
  misc_feature: Ceres CLONE 1570146
MGTSSGANFHQQPPPTQGMLPPRHGPRPSGLQTSLSLASSEQVGSPDMQEPGSNSEPGHDSATESASSKDTWPAEPNQSNGGVAASDVVSKAAEKEVANGVSKPQVIHGPSSRVSGMLLREVARERVDLVAEKMKMMSDEHLEEVKNELRSILEGTGGSHHIEEVLYLQKLVQ

SEQ ID NO: 84150 - DNA, 819 bp, Zea mays
  misc_feature: Ceres CLONE 1570149
  misc_feature: Encodes the peptide sequence at SEQ ID NO. 84151
  misc_feature (757)..(757): n is a, c, t, g, unknown, or other
  misc_feature (819)..(819): n is a, c, t, g, unknown, or other
ccccgcggtggcggccgctctagaactagtggatcccccgggctgcaggaattcgtctcacccctagaaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggttgatcgcggtgtcggagcccatatcgttcaagaacccaaggcgcccgtgtttcccgcgctggcgcagggcacgtcccacgacgagatgacggtgacttggaccagccgctacgccatcgatggagcgtacccgtttctgggagtggggggnccctgggtcccggggggcgggccccggaaaaacgggggggccggccgccggggaccctcacn

SEQ ID NO: 84151 - protein, 183 aa, Zea mays
  misc_feature: Ceres CLONE 1570149
MAVALLAALVASAAMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFKNPRRPCFPRWRRARPTTR

SEQ ID NO: 84152 - DNA, 833 bp, Zea mays
  misc_feature: Ceres CLONE 1570150
  misc_feature: Encodes the peptide sequence at SEQ ID NO. 84153
ctggagctccccgcggtggcggccgctctagaactagtggatcccccgggctgcaggaattcgtctcacccctagaaaaaaggctttacaagtcaattgacgatgcaaaatatttgggacctggcattttgtttcctcgccaatcaccttgtagagttttgaaaaggtggccgtttaatcctctgaatccacatataaatactgagcaagctgatgctgttgcaatggtacttgcctgcagagagagctccaccatatgtgatatatggacctccaggaactggcaagaccatgaccattgtagaggccgttttgcagctttacacgggaaagaagagggcaaatattctcatctgtgctgcttccaatactgcagctgatcatgtactggaaaagctccttcaagctagctatctgatccggccaagtgatatctttaagctaaatgctcagagtcgccaatacgaggatgtcagtactgattttatcaagttttgcttctttcaagatcgggtgttcatgtgccctcccttacaagcattggtgcggtacacgatagtcatatcgacctattcgagttcctatcagctgcacgctgagggcattcaccaagggcattgcacacacattttcctggatgagggcggccaagcctctagaacagaggcgatggttccttttgtcaaggttgtgtgagaagagacactgttggttggtgttagcagggagatccacaagcaattaggtccggatggcttactgttaagcaaaccaaagaaaggagggtcttggggacatcatatctgggaaaagctgcttaactgacctccaac

SEQ ID NO: 84153 - protein, 160 aa, Zea mays
  misc_feature: Ceres CLONE 1570150
MLLQWYLPAERAPPYVIYGPPGTGKTMTIVEAVLQLYTGKKRANILICAASNTAADHVLEKLLQASYLIRPSDIFKLNAQSRQYEDVSTDFIKFCFFQDRVFMCPPLQALVRYTIVISTYSSSYQLHAEGIHQGHCTHIFLDEGGQASRTEAMVPFVKVV

SEQ ID NO: 84154 - DNA, 854 bp, Zea mays
  misc_feature: Ceres CLONE 1570156
  misc_feature: Encodes the peptide sequence at SEQ ID NO. 84155
ctccccgcggtggcggccgctctagaactagtggatcccccgggctgcaggaattcgtctcacccctagaaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccaccctcctccctcaaagcttcctccaagggcatggaccccacccgtccaccgcttggagagcgggttccagaagttcaaggaccgagggctatgacaaaaaaccggagctgttccaagcctctcaagtccggccagaaccccaggtaaatgggggttccctgctccaaaccccccggtggcccctcggggaccctggggccggaacccggggaaggctttatccggccgaaaaaacacctcctggggccccccccacaaaaaaaaaaataacccggcacgggggcgccccctcatataacccccggggccccccaaggggaagggaaatgggggtatttggcccccaccgcgtgggggtggggat

SEQ ID NO: 84155 - protein, 86 aa, Zea mays
  misc_feature: Ceres CLONE 1570156
MSSCLCLPKKKEGPAKEKPSTDTPTSSLLQNQKPSQPPPSSLKASSKGMDPTRPPLGERVPEVQGPRAMTKNRSCSKPLKSGQNPR

SEQ ID NO: 84156 - DNA, 1236 bp, Zea mays
  misc_feature: Ceres CLONE 1570157
  misc_feature: Encodes the peptide sequence at SEQ ID NO. 84157
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (62)..(62): n is a, c, t, g, unknown, or other
  misc_feature (828)..(828): n is a, c, t, g, unknown, or other
  misc_feature (980)..(980): n is a, c, t, g, unknown, or other
  misc_feature (1029)..(1029): n is a, c, t, g, unknown, or other
  misc_feature (1223)..(1223): n is a, c, t, g, unknown, or other
  misc_feature (1236)..(1236): n is a, c, t, g, unknown, or other
agagagagtgatntnnnntatatctcccgtataagtaaataacatatataccgattatagcnttaaatttattttttgtccaaaactgggctccccgcggtggcggccgctctagactagtggatcccccgggctgcaggaattcgtctcacccctagaaaaattcgaggcgataggcatcgtcgtcccacccagcagtgcagagactctctctctctctccccggccacctctcgctcacgagcaccccatcttccccgccagggcctgggtatgggtgctccgctcgcctcctggccatgggcaagcctcggatcatacaagtacctgctgtacgggcctctggtggcgaaggtggcgcacgcgtggagggagacggggagcctgccgctggggtcgtggtgcctccacctcctgctccccctggagctccgctcgctcaccttccagctcaggttctcctacgggaacatggctccttctttatcctgcccccgccacagtcgtcaaaagaaagggtgtcgaactatcaaccaggatccgacatccgaaaatggggaactggggaaataaccattggcagatacccctggcaataaccgcctggtatctaacggtcttgtgtcggccctataggggtggttccgcgtcgcgagacgaaagttcccccggggccccacttatatttccttaataatcactttaccactatttccacaacctaaacggcaaacactcccccctcccgacctagggtaattgtctgggggcgccccctccttatcgtagacgggcgactgtggaggtgacacgacccccacacgctgnacaaaacaccttcaaaccagagaattagaagatacactttatacaaagagaaaaaacaccctaccctcgtagttccttctctatcctttgaaatccgcggtagtgtcccacctccctcaccccatagagaagccgcgcgataagtgcaaganaccacttgggatgggtttcagcaacaagccacaaacaaactaacctatngttcccccaagtctataccgcgccctcccccctccggcggggtaggaaactcactaactacatactaatctcacttccccacctctaacaacagtccataagactgctgacgacacccacccaacacactcgatagaggataaatacgagaggatatacatactcgcataaatagtgatgaggagctcctcacngcgcgtcacctgn

SEQ ID NO: 84157 - protein, 99 aa, Zea mays
  misc_feature: Ceres CLONE 1570157
MGAPLASWPWASLGSYKYLLYGPLVAKVAHAWRETGSLPLGSWCLHLLLPLELRSLTFQLRFSYGNMAPSLSCPRHSRQKKGCRTINQDPTSENGELGK

SEQ ID NO: 84158 - DNA, 786 bp, Zea mays
  misc_feature: Ceres CLONE 1570158
  misc_feature: Encodes the peptide sequence at SEQ ID NO. 84159
ggagctccccgcggtggcggccgctctagaactagtggatcccccgggctgcaggaattcgtctcacccctagaaaaaagtcgcgtcacggacatgcggacacagcgggatccagcaccaagagcctaggaaggccaggggcaggggtcctcgccctcgccgcaatggagctgctggccaaggcgcccgtgctgggctgcgccgggaagatgcagaggcagcggcaacgggggtccgcgctgggcaggtggatttgccgtgccgtggcgccgccgagggccgcgccagccacgccgccgagggtgcggctcagggacggccgccacctggcgtacgccgagtccggggccagcaaggaggacgcgaggttcaaggtcgtcttctcccacggcttcaccggctcccgcctcgacaccgtccgcccggcgccggtcagtgtcccgccccggcctctggatctggctctgcacggaaaagattcgagcttttgtggatccgcttgtgttctcccccccagttcctgtacacatcgccagccagcgcgattgtgcattgcgtggttcgccggtgccatccgtgcgaccacacgaacatccttactgtaggcgagttcgtcttcgatcgggccgatgcaatcgactccgtatctcacagccgctccgtatcctcaactgaatgaatttgtttctactttctaggaagttgcggaggagctgggcgtgtacatggtgggtttcgaccgcgccgggtacgggcagagcgaccccaaccccaccgggtcgtcat

SEQ ID NO: 84159 - protein, 146 aa, Zea mays
  misc_feature: Ceres CLONE 1570158
MELLAKAPVLGCAGKMQRQRQRGSALGRWICRAVAPPRAAPATPPRVRLRDGRHLAYAESGASKEDARFKVVFSHGFTGSRLDTVRPAPVSVPPRPLDLALHGKDSSFCGSACVLPPSSCTHRQPARLCIAWFAGAIRATTRTSLL

SEQ ID NO: 84160 - DNA, 829 bp, Zea mays
  misc_feature: Ceres CLONE 1570161
  misc_feature: Translation starting site: 383
  misc_feature: SWISSPROT Homolog: EC 4.2.1.1 Carbonate dehydratase
ctggagctcaccgcggtggcggccgctctagaactagtggatcccccgggctgcaggaattcgtctcacccctagaaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccccccgaaaaaaaaggaggggccagcgaaagagaagccgtccacagatacccccacctcgtcactccttcagaaccagaagccctcccaacctccacctcctccctccaaggcttcctccaagggcatggaccccaccgtcgagcgcttgaagagcggggttccagaaattcaagaccgaagtctatgacaaaaagccggagctgttctagcctctcaagtccggccagaaccccaggtacatggtgttcgcctgatccgaatcccgcgtgtgagccgtcggtgaccccggggcctggaaccccggcaaagcctttacccctacgcaaaaatcgcctcccagggccccccccctacgaaaaaaaacaaaataaagccggagaaaaggttcccccccttccagataccccccgtggttgaacaccacaag

SEQ ID NO: 84161 - DNA, 844 bp, Zea mays
  misc_feature: Ceres CLONE 1570162
  misc_feature: Encodes the peptide sequence at SEQ ID NO. 84162
  misc_feature (800)..(800): n is a, c, t, g, unknown, or other
acccgcggtggcggccgctctagaactagtggatcccccgggctgcaggaattcgtctcacccctagaaaaagtcctcgcatcccgcgccacaccatcccaatcccctccctccccctcgcgtctccagtctccacacctttcacacgcgacgccggagagacagagcgcgcgcgcgcgcccgaaagatgtcgacgtgcgcagcggacctggcgccgctgctgggcccggcggcggcgaacgccacggactacctgtgcgggcagttcgcggacacggcctccgcggtggacgccacgtacctgctcttctcggcctacctcgtgttcgccatgcagctcggcttcgccatgctgtgcgccggctccgtccgcgccaagaacactatgaacatcatgctcaccaacgtgctcgacgccgccgcgggggcgctcttctactacctcttcggcttcgccttcgccttcggcacgccctccaacggcttcatcggcaagcagttcttcgggctcaagcacctgcccaggaccggcttcgactacgacttcttcctctaccagtgggccttcgccatcgccgccgcgggcatcacgtcgggctccatcgccgagcggacccagttcgtcgcctacctcatctactccgcgttcctgacggggttcgtctaccccgtggtgtcgcactggttctggtccgccgacggctgggccggcgccagccgcacgtccggcccgctgctcttcggggtcggcgtcatcgacttcgccggctccggcgtcgtccacatggtcgggcgcatcncggggctgtggggcgcgctcatcgagggcccccgcatcgggcgt

SEQ ID NO: 84162 - protein, 219 aa, Zea mays
  misc_feature: Ceres CLONE 1570162
  misc_feature (36)..(219): Pfam Name: Ammonium_transp Pfam Description: Ammonium Transporter Family
  misc_feature (205)..(205): Xaa is any aa, unknown, or other
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGFVYPVVSHWFWSADGWAGASRTSGPLLFGVGVIDFAGSGVVHMVGRIXGLWGALIEGPRIGR

SEQ ID NO: 84163 - DNA, 776 bp, Zea mays
  misc_feature: Ceres CLONE 1570164
  misc_feature: Encodes the peptide sequence at SEQ ID NO. 84164
  misc_feature (620)..(620): n is a, c, t, g, unknown, or other
  misc_feature (626)..(626): n is a, c, t, g, unknown, or other
  misc_feature (630)..(630): n is a, c, t, g, unknown, or other
  misc_feature (726)..(726): n is a, c, t, g, unknown, or other
ctccccgcggtggcggccgctctagaactagtggatcccccgggctgcaggaattcgtctcacccctagaaaaaggagcaacaaaaaaaaaagaacaaggggaagaaatctcctcccccgtgctgttgccgtctgtttggcctcgaccgcggaccgcccgctaccatccaaaaggcggcggcaggctgctctgcccactcggtgccgttgtcgtcgccccagccagcgggatcttgctgctccaccgccgcctgccgctgttttcctccattcagctcgcgcctgctccagatatctgacccgggaggcggcggcggcaggcaggcagggagccaacccgggagaagaaggccagggaaggtgttcatcacttgagctcatatcatcgtcagaggcaggcagcagtaagcagattccgctgttgctgagcattgtcgtcgtgggcgtggcaggccagttcgcgtggagacggggagggaacatctggtgtgcgtttgctaaccgggggggcggccggcgggtggaagcgaaccagcgaagactgctctgcggcggcaaagggtttcaaaatgctggcgtgcatcgcctgctcggccaagacggcggggatcaggacgggntccgcngcgncacgccccacggaaaggacgccggcaagtccctcaccctccagctcaaggacatggtgctcaagttctccggctccggcaagcagtacaagccgcnggcggcaaacccgtcgttccggggcaaacgctttcacggcaacagccgcc

SEQ ID NO: 84164 - protein, 31 aa, Zea mays
  misc_feature: Ceres CLONE 1570164
  misc_feature (15)..(15): Xaa is any aa, unknown, or other
MVLKFSGSGKQYKPXAANPSFRGKRFHGNSR

SEQ ID NO: 84165 - DNA, 798 bp, Zea mays
  misc_feature: Ceres CLONE 1570165
  misc_feature: Encodes the peptide sequence at SEQ ID NO. 84166
  misc_feature (661)..(661): n is a, c, t, g, unknown, or other
ctggagctccccgcggtggcggccgctctagaactagtggatcccccgggctgcaggaattcgtctcacccctagaaaaaatactccaccactctgctaaagagtaaagacccagcagacatagatcagtgggtcctccctcgtcaagcagcacggtgatccacgggcgcacagggctttttgccggccattacagaggagaggaggccgacaaaggcgtggcagaggtcccatccatgggagaggaagcggccgccggagctcatccccgtgggcccgctcatcgaggtcggcggcgggcgggacgacgacgacggcgcggtgcgcggcgacctgatgaaggccgcggacggctgcgtggagtggctggacgcgcaggccccgcgctccgtggtgtacgcgtcggtgggcagcgtggtgcggctgaacgcggagaggtggggggagatggcgcacgggctcgcgtccacggggcggcccttcctgtgggtggtccgccccgacacccggccgctgctgccggacgggttcgtggactccgtggccgggcgcggcgcggtggtgccgtggagcccccaggaccgcgtgctggcgcacccgtccaccgcctgcttcctcacgcactgcggctgggactccacccctggagaccatcgcggcngggcgtgccccgtggttgccctttcccgcagtgggggcaaacagggcaccgaaccccaaagttcctgggggaaaaaacccccgggaatggggggttccccctcccccggggccccctgcgggggggaaaccccctgg

SEQ ID NO: 84166 - protein, 154 aa, Zea mays
  misc_feature: Ceres CLONE 1570165
  misc_feature: SWISSPROT Homolog: EC 2.4.1.210 Limonoid glucosyltransferase
  misc_feature (109)..(109): Xaa is any aa, unknown, or other
MKAADGCVEWLDAQAPRSVVYASVGSVVRLNAERWGEMAHGLASTGRPFLWVVRPDTRPLLPDGFVDSVAGRGAVVPWSPQDRVLAHPSTACFLTHCGWDSTPGDHRGXACPVVALSRSGGKQGTEPQSSWGKKPPGMGGSPSPGAPCGGETPW

SEQ ID NO: 84167 - DNA, 1038 bp, Zea mays
  misc_feature: Ceres CLONE 1570167
  misc_feature: Encodes the peptide sequence at SEQ ID NO. 84168
ctccccgcggtggcggccgctctagaactagtggatcccccgggctgcaggaattcgtctcacccctagaaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgagccggcgggttccccagcagtgtggcactgacgaacacgcttcagcgccgtcgtcgttctcgccgctatcttgtcgtcgcctcggcgacgagagcccaacaggaagccgcccctgtgacgatcaaggacgtggacttcagctctcatcaggccgcggccgacaacggggagctcgccgcgcggtgggggggaggtccacggcaacaaacaacgggaaggggctgctggaaccccattggacggggggctcctcccaggagcccatcccgctacggggaatttgccccaggccccccttagaaaaggtttgaaaaaaaaaaggttttttccccctttttggggggagtttgaatattaccccggggaaaaaaacttttttttccaaaaaagtgtgggcccttggggggaatttggtgttaaaaggtacaccgggtttttctttatgccccctgggagaaagaaacctaagtttcccccaattctgggattatataaggcgcgcccccacccccatattttgggagagattcccccgcatttttcctgggttgtgggcggctgttccaccacaaaataaagagcgggagctctcccccccgggtaatatccctcgtgggtgtggggggcacactcccccccccttatgggggggggagaatttaggaaacaaaaaatctccctgaggaaaggaggtgccccctcgcgcccccctttgtaggggggcggggggccttccctct

SEQ ID NO: 84168 - protein, 117 aa, Zea mays
  misc_feature: Ceres CLONE 1570167
MAATVSSCLSLVPTVHHRAGGFPSSVALTNTLQRRRRSRRYLVVASATRAQQEAAPVTIKDVDFSSHQAAADNGELAARWGGGPRQQTTGRGCWNPIGRGAPPRSPSRYGEFAPGPP

SEQ ID NO: 84169 - DNA, 948 bp, Zea mays
  misc_feature: Ceres CLONE 1570171
  misc_feature: Encodes the peptide sequence at SEQ ID NO. 84170
tccccgcggtggcggccgctctagaactagtggatcccccgggctgcaggaattcgtctcacccctagaaaaagccgtctagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggaacaccgggatcgggataaggatgacgggaaggagaaggagaggagccgcgatagccgcgggaaggacagagacagggaagggagagatacgggagaaggagaggggggacaggcaccggcccagagagagggaggtggaacgggagcggaggagcctgagccgttcggagcggcgccgtatcgaggaagaggagatggtgagggagctggagatggagcgcgagcgcagcgagcgacaccactatcgcgaccgtgacgtcaggcgtaggaaagatgacggggcagagccagaagttgatccagaaagggaccagaggactgtatttgcttttcagctatctctgaaggcagacgaaagagatgtttatgagttcttctcaagggctgggaagggtcgtgatgttcgtcttatcatggaccgaaactcaggacgttctaaaggagttggggatacacactgaaattttatagtttgctctacatgctggggatatcggcaaatttcaagttctagggcataagggggcaccccagaaccaagttcgaaacctctacatttttgatcaaaatgcctgaaagtttcctgggaaaattgaaatgcttaactatgatgccccccttttggttcttctttcctttttaaggaat

SEQ ID NO: 84170 - protein, 146 aa, Zea mays
  misc_feature: Ceres CLONE 1570171
MTGRRRRGAAIAAGRTETGKGEIREKERGDRHRPREREVERERRSLSRSERRRIEEEEMVRELEMERERSERHHYRDRDVRRRKDDGAEPEVDPERDQRTVFAFQLSLKADERDVYEFFSRAGKGRDVRLIMDRNSGRSKGVGDTH

SEQ ID NO: 84171 - DNA, 722 bp, Zea mays
  misc_feature: Ceres CLONE 1570174
  misc_feature: Encodes the peptide sequence at SEQ ID NO. 84172
  misc_feature (220)..(220): n is a, c, t, g, unknown, or other
  misc_feature (221)..(221): n is a, c, t, g, unknown, or other
  misc_feature (237)..(237): n is a, c, t, g, unknown, or other
  misc_feature (261)..(261): n is a, c, t, g, unknown, or other
  misc_feature (262)..(262): n is a, c, t, g, unknown, or other
  misc_feature (270)..(270): n is a, c, t, g, unknown, or other
  misc_feature (677)..(677): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (689)..(689): n is a, c, t, g, unknown, or other
ctccccgcggtggcggccgctctagaactagtggatcccccgggctgcaggaattcgtctcacccctagaaaaaggtctggagaagggttggggtgattgcgctaagcgtgcacaggagactatccacctcctcttggacctcctggaggccccagatccgtccaccctggagaagttccttggaacgatccccatggtgttcaatgtcgttatcctctnncccctcatgggttacnttcgctcaagctaaatgtcttggnngtttaccntgaacaccgggagggcccaaggttggtctaccattcttttgaaatcaaagtgccgccgccttatgggaagaaaccaaaaatggccttgcctgaaaggaaattcaaaccaaaggggtggggggccttttggaaacaatctcccgcccccagaaaaaaacccctttttttttgggcaccccccggggggggggggcccccccccgggaaaagacaaacattggggggcccccccccccctttgttggggggcccccccagccccccctctttttaaaaaaaaaaaaaggggctcttcttttttggggggcccccccccagaaaaaaccaccgccggccccccaaaaaaaaaaacccccccctcttcttcgggggggggggggggggggggccttttttttttttttttnggnnnnnaaaanaccaagaaaaaaaaaaaaaaagcgggggggggg

SEQ ID NO: 84172 - protein, 82 aa, Zea mays
  misc_feature: Ceres CLONE 1570174
  misc_feature: SWISSPROT Homolog: EC 2.4.1.13 Sucrose synthase
  misc_feature (73)..(73): Xaa is any aa, unknown, or other
  misc_feature (79)..(79): Xaa is any aa, unknown, or other
PRGGGRSRTSGSPGLQEFVSPLEKGLEKGWGDCAKRAQETIHLLLDLLEAPDPSTLEKFLGTIPMVFNVVILXPLMGYXRSS

SEQ ID NO: 84173 - DNA, 782 bp, Zea mays
  misc_feature: Ceres CLONE 1570177
  misc_feature: Encodes the peptide sequence at SEQ ID NO. 84174
  misc_feature (713)..(713): n is a, c, t, g, unknown, or other
tccccgcggtggcggccgctctagaactagtggatcccccgggctgcaggaattcgtctcacccctagaaaaaaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcgggcgctacgtcgtcacggccagccccagggtcatggtcgagcccttcgccagggccttcctcggcgccgacaaggtcgtcgggaccgagctggtagtcggcagggacggcaagggcacgggcttcatggccaggccaggcgtgctcgtcggcgaccacaagaagaagccgtcgtcaaggagctcggcgacgcgctgccnacgtcggcatggggggatagggggacccgacttcgacctcatgtccatctggcaagaaggcttacttgg

SEQ ID NO: 84174 - protein, 210 aa, Zea mays
  misc_feature: Ceres CLONE 1570177
  misc_feature: SWISSPROT Homolog: EC 2.3.1.15 Glycerol-3-phosphate O-acyltransferase
  misc_feature (188)..(188): Xaa is any aa, unknown, or other
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGGRYVVTASPRVMVEPFARAFLGADKVVGTELVVGRDGKGTGFMARPGVLVGDHKKKPSSRSSATRCXRRHGGIGGPDFDLMSIWQEGLL

SEQ ID NO: 84175 - DNA, 859 bp, Zea mays
  misc_feature: Ceres CLONE 1570178
  misc_feature: Encodes the peptide sequence at SEQ ID NO. 84176
  misc_feature (584)..(584): n is a, c, t, g, unknown, or other
  misc_feature (799)..(799): n is a, c, t, g, unknown, or other
ctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcangccgcacgttctcgtcggcgatctgttactacggtggcccgtggggaacaagttcggctcctgtcacgcgacctgctgctgctgccggcgacggcgaggatcctggggtcgcggcatggcgagcgagagatctcgacgaggccatctcgtcgctgttccctgtccccactggcaacgctaccgaagagagcttgagacggggcgtcgccgcctgncaacatgatggtggcgagcgcggcgacgttcccgtacgtcgagcggcgggatgagcgccg

SEQ ID NO: 84176 - protein, 227 aa, Zea mays
  misc_feature: Ceres CLONE 1570178
  misc_feature: SWISSPROT Homolog: EC 3.2.2.22 rRNA N-glycosylase
  misc_feature (139)..(139): Xaa is any aa, unknown, or other
  misc_feature (210)..(210): Xaa is any aa, unknown, or other
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSXRTFSSAICYYGGPWGTSSAPVTRPAAAAGDGEDPGVAAWRARDLDEAISSLFPVPTGNATEESLRRGVAAXQHDGGERGDVPVRRAAG

SEQ ID NO: 84177 - DNA, 790 bp, Zea mays
  misc_feature: Ceres CLONE 1570179
  misc_feature (527)..(527): n is a, c, t, g, unknown, or other
ctccccgcggtggcggccgctctagaactagtggatcccccgggctgcaggaattcgtctcacccctagaaaaagtaaacactgcttcaccagttcgctgcttctcctcgtcctcacaggcgcgtcgatccggagggcgcctgccgccgccggcgggaacggaggcccgagcaggagcgggactggggacggcgaatctggagcccggcggacctgcattgccgcgggaccgccgcgcgtaggcagatctccccccgtcccctgccgcggcaccggcacggcacggcatggtggctgccgcggcggcggccaccgcgccagatccggcccgcccctcgcgcccgccgctcacgccggcgctcgacaagcccaactccgccgccgcgcggaggaactcgcgctcctacaagcccgtgtcctcgaggtacctgcccgccgccgcgtccccggcatcgtccacctcgtcgtcttcctcgtcctcgtccccgcgctccctctccgcggagggggccgggtcatctaccccngccgccgcagcactccacgtcgcccaacaacaccgggtcggcaggggtaaacggccaccgcaccgggaccacgatgcgggagcctctccgtgtgcgtccagggggggagcccttcttctaaaaaaatcccggcggcgcccgggggcctcttttcccgttccctcccgggagggccccccggggcccccccccggaaacccccgaaaaaactcccccccccgtgcccgaaagccaaaacccggccccccggggggggagtagga

SEQ ID NO: 84178 - DNA, 828 bp, Zea mays
  misc_feature: Ceres CLONE 1570180
  misc_feature: Encodes the peptide sequence at SEQ ID NO. 84179
ctccccgcggtggcggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaagtgtccaaggcggagttcatcgacctggcgcgcaagtccggcaagttcgacgaggacagcctgggcgttccagtcgcgtctgcttggcaaatcccggcatcggcgacgagtcgtacatgcccgcgctgcgtggttcgagcccaacgccagctgcgccaccatgaaagggggccgccgccgaggccgtccccgggccattttcgccggcgctgggacaagctgttccaaa

SEQ ID NO: 84179 - protein, 214 aa, Zea mays
  misc_feature: Ceres CLONE 1570180
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLGVPVASAWQIPASATSRTCPRCVVRAQRQLRHHERGPPPRPSPGHFRRRWDKLFQ

SEQ ID NO: 84180 - DNA, 907 bp, Zea mays
  misc_feature: Ceres CLONE 1570181
  misc_feature: Encodes the peptide sequence at SEQ ID NO. 84181
  misc_feature (683)..(683): n is a, c, t, g, unknown, or other
  misc_feature (759)..(759): n is a, c, t, g, unknown, or other
ctccccgcggtggcggccgctctagaactagtggatcccccgggctgcaggaattcgtctcacccctagaaaaaacctcgttccttccccctccccacccttctcgctccgccccaccccaccccacccccgtaccaggtaccaccacccacccaagcgtcgccggccgccgcgggcgaatccccgtgctggaatcgacagcccgcctgttcgctggactcgctgcctcggcccttctcttcgcacctctctcagcctcgccacccgggtccaattcgccccgcggtataggaatcccatcctagattccatcgaggggctgcaatgccggcacctgcctagctggaaatcgggcgctaacggacaccgggcgccgagatgggccgttccggccgccgccggcgggaccgcatgcggtggagcaatctctacaccttctcctgctttcgcgcccagcacgagcacgccggcgatgcgggcccctcctccgacggggctggcgccgtcggcgggccgggcttctcgcgcgtcgtgtactgcaacaacgccgccctgcagaagccggctcagtacatcaccaactacatcaccaccaccaagtacaacgtcgtcactttcttccccaaggccatcttcgagcagttccgacgcgttgccaacctctacttcctcctcaccggcantctctctcttaccccggtgtgcccccttctctgccgtcagcatgattgctccgctgggcatttgcggttgcctcancatgatgaaggaggggtttggaggatgggccccgcttcttgcggacatgaaggggaacaacgccatgtccccgtgcacaaaatgatggcgaattcgactcccggcactgggaggaccttccttaagcaatagggccagggttaaaaag

SEQ ID NO: 84181 - protein, 170 aa, Zea mays
  misc_feature: Ceres CLONE 1570181
  misc_feature (102)..(102): Xaa is any aa, unknown, or other
  misc_feature (127)..(127): Xaa is any aa, unknown, or other
MGRSGRRRRDRMRWSNLYTFSCFRAQHEHAGDAGPSSDGAGAVGGPGFSRVVYCNNAALQKPAQYITNYITTTKYNVVTFFPKAIFEQFRRVANLYFLLTGXLSLTPVCPLLCRQHDCSAGHLRLPXHDEGGVWRMGPASCGHEGEQRHVPVHKMMANSTPGTGRTFLKQ

SEQ ID NO: 84182 - DNA, 818 bp, Zea mays
  misc_feature: Ceres CLONE 1570182
  misc_feature: Encodes the peptide sequence at SEQ ID NO. 84183
  misc_feature (715)..(715): n is a, c, t, g, unknown, or other
  misc_feature (716)..(716): n is a, c, t, g, unknown, or other
ctccccgcggtggcggccgctctagaactagtggatcccccgggctgcaggaattcgtctcacccctagaaaaacactccactccactgtgtgctgggtgctgcttccttccaaatctaggggatcaagcagccagccttccaccgcgccgccagcaatggcggcacccccgcccgcgccgttcctcctcctgctgctcgccgtggcagcagcgtcgctcgccggcgccgacgacccctaccgctacttcacctggaccgtcacctacgggccaatcagcccgctcggcaccacgcagcagggcatcctgatcaacggccagttcccgggcccgcgcatcgactgcgtgacgaacgacaacctggtggtgaacatcgtcaacagcctggacgagccgttcctgctcacctggaacggcgtcaagcagcgcaagaactcgtggcacgacggggtaacgggcaccaactgctgcatcccgccgggcgccaactacacgtaccacttccaggccaaggaccagatcggcaccttcttctacttcccgtccctggccctgcaccacgacgcgggcggctacggcgcgctcaacgtgtaccagcagaccgccatcccggtgccctacccgccggcggccgggggactcacgctgctcgtcggcgactaggacaccgccgagtcccccgcagactgacctccggaaaggcatgagaccgtnnggccggtttgttcctttaaaactttttccccaatccggcccggcgggaacttaaagggcaccggccttggggcaacccttggtaaccgcctgggccctaaga

SEQ ID NO: 84183 - protein, 168 aa, Zea mays
  misc_feature: Ceres CLONE 1570182
  misc_feature (34)..(150): Pfam Name: Cu-oxidase_3 Pfam Description: Multicopper oxidase
  misc_feature: SWISSPROT Homolog: EC 1.10.3.2 Laccase
MAAPPPAPFLLLLLAVAAASLAGADDPYRYFTWTVTYGPISPLGTTQQGILINGQFPGPRIDCVTNDNLVVNIVNSLDEPFLLTWNGVKQRKNSWHDGVTGTNCCIPPGANYTYHFQAKDQIGTFFYFPSLALHHDAGGYGALNVYQQTAIPVPYPPAAGGLTLLVGD

SEQ ID NO: 84184 - DNA, 1003 bp, Zea mays
  misc_feature: Ceres CLONE 1570186
  misc_feature: Encodes the peptide sequence at SEQ ID NO. 84185
  misc_feature (271)..(271): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (579)..(579): n is a, c, t, g, unknown, or other
  misc_feature (585)..(585): n is a, c, t, g, unknown, or other
  misc_feature (586)..(586): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (638)..(638): n is a, c, t, g, unknown, or other
ctccccgcggtggcggccgctctagaactagtggatcccccgggctgcaggaattcgtctcacccctagaaaaaattgctcaccccaaagcaaagcaatcacgagcaatgggcgagataggcacggaccaccgcggcctagccgaggccgaggccggcgtcggcggcaaggaggagggcatcgtcctcggcggccacgaggaggaggaggagacttcgccggtggagcaggtgcggctgacggtgccgtcgacggacgacccgtcgctgcncggtgttggtacgtttcccgggatgtggagcatcgggctgctgtcgtgcgcgctcatgagcttcctcacagttctctcgtacggacggagccgctgatcgtgagcatatcacggtgcaggttggcgtccctgcctgttgggccccacttcttgggccccggccgcgcttgccggcggcggccatgggttttcctgggggggcccccccctttcttgggccggtcggggatatttgtaaccttctaactccggggggggccccttttaaccgccccaagggtnnnnnnnnnnnnacagggagccgcagnaggggnnggnnnnnnnncccaggggttttgccgggttcgaggataaaacggttttattncctcttatggtgccggtgggcccttttttttgtaaaatattttcccgggggggtgcttttaaaacaccacggcgaaaatttttctctttttttttaaacgcccgtggggtctctcttttttttcacacccacaaaggggggggtcccgggttcagggtggggaggaggggggccccctcctccaaaaaaaatacgggtgttctccccccgcgccctattttgggggggtgggggggggcaccctcctccccactatttttctcccccctcccgggggtgttttccccacaaagaaaaaaaaaaccctcctaattccccccgccccccaaatttctccccccccaaattttgtttccggggggggg

SEQ ID NO: 84185 - protein, 86 aa, Zea mays
  misc_feature: Ceres CLONE 1570186
  misc_feature (55)..(55): Xaa is any aa, unknown, or other
MGEIGTDHRGLAEAEAGVGGKEEGIVLGGHEEEEETSPVEQVRLTVPSTDDPSLXGVGTFPGMWSIGLLSCALMSFLTVLSYGRSR

SEQ ID NO: 84186 - DNA, 745 bp, Zea mays
  misc_feature: Ceres CLONE 1570187
  misc_feature: Encodes the peptide sequence at SEQ ID NO. 84187
  misc_feature (523)..(523): n is a, c, t, g, unknown, or other
ctccccgcggtggcggccgctctagaactagtggatcccccgggctgcaggaattcgtctcacccctagaaaaaccaacacaagccgccgtcatgtcgaagcgaggtaggggaggttcggctgggaacaagttccgcatgtcactgggtctaccggtggcggccacggtgaactgcgcggacaacacgggcgcgaagaacctctacatcatctccgtcaagggaatcaagggccgcctcaaccgcctcccgtccgcctgcgtcggcgacatggtcatggccaccgtcaagaagggaaagcccgacctcaggaagaaagtgatgcctgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgctagtgcagcaaatgccatcgtttgagagcttgnttgaatggtgttaagacttgagtatgatcatcctcaatggggtgttgcaccctgttgtaagggtgctattggaacttgatgggctccttttaaggttgggccccccaattttttgaggggaacaaaaaattgggccctaccctgggtttgccccaaattttgcccgccccaaaaaaggggaaaaataaaattaattttggggttccaaaaaaaaaaaaaaaa

SEQ ID NO: 84187 - protein, 140 aa, Zea mays
  misc_feature: Ceres CLONE 1570187
  misc_feature (19)..(140): Pfam Name: Ribosomal_L14 Pfam Description: Ribosomal protein L14p/L23e
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAANAIV

SEQ ID NO: 84188 - DNA, 1194 bp, Zea mays
  misc_feature: Ceres CLONE 1570190
  misc_feature (69)..(69): n is a, c, t, g, unknown, or other
  misc_feature (1052)..(1052): n is a, c, t, g, unknown, or other
  misc_feature (1055)..(1055): n is a, c, t, g, unknown, or other
  misc_feature (1056)..(1056): n is a, c, t, g, unknown, or other
  misc_feature (1144)..(1144): n is a, c, t, g, unknown, or other
  misc_feature (1194)..(1194): n is a, c, t, g, unknown, or other
atgttttgatttttttatagatgaaaagtaagataaggaagaaataaaatattgatttgagtaaggggntgtttttacaaactggaactccccgcggtggcggccgctctagaactagtggatcccccgggctgcaggaattcgtctcacccctagaaaaagtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaactgaagctggttcgccgtcaggaacgatgttttaagtgaatccattggaagagtcatataattacacaaaaacacataacttaatataaagctagggtgatgtgtattattttaagctgttagttcttctttcgctctaacaataaacgaacatatcagattgaaaggatataagaagagattatgaagaataataatggagaagaaatatgcagctatgtcgataatatgatcttataacattatattctttcttttgttgggtatatattttagtattatattcctttcgcccctgtatgtgtgatagatgttaataatatttcttcttttattgatgcttttaacaattttcaactcattatttaatagcaataaaaacattggaggtaaggagcacgggaaaaaaaaattaagatggtaagaaaataaaaaagtatagaggtatgacaaaatttatgttcgtccgaggcgtatttatcaccattatgttacggttctaaacattattgtccataccgttattctaaatagtaattcattatttataattatggtgttaaacgctataaatataatatgaatcatataagccccgctcatattatgttattataaaaggggtatcatcgagaagcgcaatattgagtctgatacagtctcgtcatgcccttttgctaccagagactaatctcataatcccccctccgcgctagtgaccgatcacaaancgnngttggcaagctccatggtgttcgtgttacattgtctaatgtggaattgatgtgctaacgtcatgaacagctaatatacgattacgacnaaacactatatagtaagttttgtccatcatgtcatcttatattacgcgcn

SEQ ID NO: 84189 - DNA, 964 bp, Zea mays
  misc_feature: Ceres CLONE 1570192
  misc_feature: Translation starting site: 269
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (109)..(109): n is a, c, t, g, unknown, or other
  misc_feature (430)..(430): n is a, c, t, g, unknown, or other
  misc_feature (433)..(433): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagctggaactcaccncggtggcggccgctctagaatagtggatcccccgggctgcaggaattcgtctcacccctagaaaaaacctcacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagccgccaaatgcgccggcgagcagccttaccgcctcgcgggcttcctggccgtctgcgccgtggccttcgtcgtgacatgcctcctccactggtgcttccccgggagccccgcntgngggaaggtggtggtgggacccggcggcctcggtgcccggtgcccggtggcggcccctaccgggcggtgggcggccggccctgcccgggggcccaagggggcctggcccctggggcccgggaaacatggtggcttcaatgaaagggggccctggccccacccgcaaaggcttccccgccccgcccggccgggggaaacccctcgggggggccccagggcgccccgtgaaaagggccttttcttcccccctccggggggggcaccaaaaagggggggggggggggggggggctcttcgaaaacccgggaaaaaatttggggccccccccaaaaaataccctccaaaaaaaacccccccgggggttttctccggggaaaacaggggcccccaaaaaagagagaatccccccccttaaagggggggccccccctgtgttcccacccgggggccacattggggggttttttcccccccccttaagggggggcccctataattgggggggggcccccttttttcccccccccctggg

SEQ ID NO: 84190 - DNA, 849 bp, Zea mays
  misc_feature: Ceres CLONE 1570194
  misc_feature: Encodes the peptide sequence at SEQ ID NO. 84191
acccgcggtggcggccgctctagaactagtggatcccccgggctgcaggaattcgtctcacccctagaaaaacccgacggcccgggccgacggctcgactccactagtcgctggaaccctctgcaacaaagccgcctccacctgaccacctcccttgagctcttccccttcgtcgtaggttgtgcgagccctctaccggcgcgcagtacaggggctgattgggtgatcaaacccgcaagatttgggtttgtgatttgggagcaggaggcggtggcaatatggaatataaggcgagatctactggaacttcaggaacttcgtctaaaagtttccgtgatctgtacaatatgaagtactcgagctacttaaacgacgaaccaatgccggatgctacatcggaaaaggagcagggaaatgagtatttcaaacagaagaagttcactgatgccattgaatgctactccagaagtattgggctgtctcctacagcagtaacatttgcaaatagagctatggcatatcttaaactaagaagattcaaggaggcagaggacgattgcactgaagctctgaatctggatgatcgctatattacagcatactcacgccgtaatactgcacgaaaagaacttgtgtagcttaagggagcaatggatgatgctgacttttctatcagtcttgatccacacattcagagctaacgaagcagtattctgagataaaactttgcacatgaacgaaatggctaaaaggatccagtgccagctaaacgtgcaggttctgggagtggataaactgcagatgtcgattctcacccactgactatctcccagaaggacatttttatgg

SEQ ID NO: 84191 - protein, 119 aa, Zea mays
  misc_feature: Ceres CLONE 1570194
  misc_feature (38)..(71): Pfam Name: TPR_1 Pfam Description: Tetratricopeptide repeat
  misc_feature: SWISSPROT Homolog: EC 3.1.3.16 Phosphoprotein phosphatase
MEYKARSTGTSGTSSKSFRDLYNMKYSSYLNDEPMPDATSEKEQGNEYFKQKKFTDAIECYSRSIGLSPTAVTFANRAMAYLKLRRFKEAEDDCTEALNLDDRYITAYSRRNTARKELV

SEQ ID NO: 84192 - DNA, 952 bp, Zea mays
  misc_feature: Ceres CLONE 1570200
  misc_feature: Encodes the peptide sequence at SEQ ID NO. 84193
  misc_feature (578)..(578): n is a, c, t, g, unknown, or other
  misc_feature (582)..(582): n is a, c, t, g, unknown, or other
  misc_feature (765)..(765): n is a, c, t, g, unknown, or other
  misc_feature (773)..(773): n is a, c, t, g, unknown, or other
  misc_feature (861)..(861): n is a, c, t, g, unknown, or other
acccgcggtggcggccgctctagaactagtggatcccccgggctgcaggaattcgtctcacccctagaaaaaatgggccactactgctagagctagtgctagtagcagcgtggagaggcagagaagtagccaaagccaagtaggaggaggaggaggagcggcaggtagggcgcggggcgagagcttgacgcggcaaccaccgctgcactgcactgcactgcaccccctagctcctccgagctcagcagctcgctcgcggcaagtcgccatccatgtcaggaaagatttatctggtcggccgatcgagctcctctccttctccgaagcactgaagctccagcggctgccctgcctgacagccacttcgcacgaccaaattaaaaagcgcgggcgatcgagatggcgcacgaccccagcctgggcttcgcggactacttctcggcggcggcggcggctgcggcggcgggcgccacggcgatggacgacgacgtcggggcgccggagctctatggcctgcatgccgacgacatggagttcctcggcatgcgtggcctggccgccatgccccctggcgcggnacancaccaccaccaccaccattacgggccacagcaaggccggtgcgctcctcgacgacgacgacgcgggggtgggggcagacgtcagcggctccgcggacgacgccaccatgcgcttcctgagcgagcagcagcagcagcagcagcaccaggcgccgctgtcgctgtcgctgtgcccggccgaccntgacgacnacgttgcacgagcagcaccacctcgccggcgggcggctcctcgtcccggtacatcaagagcacaagcccggcggcgtgggtgcagcancagcagcacgactacctcgcgtcgccgcaacagcacgcgtgaacccggggcagcttccaggtcttcgtccccgggcaacagggtcctgcag

SEQ ID NO: 84193 - protein, 122 aa, Zea mays
  misc_feature: Ceres CLONE 1570200
  misc_feature (60)..(60): Xaa is any aa, unknown, or other
  misc_feature (61)..(61): Xaa is any aa, unknown, or other
MAHDPSLGFADYFSAAAAAAAAGATAMDDDVGAPELYGLHADDMEFLGMRGLAAMPPGAXXHHHHHHYGPQQGRCAPRRRRRGGGGRRQRLRGRRHHALPERAAAAAAAPGAAVAVAVPGRP

SEQ ID NO: 84194 - DNA, 804 bp, Zea mays
  misc_feature: Ceres CLONE 1570201
  misc_feature: Translation starting site: 514
ctcaccgcggtggcggccgctctagaactagtggatcccccgggctgcaggaattcgtctcacccctagaaaaacagagagctactactccccctcctcatctcgagtgtgtcctccacacttacagacactgagagagcgccgtagcgccagcctccaagtcactcctacttccgcgttctctgagtggaacatagctgaaggtcgaaggcctgtacctgttccacactcccctgggctcaggcgcctaccaggctcgggtcatagagggcaaggcgccgattggcatcggtgccaccgtagttaacaactggacagtgtatgacgggccagggccgaacgcaaagctggttgcccgtgcacagggcttgcatatccaagccggcaactgggtcaactccttcagcctagtgttcgtggatcaaaggttcagtgggtccacgcttgaagtgaccgggatagtagttgaatcccgggagtgggctattgttggggggcaccggtcagtttgccatggcaaacggtgtccatcttcaagaaagttcccatggagcagagaaccgaagggaacctcatacaactcaccatccctgcctttctgtccggggccttcggaccgaagaaaacccctcggccgccaaaaattggaacccctggggttgggaaccagcggggtctccccgtgggacaattcaccgggcagaaagcccccggcggtctggaagaaaccaatccaccgtttggcctacttgggcaattccccgcatgaacccctctcaaatggccctttctccatcgtaaggg

SEQ ID NO: 84195 - DNA, 849 bp, Zea mays
  misc_feature: Ceres CLONE 1570202
  misc_feature: Encodes the peptide sequence at SEQ ID NO. 84196
ctggagctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggacggcggtctgctccagctcaccgccgtcgacggccgccgcgccaccgtcgtcgtccccaacgaccccgacctcatagacatcctcgccaccaacggcgtcgacatctccgtctcctagggcgagtcggcggggccggggcggcttcgtcgccttcgtcggcaaactcctctttccttttatcgcgttcgctgggcctcttcttcctcttccgccgcgcgcaagggcgggcccgggcgccggggcctggtggccttcgggggggcccatgggactttcgggcgcctcccaaaaaacaagttcccaagaagggggcccc

SEQ ID NO: 84196 - protein, 165 aa, Zea mays
  misc_feature: Ceres CLONE 1570202
MAPPSVSASHLLITASLPKPKPSSLRPPRLPLAKPLPASAALLALAASPALAADAPAPAPAPTPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVS

SEQ ID NO: 84197 - DNA, 817 bp, Zea mays
  misc_feature: Ceres CLONE 1570211
  misc_feature: Encodes the peptide sequence at SEQ ID NO. 84198
ctcaccgcggtggcggccgctctagaactagtggatcccccgggctgcaggaattcgtctcacccctagaaaaacgagcaccagccgtccagccccggtttttctcctcccgcccccgttccccgtcccgactcccgacccaacccatatcagagattccttccgttggtggcgctggcgtccgcgctggcgttcccgtgagtcggcccgcgcgcgaaggcggccgtgaccgaccgtccggagcttcatgcgccaggggcggcggctccaccccgtcgtttgatgggcaacgcatgcggcggcgcccttagatccaagcaccagcacagcttcaagcacgccgcgtcgtcgcagcgccaccacgcctcctccgagtacagcgccagcgccgcggccgacgactcgcccaggaagccggctacgccgccctgcaccacgggacgcccacgcgccgccggccgccgcccggcaccggcatgaagcgcggcgggggccggccccgccaccggacctggggttccgggctcggccaccccaacccccaaaactcggggaactttaacccccttggtaggaaaccccgggccagggggaatttcgggcaccccctttcctctggaccgaaattccgccaggggggggggaataacccctggaagggccttctcccaaggggcaaggtctcttacccggggagggacgcctaacaaaattggcccccccaatattccattttttggccccccccttttggggggaaaaaaaaatgggtggccgcataaggggggggccctaaaaaaggacaactcttttttca

SEQ ID NO: 84198 - protein, 65 aa, Zea mays
  misc_feature: Ceres CLONE 1570211
MGNACGGALRSKHQHSFKHAASSQRHHASSEYSASAAADDSPRKPATPPCTTGRPRAAGRRPAPA

SEQ ID NO: 84199 - DNA, 1141 bp, Zea mays
  misc_feature: Ceres CLONE 1570212
gtgttggggtggggggggggtgccgcagcacgacccaccttccacctctaattttttttttttttggaaaactggagctccccgcggtggcggccgctctagaatagtggatcccccgggctgcaggaattcgtctcacccctagaaaaacagaactggtacggacaaggggaatccgactgtttaattaaaacaaagcattgcgacggtcctcgaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctacccccactttgtgaaatgacttgagaggtgtaggataagtgggagccctccgggcgcaagtgaaataccactactttttaacggtatttttacttattcccgtggggtcggaaagcggggccacccgccccttcctttttggcttccaaaggccccgggccctccgcccgggggcccgaattccaggggccggaaagtacattttgttcccggggtggtgggaagttttttgggccttgagggggccgggctcaacaatatccttggtttaaaaaaagaaatataacccgcccgagggtgtggtgtcactctaaaaaaaattgaaaaccgtttctcccacgcgggaggaaaccacttggaaaattccccttccgttggtgggggaaaaacaaaaaaaaggggggtcaagaaaaggcctctcgcgcttcgggaaatttcatggaaattttcccacctggaacaaaaatatacctaaaaaccgggtgggaaaaagacgttggcgcccttaaatttcggaaacccttttatagaaccctttcccggaaggtctatagaaaaccattcggaggtgttgtcccaaacaaaaatgttccccaccaagggggaaataaccgtggttctttggagggcacaccacacaaagtttgtctttaaaccaccctttgttttt

SEQ ID NO: 84200 - DNA, 966 bp, Zea mays
  misc_feature: Ceres CLONE 1570214
  misc_feature: Encodes the peptide sequence at SEQ ID NO. 84201
  misc_feature (748)..(748): n is a, c, t, g, unknown, or other
  misc_feature (777)..(777): n is a, c, t, g, unknown, or other
  misc_feature (857)..(857): n is a, c, t, g, unknown, or other
  misc_feature (936)..(936): n is a, c, t, g, unknown, or other
tggagctccccgcggtggcggccgctctagaactagtggatcccccgggctgcaggaattcgtctcacccctagaaaaaagctggaagaggagaggaccgcgcgaggctccgtgccggcgagttcgggtgcttttcctgcggtccgagatgcgatcgttgggacccgggagacagcgcagctcgggttcgggttcgggggggcggtagccacctgagcaggatgtttaactggaacgacgagcagcaccaggtaagggatgcaatatgggctgaattcaatgagtgtgatgaccatattgtgccttgtcctaaaggtgcacaagatagcacgatagttagttccagggttcgcaagaacaatgaggaagaggtggctagtattgctgccatcactgaacagtctgcaggtgttcaaaatggacatcaagggatggaaaagcagactgcaagtcacacaagtgcacatatttcagccacacaaattgacatggaatcctggcctgatcttccttccctgaatcctacacttgatagaaattatagtgatgacaacatagcatccacatatctggatttttgtgctgcaaccagtttacaagaagtgaccggaaattctacagagcaactagatggtaaatcagaagtgtttggtaatgatcaagaagaaaagagtaacagtttacttgattgcgactggggcaatattggagattttgatgattttgaccgtctatttagccatagtgnactcatatttggtaatgagatagttgccnacgacagtgattttctttctgcatcttcgaatttgatggatactgctgtgctatcaatcccaattccggtcgaacacatnagtagccagtgtggtcacgtagaaacccgaggaaagaggtaaagtaaaatatccagcagtacaagtggcttctccaaangcaagtagagagtcatccgacgatttgcaa

SEQ ID NO: 84201 - protein, 225 aa, Zea mays
  misc_feature: Ceres CLONE 1570214
  misc_feature (176)..(176): Xaa is any aa, unknown, or other
  misc_feature (186)..(186): Xaa is any aa, unknown, or other
  misc_feature (212)..(212): Xaa is any aa, unknown, or other
MFNWNDEQHQVRDAIWAEFNECDDHIVPCPKGAQDSTIVSSRVRKNNEEEVASIAAITEQSAGVQNGHQGMEKQTASHTSAHISATQIDMESWPDLPSLNPTLDRNYSDDNIASTYLDFCAATSLQEVTGNSTEQLDGKSEVFGNDQEEKSNSLLDCDWGNIGDFDDFDRLFSHSXLIFGNEIVAXDSDFLSASSNLMDTAVLSIPIPVEHXSSQCGHVETRGKR

SEQ ID NO: 84202 - DNA, 825 bp, Zea mays
  misc_feature: Ceres CLONE 1570215
  misc_feature: Encodes the peptide sequence at SEQ ID NO. 84203
  misc_feature (117)..(117): n is a, c, t, g, unknown, or other
  misc_feature (131)..(131): n is a, c, t, g, unknown, or other
  misc_feature (132)..(132): n is a, c, t, g, unknown, or other
  misc_feature (139)..(139): n is a, c, t, g, unknown, or other
  misc_feature (140)..(140): n is a, c, t, g, unknown, or other
  misc_feature (313)..(313): n is a, c, t, g, unknown, or other
  misc_feature (369)..(369): n is a, c, t, g, unknown, or other
  misc_feature (398)..(398): n is a, c, t, g, unknown, or other
  misc_feature (414)..(414): n is a, c, t, g, unknown, or other
  misc_feature (415)..(415): n is a, c, t, g, unknown, or other
  misc_feature (471)..(471): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
tccccgcggtggcggccgctctagaactagtggatcccccgggctgcaggaattcgtctcacccctagaaaaaaaaagctctcgagacttcctcagcaatcaatcagctttccagancgatcggcagctcnnctcgatnncgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggccctgcgctcngcgcgccggtcatcgccgaagtgggatctctacagttcgaaccatggcagctcccnagagaaggcgtcggtgggggagaaaggantgggtactcttctcgnncgcgcgaacggcaagttccccgaaatggctcccgggcctaaccgggccggccccgnaaaaggggtacctggaaaggccacccgggggcccaaaaaaaacccgggtaggggcccccccccgcccccccctggggccaatcaaaaaaaaggggggcctcggtttttttttataccccccggggaaaaaccccccccccaaaggggggggttccaaaaaaacccaaaatggggggattttttgtcccccaaaaaaaacccccccccccccccggggggaaaatttttaaaaaacacccctttgggggcgccccccccccccccnnnccccaaaaaaaaaaaaaccaaaaaaaaaaaaccccgcccctctcttaaaggggggggggagaaaaaaaaaaaaaagggggggggggc

SEQ ID NO: 84203 - protein, 83 aa, Zea mays
  misc_feature: Ceres CLONE 1570215
  misc_feature (9)..(84): Pfam Name: NAM Pfam Description: No apical meristem (NAM) protein
  misc_feature (37)..(37): Xaa is any aa, unknown, or other
  misc_feature (65)..(65): Xaa is any aa, unknown, or other
  misc_feature (71)..(71): Xaa is any aa, unknown, or other
MDCGGALQLPPGFRFHPTDDELVMYYLLRKCGGPALXAPVIAEVGSLQFEPWQLPREGVGGGERXGYSSRXRERQVPRNGSRA

SEQ ID NO: 84204 - DNA, 870 bp, Zea mays
  misc_feature: Ceres CLONE 1570218
  misc_feature: Encodes the peptide sequence at SEQ ID NO. 84205
  misc_feature (387)..(387): n is a, c, t, g, unknown, or other
tccccgcggtggcggccgctctagaatagtggatcccccgggctgcaggaattcgtctcacccctagaaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacacatcctgatgagagcaccctcactttgtctcgcctcaggggagcatgcagatnctcgtcaagaccctcactggaaagacatcaccctcgaggtggagtcttctgacaacatcgacaacgttcaaggcaagatccctgacaaggatggcatccctcccggaccacaagcgggtcattttttgctggcaacaaccccaaggaaggggccccacctggcccgaaataaaaatttaaaaaggagaagaaccctccccctggggggttgcctccccagggggggcggaggcaaatacttcggggaaaaaccgaaggggggaaaaaatatccccccttgggggggagagctctctggaaaccctttggaaaatggcaaggggcccaaatcccggaaaaagagggggggcgccccccccggaaaaaaaaagggggtttttttttttgcggggaaaaaaccctttgggagaggggggggccccctttggggcaaaaaaaaaaatttttcagagagaagggaaaccccccccctggggtggtggg

SEQ ID NO: 84205 - protein, 61 aa, Zea mays
  misc_feature: Ceres CLONE 1570218
  misc_feature (6)..(61): Pfam Name: ubiquitin Pfam Description: Ubiquitin family
MQIFVKTLTGKTITLEVESSDTIDNVKAKIQDKEGIPPDQQRLIFAGKQLEDGRTLADYTS

SEQ ID NO: 84206 - DNA, 1273 bp, Zea mays
  misc_feature: Ceres CLONE 1570221
  misc_feature: Encodes the peptide sequence at SEQ ID NO. 84207
  misc_feature (1129)..(1129): n is a, c, t, g, unknown, or other
  misc_feature (1241)..(1241): n is a, c, t, g, unknown, or other
  misc_feature (1273)..(1273): n is a, c, t, g, unknown, or other
aaagctggagctcaccgcggtggcggccgctctagaactagtggatcccccgggctgcaggaattcgtctcacccctagaaaaagggactgggagcacgtagcacgcggaggaaaagcgatcggcgccgcggcggcaagatgactgcggcggcgacgatgacgtggcacgaggacctggccactctcgtgggggacacggactgttcacctcaccggcgccggggggcacgcgccggagccggcggatgttacgccggcgggggccgggtggtacggggaggaggaagaggtgagggcggaggaggggtggtcttcttcttcccacgcttcatccgtcatctcttggtcaagtttttgctgtagtgtgttggggggccagaattagaaactacgttttgagtgttttttccccccccccaaatacatttcctcgtcctggtacacttatgggtggccgttttgtttcggtgtttcagtgttgtggggtgtgttccttttttttggtggttgccgtcgtcgtgaggcctcctgtccatttttatcgtgtccgctccattcctgtatcgttattttcgtttggttctttttttgtatttttcgctgtgctgtttttgctgcccgatgttcgtcgtactcgctttgtttcgcgatttgttctccgctcgtgtttttcctatcgtcctgtctgggattctctcttggatcgcatctgttcttgatgatgccgctctcgctcttgctgtgtgtctcggacggacgtacgtggcaattgtcatctagagttgatgcgctctgtctcatgcctatgctcgtctctctttgttgttgtgcggttttgacatgagtaggataaagtctgttaattatattatactttcctctgcattgatgatgtgcccagcggcacgcgacggttatgtctgcgtcctgagcgcctctgtgtgtgtattggtgtatcggctagcctcgtgagtctcgacgtatagcatcatgttccatattcttacctctgcacgattctcttacacttatactttctgcatgattccgcgcatgctgttgttgatactcactcttgtatcgtatctgccctgttatgtgtaagcggcgtgcttctgtctctacatnaactcatgtcttctctcacgcgctcttcatcttcgcacactactttacacacatctgtctatattgtcgttaggatgcgtgactctttcgattgttctcgccgcttgctctncattgttgcgatgtacgctttgtcgtcttgtn

SEQ ID NO: 84207 - protein, 68 aa, Zea mays
  misc_feature: Ceres CLONE 1570221
MTWHEDLATLVGDTDCSPHRRRGARAGAGGCYAGGGRVVRGGGRGEGGGGVVFFFPRFIRHLLVKFLL

SEQ ID NO: 84208 - DNA, 986 bp, Zea mays
  misc_feature: Ceres CLONE 1570227
  misc_feature: Encodes the peptide sequence at SEQ ID NO. 84209
ggagctccccgcggtggcggccgctctagaactagtggatcccccgggctgcaggaattcgtctcacccctagaaaaaatccagcgcggctccaatcctgtcgcggccattaaaagcttccctcccctgcctctctctgctccgctcgtctcttctggaaccgtccctcgctcgtcatctttccgccttcgctacgcaattcctgtccacgctgcgggccagttgtgacgaccgcgaagctcgtcagagaaagaagagaggccggcaggcgggcggcgatcggagatggcgccagagaagccccggaaggagcaggaggaggaggaggaggagttgatgctggaggatggaggcatcgaggagagcccgcgccgcagcttcgaggactgcggtgattcccacgaggaggacgatgacaaccatgaggagcgggacggggactgcgtcggttcgccccgctccctcccagtcccataaagtgggccgcaaagctacagggaaaacaaaccgataaccttacacaatccgctgtcattaaccgaaacttttggggttaacttgggggccccttttccaacaagggaaaataaacccaacttcccgctcagagtctttggttcccgttaaataggattcatgggggggttccgagaaaccctagaaaaaattaaacacctgccaaaggtagggcccgggaaaaaaagggctttgaaagcgagaaaaaaaaaaataatttctctgggtccaaaaaaactccctcgcgccaaaaaaaccccgcgtggggttgttgaatagaaaagaaattataaaggaggggcccccatttttcaaagtgtgccaaaaccacggcgggagagaaacacttcctacgttttctccctagggtgggctatatatgttgcgacgacaataagaagctcttcacagagggggataacaaggaattcgtgtgtggagggaggagacattttcttccccccagcgaa

SEQ ID NO: 84209 - protein, 63 aa, Zea mays
  misc_feature: Ceres CLONE 1570227
MAPEKPRKEQEEEEEELMLEDGGIEESPRRSFEDCGDSHEEDDDNHEERDGDCVGSPRSLPVP

SEQ ID NO: 84210 - DNA, 1066 bp, Zea mays
  misc_feature: Ceres CLONE 1570228
  misc_feature (18)..(18): n is a, c, t, g, unknown, or other
  misc_feature (45)..(45): n is a, c, t, g, unknown, or other
  misc_feature (64)..(64): n is a, c, t, g, unknown, or other
  misc_feature (81)..(81): n is a, c, t, g, unknown, or other
  misc_feature (82)..(82): n is a, c, t, g, unknown, or other
  misc_feature (89)..(89): n is a, c, t, g, unknown, or other
  misc_feature (90)..(90): n is a, c, t, g, unknown, or other
  misc_feature (325)..(325): n is a, c, t, g, unknown, or other
  misc_feature (326)..(326): n is a, c, t, g, unknown, or other
tatggctctcttattcgncggatgagaggagcgaatatatattcntaatttgggcccccccccngcgcccccccccccccnncccccannaaaaaaaaactggagctcacgcggtggcggccgctctagaacagtggatcccccgggctgcaggaattcgtctcacccctagaaaacggaatccgatctaaccctaaacccgaatcccaaacggaggagggcactcggcgaggcaggtggcgattctgcgattctcctgtcaccttccgtcgtctccatcccccttcatttccggcgagggtcaaagcaggcctcttgctcttgnnggtggtttgagagagggagagaacatggcccgcgccgcggtgttggtggtgctcaccgtgtcaaccctggcggggggaacggccgccgggaaaatcgtccaccccgaagacaaggcccccagaatccctggaagccccaaccaattttccccgggaaaaaggggaaaagttgggtccaagggcaaaaaggggggggaaatttttttggcccccgggccccccgttttgggccccaaaaaaccctcccccccggggaaaaacccccaaaaaccgaaaaaaaaattttcgccgggggaaaaaccccaaaggggagtggggtgtctttcctctccaaaaaaaaaaaaggaggtccccccaggaagaattttttcttttttttttctcccaagggggggggaaagaaggcgcaaaatttcttccaaaaaaaaaaagaaaaaaaaaattttttttgcaaaaaaaccccgcggggggggctgtcttttctctctatataaaaaaaaaaataaaaaaaacaaacgccctcccccacaacattttttctacaaaaaaggtggtcctcgcgcacaaaaaaaaaagaaaacaacaccccacccccccataaacaaaaataaatggcgcggggggggttttctcttcctcacaaacaaaaaaagagaggggggttttgttttttatacacaccacctctcttaaaataaggaaaaaaaaacaaaactttgttgggggcggggcgttatctc

SEQ ID NO: 84211 - DNA, 935 bp, Zea mays
  misc_feature: Ceres CLONE 1570233
  misc_feature (684)..(684): n is a, c, t, g, unknown, or other
ctccccgcggtggcggccgctctagaactagtggatcccccgggctgcaggaattcgtctcacccctagaaaaacccatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaatttgtagtagcaatctcttgtaaactgcgcctcgcctttgcgtgttcctgggaccttttggcggctttctcgtcccctctttcccctcaatctccccttaattccttccccctcccccgggaaaaaccgggcgggggggtttggggttccccatagggcccccaaaaactgggagggcccttttggccccccgaccctctccaaaggggcggggggaacctttctcccccccccttccagaaaattggtgtaatggggggggggggggatcctccccgggggggttgttaagggttggcccgggggcccccttccccaaatttccccccgnattataagggaggaaccggtttttgggggaaccctggagaggtcttctttttttgggcggggcgccaccccccgatcacggggaaaaaactcgctgtgtggggggccaccccatgtattttaggggggaccccctcgggggggctccgccgccgtggtgttgagaatagaaaaacacacccggggggcgcccccttggaaaaagtctcttctgggcggccggagagagttgcctctggcgtgggcggtgta

SEQ ID NO: 84212 - DNA, 1113 bp, Zea mays
  misc_feature: Ceres CLONE 1570236
  misc_feature: Encodes the peptide sequence at SEQ ID NO. 84213
  misc_feature (26)..(26): n is a, c, t, g, unknown, or other
  misc_feature (63)..(63): n is a, c, t, g, unknown, or other
  misc_feature (67)..(67): n is a, c, t, g, unknown, or other
  misc_feature (898)..(898): n is a, c, t, g, unknown, or other
tgggtggggggtgtggggtgggggantggggggtgggatttattggggatacagaacaaaggngtgngtgggggggggggcaaactggaactccccgcggtggcggccgctctagaactagtggatcccccgggctgcaggaattcgtctcacccctagaaaaagtcggttccgcctagctgccccccctcggattcggccatggagcggcagtccagcatccggctgggcgcgctggagaagctgaggagcttccgggggatggagaagcagaagagcttccgcgggatcatgtccctcgagcggcggagcagggacagcccggggaaacgcggcgacacgccgctccacctcgcggcgagggccgggagcgtggccccacgcgcagaggatcctcgcgggagctcgaccgggcgctggccgccgagatgggccgccaggcagaaccaggacggcaagacgcccctggtacgtcgccggccgaaaaaaagcccaccccggaaggtcgtggcgcaaagatcctcagaggtcctgtgggcgttgcaagagggggccggggcttcaaggggccaaccaaataagtttttcgaacggcggtttccgcaattcggtcccggcgtaagggagggggggtccgccctttggaaaagttttcctcaaaaaggaagaaaggccctgcccaaagccgtctcgttcccgggggcgtcgctgtggctgttgttggtagaagaacacaaaaatgtcccttggggtataaaaacggcgctgtgaggggggcgcccccggtgggaaaaaacccggggccgcggcgtagaaatatttcagagggggtccacacgttgtttgggtaaactacggcaggcagaagatatctgcacctgtggaccggagggagagnacctgtgaaatgggctgagcagcctctggcagaccggaggggggtatcccccggaggggggaggcatataaccggggcgaacaagaagcgaggtgttttttataagagtgtcgtgggggggagtggataggaagagggtggtgccgccatatgagggcaaaaagatatattgtaaaaaaaacattgatgtgtaccctttaaaaataaagaggaag

SEQ ID NO: 84213 - protein, 189 aa, Zea mays
  misc_feature: Ceres CLONE 1570236
MERQSSIRLGALEKLRSFRGMEKQKSFRGIMSLERRSRDSPGKRGDTPLHLAARAGSVAPRAEDPRGSSTGRWPPRWAARQNQDGKTPLVRRRPKKSPPRKVVAQRSSEVLWALQEGAGASRGQPNKFFERRFPQFGPGVREGGSALWKSFPQKGRKALPKAVSFPGASLWLLLVEEHKNVPWGIKTAL

SEQ ID NO: 84214 - DNA, 866 bp, Zea mays
  misc_feature: Ceres CLONE 1570237
  misc_feature: Encodes the peptide sequence at SEQ ID NO. 84215
  misc_feature (824)..(824): n is a, c, t, g, unknown, or other
  misc_feature (825)..(825): n is a, c, t, g, unknown, or other
  misc_feature (866)..(866): n is a, c, t, g, unknown, or other
ctggagctcaccgcggtggcggccgctctagaactagtggatcccccgggctgcaggaattcgtctcacccctagaaaaacctcgcaggtgaccttgcgtacgtacgtcgtagcggctcgtccagctcgctcgccaccgccatggacccgtacaagcaccgcccgtcgagcgccttcaacgccccgtactggaccaccaactccggcgcccccgtgtggaacaacgacagctccctcaccgtaggcgcacgaggtcccatcctgctggaggactaccacctggtggagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgcccggggtgcagacgcccgtcatcgtccgcttctccacggtgatccacgagcgcgggagccccgagacgctgcgcgacccgcgcgggttcgccgtcaagttctacacccgggagggcaactgggacctggtgggaaacaacttccccgtcttcttcatccgcgacggcatcaagttcccggacatggtgcacgcgctcaagcccaacccgcggacgcacatccaggacaactggcgcatcctcgacttcttctcgcaccacccggagagcctccacatgttctccttcctcttcgacgacgtcggcatccccgccgactaccgccacatggacggatccggggtgcacacgtacacgctcgtcagccgcgccggcaccgtcacctacgtcaagttccactggcgccnncactgcggcgtgcgctcgctgatggacgacgaggccgtccn

SEQ ID NO: 84215 - protein, 241 aa, Zea mays
  misc_feature: Ceres CLONE 1570237
  misc_feature (18)..(241): Pfam Name: Catalase Pfam Description: Catalase
  misc_feature: SWISSPROT Homolog: EC 1.11.1.6 Catalase
  misc_feature (228)..(228): Xaa is any aa, unknown, or other
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRXHCGVRSLMDDEAV

SEQ ID NO: 84216 - DNA, 904 bp, Zea mays
  misc_feature: Ceres CLONE 1570239
  misc_feature: Encodes the peptide sequence at SEQ ID NO. 84217
  misc_feature (904)..(904): n is a, c, t, g, unknown, or other
ctccccgcggtggcggccgctctagaactagtggatcccccgggctgcaggaattcgtctcacccctagaaaaaagcggcagcgtcgacctggtggtggtgcgcttcgggttcggcgaagggcgacatggagagcacgctcaaggggatacgcggcagcgatgcgccgtgcgttctggacctggacgacgcggccaccgtggcgggcggcgtcaaggacacctacggcgaggatcgcgccaccgaggagcagctcgtcacgccctggaccgtctccgtcgccagcggttacaatctgcttagggatccccgttacaacaagggacttgcgttcacagagagggaacgtgagacgcactacctccgtggccttctgccaccagctattgtatcccaggagctccaggagagaaagatcatgaataatattcgacaataccagttgcctttgcagcgctacatggcactcatggatctccaggaagggaacgagaggcttttctacgagttgctcattgaccacgtcgaggagttacttccaatcgtgtacactccaagcgttggcgaggcctgcccaaaatatggatccctatttagtcgccctcaggggtctttatatccgttttgaagggagaaaggaaagatcctttgagggtgttgaaagaactgggccgaaaagggagcacttccgggttaaaaggtggttaccggaaggggggaacgcttatttttgggggccttggaacatatcttgggaaatccccagggggaatgggggaattttcctggttgggggaaaaaatttttcccttttttagaacctggcctctcgggggaaggaaaattccgcttcccctctttgggcgtttgtcttttgggcccaattatatcactatgtggggagn

SEQ ID NO: 84217 - protein, 166 aa, Zea mays
  misc_feature: Ceres CLONE 1570239
  misc_feature: SWISSPROT Homolog: EC 1.1.1.40 Malate dehydrogenase (oxaloacetate-decarboxylating) (NADP(+))
MESTLKGIRGSDAPCVLDLDDAATVAGGVKDTYGEDRATEEQLVTPWTVSVASGYNLLRDPRYNKGLAFTERERETHYLRGLLPPAIVSQELQERKIMNNIRQYQLPLQRYMALMDLQEGNERLFYELLIDHVEELLPIVYTPSVGEACPKYGSLFSRPQGSLYPF

SEQ ID NO: 84218 - DNA, 800 bp, Zea mays
  misc_feature: Ceres CLONE 1570240
  misc_feature: Encodes the peptide sequence at SEQ ID NO. 84219
  misc_feature (738)..(738): n is a, c, t, g, unknown, or other
  misc_feature (755)..(755): n is a, c, t, g, unknown, or other
  misc_feature (761)..(761): n is a, c, t, g, unknown, or other
ctccccgcggtggcggccgctctagaactagtggatcccccgggctgcaggaattcgtctcacccctagaaaaagttcccgggcggcgccgaggcgttcgaggcctgcgccaagtactgctacggcatcaccatcacggtgagcgcgcgcaacctggtcccgctgcggtgcgcggcggcgcacctcggcatgtcggaggccgccgacaggggcaacctcgcggccaagctcgacgcgttcctcgcctcctgcctcctgcgccgctggaaggacgcgctgggcgtgctccactccacgcgccaccacgccccgctctgcgaggacctgggcctcacgtcccgctgcgtcgacgccgtggccgccctcgtcgccagcccggacaccgccccgacgtccacgtcggcgtcgccgtggtgggcgcacgacgtcgccgagctcggggtcgacctcttctggcggatcatggtcgccgtcaaggccaccggcgccgtccacgagaagaccgtcggcgacgcgctcaaggcgtacgcgcgccggtggctgcccaacgtcgccaaggaccagccgctcgaccgcgacgccgcggacgtgaagcaggtcgccacgaggcaccgcctcctgctcgagaagatcgtcagcctgctccccgcggagagggacgccgtctcctgcggcttcctgctcaagctgctcaaggccgcaacatcctgggcgcgtccaaagcgtcccaggcggaanctgtgaggagggtggcntggcanctggaagaagccagcgtctccgacctgctcatcccgtcg

SEQ ID NO: 84219 - protein, 184 aa, Zea mays
  misc_feature: Ceres CLONE 1570240
  misc_feature (73)..(182): Pfam Name: NPH3 Pfam Description: NPH3 family
  misc_feature (183)..(183): Xaa is any aa, unknown, or other
MSEAADRGNLAAKLDAFLASCLLRRWKDALGVLHSTRHHAPLCEDLGLTSRCVDAVAALVASPDTAPTSTSASPWWAHDVAELGVDLFWRIMVAVKATGAVHEKTVGDALKAYARRWLPNVAKDQPLDRDAADVKQVATRHRLLLEKIVSLLPAERDAVSCGFLLKLLKAATSWARPKRPRRXL

SEQ ID NO: 84220 - DNA, 960 bp, Zea mays
  misc_feature: Ceres CLONE 1570241
  misc_feature: Encodes the peptide sequence at SEQ ID NO. 84221
acccgcggtggcggccgctctagaactagtggatcccccgggctgcaggaattcgtctcacccctagaaaaagtctccatgcctgcagtccagagtccagactccaggactaccagtctaccaccacttcgtctcgtcctcacacctcactccaccacctctgccttgcaaagccttccacaccgatccgccgcctcgtccgcgcgctcgcaggcagcagtgtggactacccgccccatactccatcccctactcgaaggacctcgagttaagttgggcgaggagaggtggttcattccagcagggatccttctcgtgagcccagtcgatctgaccgtccttggtatctgggggggttgttctgtactctctctttaatttgtgagtcgtgacaggttcttgaagtgcaattgttaagagttttagttgtagaggaagagaaggatttgctaatatggcgttggcagggacctccaaagtagtgctgggatgtatcgcctttgggattttctgggtgatggccgtcttccccaccgtcccgttcatgcctgttgggcggacggctgggtccctccttggtgctatgctaatggtcctgttccgcgtcatctccccggaggacgcgtacgccgcgattgacctcccgatcatcggcctgctcttcgggacaatggtcgtcagcatcttccttgagagggctgacatgtttaagtacctcgggaacctgctctcgtggaagagcagaggcagcaaggacctgctcttccgagtctgcatcgtggtcggcgttggccagcccgctttccaccaagaaacatggctgggttgtcctccaaaagtcatcctcaaggtggctgggaaaaaaaccggcaccacagccttgcttttgggccttgcactagttcaaaataggtctggctgccaccgaatgggaaaccttagaacttgtgaaaactgtgg

SEQ ID NO: 84221 - protein, 168 aa, Zea mays
  misc_feature: Ceres CLONE 1570241
MALAGTSKVVLGCIAFGIFWVMAVFPTVPFMPVGRTAGSLLGAMLMVLFRVISPEDAYAAIDLPIIGLLFGTMVVSIFLERADMFKYLGNLLSWKSRGSKDLLFRVCIVVGVGQPAFHQETWLGCPPKVILKVAGKKTGTTALLLGLALVQNRSGCHRMGNLRTCENC

SEQ ID NO: 84222 - DNA, 829 bp, Zea mays
  misc_feature: Ceres CLONE 1570243
  misc_feature: Encodes the peptide sequence at SEQ ID NO. 84223
  misc_feature (521)..(521): n is a, c, t, g, unknown, or other
ctccccgcggtggcggccgctctagaactagtggatcccccgggctgcaggaattcgtctcacccctagaaaatgttgctctcaaagcctgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatccctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactcntcagtctcttgaggctgttgttgggaaggacaagcttgtcgtatcaacttcctgctcgctcatgcacaccgctgtggatcttgtgaacgagactaagcttgacagcgagattaagtcttgggcttgctttttgctgccccagagggttgtttgaggttgaatgctcttggctaagggcattgggcttggtcaaaagggatgaaggccttactttcgcaacaaaatgcttggtggttcagggcccttgaggaaaaatcttccccccccctgggggaacccaatggaagaaaagtcccagaagaggttcc

SEQ ID NO: 84223 - protein, 200 aa, Zea mays
  misc_feature: Ceres CLONE 1570243
  misc_feature (1)..(158): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (150)..(150): Xaa is any aa, unknown, or other
MLLSKPAKGVEKGFPLLSLLSSILPVYKEVIAELKAAGASWIQFDEPTLVLDLDSDKLAAFSAAYAELESVLSGLNVLVETYFADVPAESYKTLTSLSSVTAYGFDLVRGTQTLGLVTSAGFPAGKYLFAGVVDGRNIWADDLATSLSTXQSLEAVVGKDKLVVSTSCSLMHTAVDLVNETKLDSEIKSWACFLLPQRVV

SEQ ID NO: 84224 - DNA, 798 bp, Zea mays
  misc_feature: Ceres CLONE 1570249
  misc_feature: Encodes the peptide sequence at SEQ ID NO. 84225
  misc_feature (798)..(798): n is a, c, t, g, unknown, or other
ccccgcggtggcggccgctctagaactagtggatcccccgggctgcaggaattcgtctcacccctagaaaaagttccattgcatcctccccaactcatgttgtgctgtgcctggtggtcaggaaagaggctcctccctttccctctccacctcgccgtgcttctccagtccacctcccccctcgtcgttgcttcttccctccccttccctcgtcgtcgcgctatcccgccggtgcgcgggcgtggggccaagcgccgccgaaaggtagcagcagaggagaagacggacacggacgcaatagcgtccacccccgtaggcaccccccgcccaaagactggtggcaggcctcctacaggcagatgctagttttatttccaaccatatgattgacattgaaaggacaccagccggcttagcctttcggtgactctaaacaccacgacacattcagagccatgtgactccctaccaaagaatatcctggcaaaaggtgcttctcgctgaccatcgaaacacagagcttcatgtctgtccagtccaaggtggttgcgcttggtgcactgatcttccttgtctcgtatggctcttgcactaggattgtcaactttaatgcctcccacatcaccaccgacccctactgggtggctgccagggccacttggtacggtgcgccaaccggcgctggcccctatgacaacggtggtgcttgtgggttcaagaatgtgaacctacctcctttctcggccatgacatcgtgcggcaaccagcccctgttcaagatggcaagggctgtggctn

SEQ ID NO: 84225 - protein, 91 aa, Zea mays
  misc_feature: Ceres CLONE 1570249
MSVQSKVVALGALIFLVSYGSCTRIVNFNASHITTDPYWVAARATWYGAPTGAGPYDNGGACGFKNVNLPPFSAMTSCGNQPLFKMARAVA

SEQ ID NO: 84226 - DNA, 810 bp, Zea mays
  misc_feature: Ceres CLONE 1570251
  misc_feature: Encodes the peptide sequence at SEQ ID NO. 84227
ggagctccccgcggtggcggccgctctagaactagtggatcccccgggctgcaggaattcgtctcacccctagaaaattccgccccaccccggtgaggcgctgatccatcgcctcggacagcggctccagaacctccgcgttgcagaaacacagtagcgagaactattcggtggggccgaagatggtgtcgctgaaggtgccaaagcgcctcgccgcaagcgttctcaagtgtgggaaaggcaaagtgtggcttgaccccaatgaagttagtgagatctccatggcgaactcccgccataacatccggaagttggttaaggatgggtttatcatcaagaagcctcagaaaatccactctagatctcgtgcaagaagggcgcacgaggctaagcagaagggacggcactcaggatatgggaagcgtagaggtaccagggaggctaggctccccaccaaggtactgtggatgaggaggatgcgcgtgctgaggcgcctgctccgcaagtaccgcgaggccaagaagatcgacaagcacatgtaccacgatatgtacatgaaggtcaaaggtaactcgttcaagaacaagagggtgccttatggagagcatccacaagtcccaaggctgaaaaaggcaggggaaagaaccctctcccattcaattcaaggcccaggcccgccaaaaacaaggggaaatccccaaaaggaaaaaattctttgggggggggaaaaaaaggttgggccccccggggcccccaaaaaaaaaaaccccccccccccctttttttttttcccacaagaagtttcctccc

SEQ ID NO: 84227 - protein, 209 aa, Zea mays
  misc_feature: Ceres CLONE 1570251
  misc_feature (2)..(150): Pfam Name: Ribosomal_L19e Pfam Description: Ribosomal protein L19e
MVSLKVPKRLAASVLKCGKGKVWLDPNEVSEISMANSRHNIRKLVKDGFIIKKPQKIHSRSRARRAHEAKQKGRHSGYGKRRGTREARLPTKVLWMRRMRVLRRLLRKYREAKKIDKHMYHDMYMKVKGNSFKNKRVPYGEHPQVPRLKKAGERTLSHSIQGPGPPKTRGNPQKEKILWGGEKKVGPPGAPKKKNPPPPFFFFPQEVSS

SEQ ID NO: 84228 - DNA, 728 bp, Zea mays
  misc_feature: Ceres CLONE 1570253
  misc_feature (380)..(380): n is a, c, t, g, unknown, or other
  misc_feature (390)..(390): n is a, c, t, g, unknown, or other
  misc_feature (391)..(391): n is a, c, t, g, unknown, or other
  misc_feature (414)..(414): n is a, c, t, g, unknown, or other
  misc_feature (415)..(415): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (450)..(450): n is a, c, t, g, unknown, or other
  misc_feature (453)..(453): n is a, c, t, g, unknown, or other
  misc_feature (454)..(454): n is a, c, t, g, unknown, or other
  misc_feature (477)..(477): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (567)..(567): n is a, c, t, g, unknown, or other
  misc_feature (568)..(568): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
ctccccgcggtggcggccgctctagaactagtggatcccccgggctgcaggaattcgtctcacccctagaaaaaagcaaaagctgctcatcaccgatgaccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctaacttcgcgggggggntccggggggnntcgggggggtctcggggggcctnncggggaaaannnaaaaaaaaaaaacnnnccccccnccnnccggccgccgggggggggggggnggggnnnnnnnnncccccccccccccaaaacaaaaataatattggggggtggggggggccccccccaaaaaaaaaaacacccctcttttnnccccccccctttggggggggggggggaaaaaaaattttttttcttttttcccccccccccccnnngnncngggggggggggggggaaaaatttttttttttttttttcctccccccccccccccacaaaaaaaggaggagggtgggtttttctttttttt

SEQ ID NO: 84229 - DNA, 949 bp, Zea mays
  misc_feature: Ceres CLONE 1570255
  misc_feature: Encodes the peptide sequence at SEQ ID NO. 84230
  misc_feature (21)..(21): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (70)..(70): n is a, c, t, g, unknown, or other
  misc_feature (93)..(93): n is a, c, t, g, unknown, or other
atcgatggaatcgaacgggtnttgtgnncnnnnnnccngatgttaaagttaatttttttattttccattngggtttcaaactggaactcaccncggtggcggccgctctagaactagtggatcccccgggctgcaggaattcgtctcacccctagaaaaaaaagtataccaacgaattcctcctcgggctcccacctaatcgtgttcgccgcctgcctctcccaaaccctagcaacccacgatcgaacccaaatccgctcctcccacccgaggaattatgcgaaattccccgagatcctagcccagcactagcagatcgatccatcgcttgcccacctgccggccaccaacccttgtagtctcagtcaatctgtagattgagactacgatgagcctgtcaccgctcgactcctcctccccgccggccgcggctgcggctgctgctacggaggtgcccctcgccccgggcttccgcttccaccccaccgacgaggagctcgtctcctactacctccgccgccgcgtcctcggccgccgcctccgcgtcgacgccatcgccgagatcgacctctaccgcctcgagccctgggacctcccctccctctcccgcatccgcagccgcgacgcccaggtggtacttcttcgccccgtctcgaccgcaaaggtcgcccggcgctgggcgcccggggggcccgggggcgggcccccgggcaacagggaccaaaccgcgcctacgcccggaaggggggtacccgggaaaaaaccacggggcaagggaaccgccaaagggtgcaaccacccgccggcaaaagcccccttcggggaatgaaaaaaaaaaacccttcggtctttcccacacccccggggaaggggcccccctaaaagggccgaaaaagggaacccaactgggggttccattgccaacgaaagttaccggggctttcccttt

SEQ ID NO: 84230 - protein, 146 aa, Zea mays
  misc_feature: Ceres CLONE 1570255
  misc_feature (24)..(139): Pfam Name: NAM Pfam Description: No apical meristem (NAM) protein
MSLSPLDSSSPPAAAAAAATEVPLAPGFRFHPTDEELVSYYLRRRVLGRRLRVDAIAEIDLYRLEPWDLPSLSRIRSRDAQVVLLRPVSTAKVARRWAPGGPGGGPPGNRDQTAPTPGRGVPGKKPRGKGTAKGCNHPPAKAPFGE

SEQ ID NO: 84231 - DNA, 988 bp, Zea mays
  misc_feature: Ceres CLONE 1570258
  misc_feature: Encodes the peptide sequence at SEQ ID NO. 84232
  misc_feature (395)..(395): n is a, c, t, g, unknown, or other
  misc_feature (793)..(793): n is a, c, t, g, unknown, or other
acccgcggtggcggccgctctagaactagtggatcccccgggctgcaggaattcgtctcacccctagaaaaaccttctccatctccgctttccctcctcgcctaggcctagcctagccgcccccgcacgccacgccacattcgcatctctggatccccctcccttcgccctctcccattacccgccgccgccgcctcgcgcccgcgacccacccggcctcccacttcgatcccgccccgttcgctgcccccgccccgattccgattcgtcactgtatcgcgcgcgcgcgggtggtaagacagcgatggctcgtggcgggggcctctcgccccgccgcgggtgatctctcctctagcggggagccttcccgcgtgcccaagcggaggatcccgccncagctggtgcctcacctatccctctccttcgcatctccgccgtgctctctcgcgcaccccctcgaccctaggtttgctccttccctcccttcctcgccacccgattcgatctcgctccctccggcctccggctaggctgctccgtctctcctccgccatgttctcgcacggcgctgattccgcccacgacgccggggccgtcggcgtcagcagcggcggggctaccgtccccacccgcttcgtctggccctatggtgggaagagggtcttcgtcccaggctccttcaccggggggtcggaacatttgccgatgtctcctatcgaaaggtgccccactgtatttcagggctatttgccagtctgtcctcctgggattcaccgagtacaaattcctttgngggacgggggaaaggggggcctgaatgaagcgtcaaacctacccatatttgtggggaagttgggccaaaatttaaaacacactttacgttgggcgaagggtaaatatataccaaatataaaacaccctttaatataaagcccacaagacacaccactgtgggaagaccagagagaaaaacagggggagtgggtgg

SEQ ID NO: 84232 - protein, 125 aa, Zea mays
  misc_feature: Ceres CLONE 1570258
  misc_feature (81)..(81): Xaa is any aa, unknown, or other
MFSHGADSAHDAGAVGVSSGGATVPTRFVWPYGGKRVFVPGSFTGGSEHLPMSPIERCPTVFQGYLPVCPPGIHRVQIPLXDGGKGGLNEASNLPIFVGKLGQNLKHTLRWAKGKYIPNIKHPLI

SEQ ID NO: 84233 - DNA, 1060 bp, Zea mays
  misc_feature: Ceres CLONE 1570260
  misc_feature: Encodes the peptide sequence at SEQ ID NO. 84234
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (199)..(199): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttnnnnnnnncccaagctggggctccccncggtggcggccgctctagactagtggatcccccgggctgcaggaattcgtctcacccctagaaaaaagaccggttggcgcttcatcactcgttccctttcgaaagcccgcgcacgcacgtcggtcgtcccgagcaggacctcgatcggccgagatggcgacgccgaacgggcttgcgcggatcgagacgtccgggaagaagaagcacgacaacggcgtgtggtacgacgacagctcggcgccggtgcgcgcgcagaccatcgacgagctgcactcgctgcagcggaagcggtcggagtccagcacgcgcaagcggtcggcgcccaccacgcccatcaaggggcgggtgcccactcgcccttttgaccgtcgccgatctcccaaggaagggagcggccatcactccagccggaggcagggccattccaatggccttccgttggccgttccactggaccccccggtaaaacccggggcccaaaaaattggggtcaaagggggcgaacccccggttccccccaaaaggggccccaaagggccccccccccccggaaaaggtgggggcccccaatttctaaaccccccccaaaggggggggcccccccccccccctttgaagggggggcccaacccccgagggggagcccccgggggcaaatttccccttttttgggggggaaaaggatcccccccccccggggtgtcccccccccccggggggggccccacaaaaaaacctcccttgtttcccgggggggggaaactctttttccccaaagggggggggccccttctatatttcccaaaaaaaagggggggggggggtttttttcccccgggggcccccccccggggggggggt

SEQ ID NO: 84234 - protein, 236 aa, Zea mays
  misc_feature: Ceres CLONE 1570260
  misc_feature: SWISSPROT Homolog: EC 4.1.1.49 Phosphoenolpyruvate carboxykinase (ATP)
MATPNGLARIETSGKKKHDNGVWYDDSSAPVRAQTIDELHSLQRKRSESSTRKRSAPTTPIKGRVPTRPFDRRRSPKEGSGHHSSRRQGHSNGLPLAVPLDPPVKPGAQKIGVKGGEPPVPPKRGPKGPPPPGKGGGPQFLNPPQRGGPPPPPLKGGPNPRGGAPGGKFPLFWGGKGSPPPGVSPPPGGGPTKKPPLFPGGGKLFFPKGGGPLLYFPKKRGGGGFFPPGAPPRGGG

SEQ ID NO: 84235 - DNA, 802 bp, Zea mays
  misc_feature: Ceres CLONE 1570261
  misc_feature: Encodes the peptide sequence at SEQ ID NO. 84236
ctccccgcggtggcggccgctctagaactagtggatcccccgggctgcaggaattcgtctcacccctagaaaaaatgactcatgacaccgtagcttccttcctcgccgtcgccaaatgctgcaggccgcctccatgaggtgctagggttccctggccgacgccacgaccgtcgcacccggccgcctccgtccctgcgggccttcgccaccgccctcgccaaacgtcccgagccagggttcctcacagcttctcccaagcgccctccagtctcaccaacccttctgcggttctgcccttggcgccgcgcccatgagcctcaccgaggcgccgtccccgtccccgtcgtcgtcgagcgggagcgatgacttcgcggccttcctcgcctccgagctcgagctcacctccggtgctgactccgccttccctggtgacccctcctccgttttccccgccaccgacgacgagggcgaggatccggaggagctagaggttgaagccatagaacaaaacggtaccaaaaggcgtagagtagaggaacaatgccaagatcaaggaacatcagttaggcctgacaaaatccccactggcgcatctaaaattgttcaggttgaggcatgtccacatcctggacattttggtggactttgcattatctgtggcaagcccacagacgaagaagaatgttcaggagttgcttttgggtacatccacaagggcttgaggctaggtacctcagaaattgacagctacctggtgctgatttgaagaatctgttgcgtgaaaagaaattagtactcattt

SEQ ID NO: 84236 - protein, 151 aa, Zea mays
  misc_feature: Ceres CLONE 1570261
MSLTEAPSPSPSSSSGSDDFAAFLASELELTSGADSAFPGDPSSVFPATDDEGEDPEELEVEAIEQNGTKRRRVEEQCQDQGTSVRPDKIPTGASKIVQVEACPHPGHFGGLCIICGKPTDEEECSGVAFGYIHKGLRLGTSEIDSYLVLI

SEQ ID NO: 84237 - DNA, 922 bp, Zea mays
  misc_feature: Ceres CLONE 1570262
  misc_feature: Encodes the peptide sequence at SEQ ID NO. 84238
ccccgcggtggcggccgctctagaactagtggatcccccgggctgcaggaattcgtctcacccctagaaaaaaggccgtagaccagagcagtagaccgccatggcgaaccgcagcaagcagctcgttaccaccgcactgccgctcgcggcggcagcagcagcctcgctcgccgtcgtgctcctgctctgctccacgggctcatcggaagccgacggatacctcgggcgcgtgggtgcgccgtggggccgtaccctcacggtcctcccattcagccccgcggacctgctgcccctcctgccgcggggcgtcgccatggccgcgctccgggcgctccgcggcgtctcggacatcttcccggtgttcgtcggcgccgcgtcggccggcgggtcgggctcggtgcccggcagcggggggacggtgagatggaagggggcctgcttctacgagaacgaggcgtggctggtgttccacaacgagagcgggtccaagtacggcggcggcacactccatatcaagacatccaaagcacacagctgggacttgcatagaatctgtaggtatttgccacacccatacagaggtaacatgggattaccacctttcggggggggaagaggcccccccttgaatttcaaagaaatggggaaaacggaggccttgaatattgagttatgtgaaaaccgtaaatggggggggtcccatccttccctcaatggccatcctgggaaacaaaatggggaaccacttttctaggccacttcttggaggaagaggctatgcccctctcgggttaacacaaaataaccatgcctatgggggtgtggaaaaaaggccggacaatgtcttgggcttttatctctcaccagagaagagaaatatagtggggtgaggcgcccaccctctattgggggaggatacacg

SEQ ID NO: 84238 - protein, 217 aa, Zea mays
  misc_feature: Ceres CLONE 1570262
MANRSKQLVTTALPLAAAAAASLAVVLLLCSTGSSEADGYLGRVGAPWGRTLTVLPFSPADLLPLLPRGVAMAALRALRGVSDIFPVFVGAASAGGSGSVPGSGGTVRWKGACFYENEAWLVFHNESGSKYGGGTLHIKTSKAHSWDLHRICRYLPHPYRGNMGLPPFGGGRGPPLNFKEMGKTEALNIELCENRKWGGSHPSLNGHPGKQNGEPLF

SEQ ID NO: 84239 - DNA, 878 bp, Zea mays
  misc_feature: Ceres CLONE 1570263
  misc_feature: Encodes the peptide sequence at SEQ ID NO. 84240
gcggtggcggccgctctagaactagtggatcccccgggctgcaggaattcgtctcacccctagaaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtcctctcggcgccgagatgtccgacagcaacgacttcgtcgagctgctatgggagaacggccaggcggtggtgcacgggaggaggaagcagcatccccaggccgccttcccgcccttcacctgcggcgcggccagcagcagtagagctcaagaaaaccagccgggtactaccgacccggtctcgctgttcaagacgggaggcctcttcgccgacttctcgtccggcctagacgccgcccgtggcaacggtgaccttgacgacaccgtgccctggatccactgccccatcgtcgaggaagacagcgccgcacccgcacctgccctcgcggagggctacagcccagatttcttctcggagctccatgcagcggcgttagcagcggcggcggcagagacgaacctcagccctctgccaccaccggtccagcacaacagaagcaccccggttgccaccaccagcagaggaccagaaccctcgaaggaagccccgcgcataccagtaccaggtccaggcagcaagcccgaagcacaatctgagttcgcggccaccaggaaacctcggcccggagagcggtggagaagggattgatgaaactctcccctctctctaagcctgcagccttggtccgggcaagcctacagaggcacccgccacgcagaaaggcactg

SEQ ID NO: 84240 - protein, 190 aa, Zea mays
  misc_feature: Ceres CLONE 1570263
MSDSNDFVELLWENGQAVVHGRRKQHPQAAFPPFTCGAASSSRAQENQPGTTDPVSLFKTGGLFADFSSGLDAARGNGDLDDTVPWIHCPIVEEDSAAPAPALAEGYSPDFFSELHAAALAAAAAETNLSPLPPPVQHNRSTPVATTSRGPEPSKEAPRIPVPGPGSKPEAQSEFAATRKPRPGERWRRD

SEQ ID NO: 84241 - DNA, 824 bp, Zea mays
  misc_feature: Ceres CLONE 1570266
  misc_feature: Encodes the peptide sequence at SEQ ID NO. 84242
  misc_feature (578)..(578): n is a, c, t, g, unknown, or other
  misc_feature (691)..(691): n is a, c, t, g, unknown, or other
tccccgcggtggcggccgctctagaactagtggatcccccgggctgcaggaattcgtctcacccctagaaaaactccctccaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatcgatgggtggggaggcgccggagccgcggcggctgacccgggcgctgagcatcggcggcggtgacggcggctgggttcccgaggagatgctgcaactcgtgatggggttcgtcgaggacccgcgcgaccgggaggccgcgtcgctggtgtgtcaccggtggcaccgcgtcgacgcgctctcgcggaagcacgtgacggtgcccttctgctacgccgtttccccggcacgcctgctcgcgcggttcccgcggctcgagtcgctcgcggtgaaggggaagccccgcgcggccatgtacgggctcatnaccgacgactggggcgcctacgcccgcccgtggatcaccgagctcgccgcggcgctcgagtgcctcaaggcgctccacctccgacgcatggtcgtcacagacgacgacctcgncgagctcgtccgtgccagggggcacatgctgcaggagctgaagctcgataagtgcacccggcttctccactatgggactccgctccggtgcccgctcctggagatcactgagggactttatttttttggagaa

SEQ ID NO: 84242 - protein, 183 aa, Zea mays
  misc_feature: Ceres CLONE 1570266
  misc_feature (101)..(101): Xaa is any aa, unknown, or other
  misc_feature (139)..(139): Xaa is any aa, unknown, or other
MGGEAPEPRRLTRALSIGGGDGGWVPEEMLQLVMGFVEDPRDREAASLVCHRWHRVDALSRKHVTVPFCYAVSPARLLARFPRLESLAVKGKPRAAMYGLXTDDWGAYARPWITELAAALECLKALHLRRMVVTDDDLXELVRARGHMLQELKLDKCTRLLHYGTPLRCPLLEITEGLYFFGE

SEQ ID NO: 84243 - DNA, 811 bp, Zea mays
  misc_feature: Ceres CLONE 1570267
  misc_feature: Encodes the peptide sequence at SEQ ID NO. 84244
gagctccccgcggtggcggccgctctagaactagtggatcccccgggctgcaggaattcgtctcacccctagaaaaaacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatggtacgtggtgctgtgccatcaccaacatctactgcacctgcagccaaccaagaacctaccactgctgctcctgccagttccccggcaacaggattgggtggtttgttgcaaagtctgggtactacaggcgctgctgctaacagtgaggggttgggttttggtttggatctgcccccccctggattagaccaaatgcaacaacagctagctgaaaatccgaacttgatgagggaaatgatgaatatgccactcatgcagaatttgatgaacaatcctgaactcatacgcagtataataatgaacaatcctcaaatgcgcgagctcattgatcgcaatcccggatcttgctcatgtcctcaatgatccaagcattattgcc

SEQ ID NO: 84244 - protein, 205 aa, Zea mays
  misc_feature: Ceres CLONE 1570267
  misc_feature (22)..(90): Pfam Name: ubiquitin Pfam Description: Ubiquitin family
MGGGDADAGGEPADAQATLHIRCTNASKFTVRADLGATVGAFKAIVADSCDVPAPQQRLIYKGRILKDEQTLASYGVETDHTIHMVRGAVPSPTSTAPAANQEPTTAAPASSPATGLGGLLQSLGTTGAAANSEGLGFGLDLPPPGLDQMQQQLAENPNLMREMMNMPLMQNLMNNPELIRSIIMNNPQMRELIDRNPGSCSCPQ

SEQ ID NO: 84245 - DNA, 785 bp, Zea mays
  misc_feature: Ceres CLONE 1570269
  misc_feature: Encodes the peptide sequence at SEQ ID NO. 84246
  misc_feature (532)..(532): n is a, c, t, g, unknown, or other
  misc_feature (593)..(593): n is a, c, t, g, unknown, or other
  misc_feature (597)..(597): n is a, c, t, g, unknown, or other
  misc_feature (599)..(599): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (713)..(713): n is a, c, t, g, unknown, or other
  misc_feature (785)..(785): n is a, c, t, g, unknown, or other
ctccccgcggtggcggccgctctagaactagtggatcccccgggctgcaggaattcgtctcacccctagaaaaaacctcgctcgccggagcaggttgcaaggagccagccactcctgcgagtttctggcgatggtggccgttgcggcgggaaggcgggccggcggcgtttgtgggcgccggcgctccgggtgcggcgcggggcacgcacagcaaaaaactattactgatctccctctccccccccttcgctgaggccgtggcgccgccgtctgcggaggcctcccgtgccggctccggcggctgttgcgtagagctcctcgagtgcctcctcggggctctgagcgtcaacgcggccccgccgcccgcgcagcacaggcgggccgtgcactcgatccgccgacgccgcccccgtgggcggggggtccgcggacgaccgccacgccgacgctccctcgggccgcatcgcgggcaacggcgcatccgcatcagcagccgcgtcgctctacacatgcaggggcaagaaggtgtcantcagacgccctgtggttctgggaagattttgggtcaaagatgataccatttttttttgtgngagntnttttttatggctggaacannnnnnnnnnncaccgccttggccgnnnnnnnncccggaggccatctctccggtagtatgcaattttggggaggtgatgcaagaatttctctaccnatgccagatgggaccttcctaaagatgcaccggaccccgggttgagataccggtgcctcccctgaaatgaan

SEQ ID NO: 84246 - protein, 190 aa, Zea mays
  misc_feature: Ceres CLONE 1570269
  misc_feature (177)..(177): Xaa is any aa, unknown, or other
PRGGGRSRTSGSPGLQEFVSPLEKTSLAGAGCKEPATPASFWRWWPLRREGGPAAFVGAGAPGAARGTHSKKLLLISLSPPFAEAVAPPSAEASRAGSGGCCVELLECLLGALSVNAAPPPAQHRRAVHSIRRRRPRGRGVRGRPPRRRSLGPHRGQRRIRISSRVALHMQGQEGVXQTPCGSGKILGQR

SEQ ID NO: 84247 - DNA, 791 bp, Zea mays
  misc_feature: Ceres CLONE 1570271
  misc_feature: Encodes the peptide sequence at SEQ ID NO. 84248
ctccccgcggtggcggccgctctagaactagtggatcccccgggctgcaggaattcgtctcacccctagaaaaaagtaatcagtgctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggtgctgtacctgacgctccggccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctgctggagcggtcggggctgggggaggagacgtgcctgccgtacgcgcagcactacatcccgccgtcgcgcgacctggagtcctcccgcgccgaggccgagctcgtcatcttctcggccatcgacgacctgctggccaagacgggcgtgtccccgcaagacatcgacatcctggtggtgaactgcaggctgttcgcgccgacgccgtcgttcgcggacatggtcatgcgccggtacgggctccgc

SEQ ID NO: 84248 - protein, 202 aa, Zea mays
  misc_feature: Ceres CLONE 1570271
  misc_feature (71)..(202): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MGSSAQLRRLKPLYQLVVNNILTIVAVPLAAAVLLKAAELGPEEILARARALRPAHMLLAGFLPAVATVLYLTLRPRAVYLVDYACFRTNPNCRVPFATFLEHSRVWPGFDERSVRFMTRLLERSGLGEETCLPYAQHYIPPSRDLESSRAEAELVIFSAIDDLLAKTGVSPQDIDILVVNCRLFAPTPSFADMVMRRYGLR

SEQ ID NO: 84249 - DNA, 927 bp, Zea mays
  misc_feature: Ceres CLONE 1570272
  misc_feature: Encodes the peptide sequence at SEQ ID NO. 84250
  misc_feature (27)..(27): n is a, c, t, g, unknown, or other
  misc_feature (70)..(70): n is a, c, t, g, unknown, or other
  misc_feature (77)..(77): n is a, c, t, g, unknown, or other
  misc_feature (95)..(95): n is a, c, t, g, unknown, or other
gaaaaaaaaaaaggggggggggggggncgggcgggtcccttcttttctttttgttacgtggcccgcggtnggtattnaaaagctggagctcaccncggtggcggccgctctagaatagtggatcccccgggctgcaggaattcgtctcacccctagaaaaatgcccattccctctcctcccactcgcttttcctccaaagcgagcgagctaggcgttacgccggagctggtttgggcggtggtgaaggagagaggaaagggaggagatgaaggcggtggagcgagcgaaactggtgaggagcctccggcacgagtcgcggcggctgcgtctactcgtcctcgttatcggtttcttcctcgttactctcaccttcgtcgtcgtctccaagcccgacgcgcttctcttcaacctgaacggcaggctgtcggtggaccaggcgccgcgctcgctcttgatccgccagcgggttgacgccgacgaggggagatccgccgaaactctcgcctcagcctccggagatccaaaggtggtcgaagacgatacctacggcgaggaagccagcgccaaagccagagccaacgccaatgcccgagggaccactgccgaggaggaacggatgctcgctagtgagcccgagcagagaaaaagggcacaggaagccactacattctgagattttagctggcggaagacgaccgggggaaggaaaagccagcaaagagggaacaccagagagcacccagcagccacaaagttgacccctccccaacctggttttcgaaatttaatacccattccacaatgccccactgaaccggccacccgaacaaatgggccaaaaccaggggaagaattaccagaaatttttaattccctccactcccccggaaatggttggaacccccgggaggtaaaatggggtttcc

SEQ ID NO: 84250 - protein, 135 aa, Zea mays
  misc_feature: Ceres CLONE 1570272
MKAVERAKLVRSLRHESRRLRLLVLVIGFFLVTLTFVVVSKPDALLFNLNGRLSVDQAPRSLLIRQRVDADEGRSAETLASASGDPKVVEDDTYGEEASAKARANANARGTTAEEERMLASEPEQRKRAQEATTF

SEQ ID NO: 84251 - DNA, 965 bp, Zea mays
  misc_feature: Ceres CLONE 1570273
  misc_feature: Translation starting site: 673
ggagctccccgcggtggcggccgctctagaactagtggatcccccgggctgcaggaattcgtctcacccctagaaaaagagccgccgacgccaggcctccacgccgcatccgcgtgaccgcgcctccgagctccatagccccgggccgccggcgccgggccttggtgatctcgtccgcctcccagcatcgaccggacctgcccgcagcccgcgcccaggccatcgcgccgccgacccgagcttcgccaggcgcctaggccgctcgccccgtcgcccgcccgcccggccggcaggacgactgggcgagctcctccccgcggaggcggggacggcggacccgcccccaggccgagtcgccgagctccgccccgcgcgggcgcccccctgcccagtcccagccgccccgctcctgtcccggccaggctcagctccgccctgttccggcctctgtacagcatccaggcacgacgacgcgagacgagatggcaggcctcgaacggcctcgccgccgccctccgccagaccccgtcgccgtgctccgcggccaccgcgccgcagtcaacgacgcctgctttcacccctccctccctctcctcttctccggtgcggccgaccgggagctcagggcctgggacaccgcgagcccacgcaccggttcctctgtgggggctcatgctgggtccgccggaagggtattctgtcccctgctggggctgggactgggcaaatagatatcagcccgggcaaggaagggaattggtaaaggttgggggaatgaaaaaaccggggttttaagggagccccctcttaaatcaaaacaggtccattccttttccgcaaaagtcccctggggaagtcttcttttaccttgtccactgaattgggtctgccaccctacttagggactggagacccaaatatggccactgtaaagtgcaaacgccggggtgtaacccctaaaaggc

SEQ ID NO: 84252 - DNA, 860 bp, Zea mays
  misc_feature: Ceres CLONE 1570274
  misc_feature: SWISSPROT Homolog: EC 2.7.11.1 Non-specific serine/threonine protein kinase
ctggagctccccgcggtggcggccgctctagaactagtggatcccccgggctgcaggaattcgtctcacccctagaaaaattattggagcatgcaggaagccagtggtttggtgcattgtgacggagtatgccaagggtggatcagttagacagtttctagcgaagaggcagaataggtcggttccactaaaactggcggttaagcaagcattggatgttgcaagggggatggcctatgttcatggtcttgggttcatccatagggatcttaagtcagataacctcttgatatctggtgataaatctatcaagatagctgactttggagtagctcgcattgaagtaaaaactgaggggatgacacctgaaacgggaacctaccgttggatggcaccacacatgattcagcataggccatatgaccagaaaagttgatgtctacagctttggcattgtgctgtgggagctcataactggcatgctcccttttgctacatgacagcagtgcaagctgctttttgctgtggtgaaacaagggtgtccgcccagctataccccaagactgcctgcccacccctcggtgagatcatgaccaggtgccttgggatccaaattcctgatgtcccgtccgcccgttcacctgaagattgtaaggatgctggaccatgcttaaggtgggaaatcccggaacactgttccccaaagggcccgattttccggggttgcaatctcccaacccgatggacccccccgcctgtattccaaaccaaaaaagaagtcccaaaaaaaaaccccctggccaggccttaaatttgagggaaaattttattccttggggggcccaaaaatttccgctcac

SEQ ID NO: 84253 - DNA, 775 bp, Zea mays
  misc_feature: Ceres CLONE 1570282
  misc_feature (261)..(261): n is a, c, t, g, unknown, or other
gcggtggcggccgctctagaactagtaggatcccccgaggctgcagagaattctgtctcacccctagaaaaagcaccccccattcgaacgccggagctcgacgaggacgaccgacgacgcacgcagagatccggcgtactgcaaattttgaaaactgaactgtaagatggcatcagcagagctttcccgtgaggaaaatgtgtacatgggcgagctcgcgagcagcggaagtacaagaatggtgagtcatggaaagtgcanactgtgactcgagactcctgggagacgaacctctgtcgtgctacagaacgcatggaccccccgcccttgcccatcattcccccttaaaaaagaggagggccaagcatggggcccataacccccccagggattttggggcaattttaaactgaccccccccaaatttgggggggggcccccccaacgccttttgaaaacacctcttgggggggggtttttcccaaggggccccccccaaaaaaaaaaaagaggggtttttttctttctttcttaaaaaaaaaaaaaagggggggggtttttttatataaaaaaaacaaccacccctcctctttgtttcaaaaaagaggggggggaaaaaaaaaaaaaaaaagccccctttaaataaaaaaagagggggggggtagaataaagaggggggcgccccccaaaaaaaaattttttggtggggggggaggagttgtccccccccaccccccccccccccccggggggggtggtggtggggggggggggg

SEQ ID NO: 84254 - DNA, 840 bp, Zea mays
  misc_feature: Ceres CLONE 1570284
  misc_feature: Translation starting site: 238
ctccccgcggtggcggccgctctagaactagtggatcccccgggctgcaggaattcgtctcacccctagaaaaaaagacgagctggagatagttttacacattggaacgcgaacgctctcggatccatccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgggggaggcggtggcgggggaggcggtagtggaggaggaagaggaggcagcggcggcggaggataccacaactactacggccggaacacacatccacagcatcaacaccactaccagcagcagcagcagcactcgcataggaactcctcgcaccagcagcagtggctgcggcgagaccagggccccgccgttgcggggccagtgtctggaaacgctgtgcctaagacggcgcctcagcttgacgctgttgactggagttcccaagattggaagggtccactaatataccagctccagacacacgctaccggacagaggatgtcacctgcacaaaaggcaatgagtttgaaggatattttcttgaaacgggagttgccttttgggaatttatgaagaagggaattgaaaagggcctccccccattcaagaaaaaaaaactttccctattggcgtttgacctggaaattgataattcctttgcaaggggggaaaaaaaaggggcccctggaagtagacaccgctgcgccctttttggattttcccggggaaatttggaat

SEQ ID NO: 84255 - DNA, 867 bp, Zea mays
  misc_feature: Ceres CLONE 1570285
  misc_feature: Encodes the peptide sequence at SEQ ID NO. 84256
  misc_feature (867)..(867): n is a, c, t, g, unknown, or other
tggagctccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcccccgcgtcggcgacgaagaacgacggagcggcgccggccagcgaccccgacaagctcttgagcctgctgccgtcgcccgccatgaagctccccatcatcgggcacctgcacctgatgggggacatcccctacgtgtccctcgccgcgctcgccaccaggaacggcccggacccgatgctgctcccctcggcccccggcccaccggggtggttcggttcccgggcgtcgccaagggccggttccgcacccaaaaccacgtttttttctcccggccggcgcttcctggggggcccgaaaaaataaatgagggggggcccccgaatcggggttttgggcccaaaggggaacaacttctccaaaggcgcaataaaatggggtccccgggaacacgttaaaaacctagaaaaggagggggggcaccaacgggtcccccacagaaaaagaagaaaagaggatcccggggctcccn

SEQ ID NO: 84256 - protein, 145 aa, Zea mays
  misc_feature: Ceres CLONE 1570285
MAAQLHHALYELLHEAAAAQRALLLAIPFSLLLLPLLLRYLAASAPASATKNDGAAPASDPDKLLSLLPSPAMKLPIIGHLHLMGDIPYVSLAALATRNGPDPMLLPSAPGPPGWFGSRASPRAGSAPKTTFFSPGRRFLGGPKK

SEQ ID NO: 84257 - DNA, 763 bp, Zea mays
  misc_feature: Ceres CLONE 1570286
  misc_feature (384)..(384): n is a, c, t, g, unknown, or other
  misc_feature (763)..(763): n is a, c, t, g, unknown, or other
tcaccgcggtggcggccgctctagaactagtggatcccccgggctgcaggaattcgtctcacccctagaaaaaagaccagagagaggccaatgcgagggagtagctcgcggcggaccagagaccagagagcgagagcgagcaaagctcacaaggcgaagcggaattgattgcgaccaccaccaccacgtcttctccacctccgtccgatccgtcgtcaccaagccaccatcattggcgccaccgcgccgcccgcccagctgcgcattcttaactgtttctctcttggcttatcggcgaagtgttgcggttgcgggggtactggagtgcggagagcagcgcggcggtacgtgtgcgttgctgcgctgtgctgccacagtgagctnggggagagcgagggggaggaagcaccacccaccacaccacctccattaaaggcgctcacgcgccgcccctccgcctccacgagaaagcgaggcgggagcgagtgagcaggggcgtacgtccgtcgtcaaggccatctctctcctcctcacttcctcccctcacggggacagccacgtacaaaggcagctcgccaacgcccagcacctccctcgccgtgcgcctttaaagacagcgcgcgacaagcttaaagctgcagaggaggtgacacagaggccagagccgtcgcgcgcgtgcgaaaccgaaagcagagaggagcggcaatggcggtgaccgcgcggctcggcgcggtcgtggcgtgcgtcgtcttggcggccgtgn

SEQ ID NO: 84258 - DNA, 967 bp, Zea mays
  misc_feature: Ceres CLONE 1570287
  misc_feature: Encodes the peptide sequence at SEQ ID NO. 84259
ctccccgcggtggcggccgctctagaactagtggatcccccgggctgcaggaattcgtctcacccctagaaaaagtcccatcgttcctctctctctgccccgcctacgcctcgccccagacgcatcaaaccgctctcctctccctccctgcccccctcgcaaccctgaagaagcccccacacgcaaggccgcaaacgcgccgcgcaccgcaagggcccagggagcgacacgaggcggcctcattgcagcatggctgctatggccgccgctggcggcgtcgggctccacctcattggcgctgccacggccacgctcatcgtggcggtccttgttgcggccgtgctggggcgccgccgccgggaccgggcccgggcccaggcgcctccggtggaagggaaacccgcgccggaggcaggctgcgcggtcggtgacggcgcgggtcccgacgtcaggacggacgtcatcatcgtcggcgccggagtagctggatctgcgctggcgtacacgctcggaaaagatggacgccaggtgcatgtcatccagagggatctgacaagacctggacagaattgtggggcgagccgttgcaaacctggaggttaccttgaaatttaattgagtaaggccctcccaagattgtggtggaagaaattggatgccccacggtggggctgggttaccccatggttccaagatggaagaaaaccaaaagcttggcttatccccttgaaaaagtcccattcctgaaggtggctggagggagctttccacaggggaaggttttaacagaggatgggtcaaaaaacccggtctttggccaatggtctattgaaacaaggaaatggttactccctctccaaaaaaaaggtgttgttaagagggcaaataaaaaacaaagtgggggaaaaaaaaaaacctatgcccccctaaaaattgagggtgagggcggtttttaatattaaggggg

SEQ ID NO: 84259 - protein, 121 aa, Zea mays
  misc_feature: Ceres CLONE 1570287
  misc_feature: SWISSPROT Homolog: EC 1.14.99.7 Squalene monooxygenase
MAAMAAAGGVGLHLIGAATATLIVAVLVAAVLGRRRRDRARAQAPPVEGKPAPEAGCAVGDGAGPDVRTDVIIVGAGVAGSALAYTLGKDGRQVHVIQRDLTRPGQNCGASRCKPGGYLEI

SEQ ID NO: 84260 - DNA, 1122 bp, Zea mays
  misc_feature: Ceres CLONE 1570288
  misc_feature: Encodes the peptide sequence at SEQ ID NO. 84261
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (1001)..(1001): n is a, c, t, g, unknown, or other
agtggggaggggnngnngccaggggggaggacatggataagagaaaggcgcgctgggttcgcatacctattaaaaaaaatatttggagctccccgcggtggcggccgctctagactagtggatcccccgggctgcaggaattcgtctcacccctagaaaaagcaggcttcccagcccctagattctctctcgcgcttccgctttcccttctcctggtcctggccatggcccacgaacgggagccgctcctgcagcaacgacagaccggcgtcggcaatgcctgcggtgccaagggctcgtcctcggcgccggcgccgtcggctgccgcgctgccgtcgctggctaggaccgtgctcaagttcctgatgtgggcggtgttcctcacctgggccgcggggatcttcctctacccgaccaagcccgtgcaggccgtgttcaggaagtgggtcgggctcaccagggactccatgttcggcatcgtcgggggtatttttcctgaaccttcagccgcgccaaattctgatcattgcgccttcctcgcattatgtgtaacatcctcccttctttcccgaagtgaagcattgtgggtggaagaaaaagggaaagcttgccgcctcaacctgaaggtttccagggcgttcctgggaaccttttccccctgggttttctttgtttaaaaaccggggcccccccttttttggagaaaaattttgtttccctccctggcccaggtcttttgggaaaagttttccccaacctccgcggaggaaaaatttgtggggtccctcttgggggggttataaaataaaaagaggtttttatctattggggtttggggcacccaaaacctctcccagaattgggaccccccatttgttttttattgtccccccttcgtgggaaaacggcctttgattgtagaaaccactttgtgtgttcctctcggaaaataattcttgttgaacaaattcccgccaaattcaaaaagtaaaaacttgggnaaaaaacttaaaaaattgcggaaatacccgggggaattgtttcaatttgtgggcccccccccggttttttatgggggcggggttgtggggtttttattttttgtacagagagcccacttcc

SEQ ID NO: 84261 - protein, 150 aa, Zea mays
  misc_feature: Ceres CLONE 1570288
MAHEREPLLQQRQTGVGNACGAKGSSSAPAPSAAALPSLARTVLKFLMWAVFLTWAAGIFLYPTKPVQAVFRKWVGLTRDSMFGIVGGIFPEPSAAPNSDHCAFLALCVTSSLLSRSEALWVEEKGKACRLNLKVSRAFLGTFSPWVFFV

SEQ ID NO: 84262 - DNA, 916 bp, Zea mays
  misc_feature: Ceres CLONE 1570289
  misc_feature: Encodes the peptide sequence at SEQ ID NO. 84263
  misc_feature (611)..(611): n is a, c, t, g, unknown, or other
ctcaccgcggtggcggccgctctagaactagtggatcccccgggctgcaggaattcgtctcacccctagaaaaacgcctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcaccctgctggtgtgcggcgccgagctgggcagcctcagccgcgactagctgtggcgcaaggtgtggggggaggccacctacgagctcgccaccgtgctcgccttcctcgccgtcgtcgccttcaccatctccgtctacatcatgtccaggcccaggcccgtgtacttcatcgactttgcatgctacaagccggccgacgagctcaaggtgtcccaggcngagttcatcgacctggcgcgcaaagtccggaagttcgacgagaacaccctggccttcaagtcgcggtctgctgggcaaatccggccttcggggaacgagtcctacatgcccccgcctgcccggttccagcccaaaagcccaattgtccccacccttaaaagaagggcccccgcccaaagccctcccccgggccattttttccggggcgcctgggacaaaagctttttccaaacaagtggccgcggatccgcgcctcaaagggaacaatggggcccgtgtcttggttgtgttccacactgcccccc

SEQ ID NO: 84263 - protein, 84 aa, Zea mays
  misc_feature: Ceres CLONE 1570289
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVTLLVCGAELGSLSRD

SEQ ID NO: 84264 - DNA, 883 bp, Zea mays
  misc_feature: Ceres CLONE 1570291
  misc_feature: Encodes the peptide sequence at SEQ ID NO. 84265
agctccccgcggtggcggccgctctagaactagtggatcccccgggctgcaggaattcgtctcacccctagaaaaaaggagtacacacttctccttagaattggagctgtacgagccacccagcaactttcttcatcatcttcttcagctctctctctgtccgtcgacacaccaagctagccatgcaggaggagtaagggtacaaccgtagaagagagagagagagagagagagctaacaccacccaccactgtccctagctagcttatttacaggcgttcgtgatcaccaacagcttctcgtcagaaagagtgcaacgggccggccgggcagaagaggtagctgggagctagagagaaaaaaagggtgcaccgagcaacccaggccagggaggaagggaggagtgagccatcagtcgaccgtttccggcgaactcacaggcagatggcaggcggcggattcgtggaggacatgatgagggagcagagcctcctggaggcgacgtgcggcgacctcttcgaccacatcgacgacctcctcgacttccccaacgaggactccgccgccgccgtgctcctcctggacgcgccggcgcccgggagcccgctgtcggcgcgcatcatcgacgtcggccgccccggcaatgcgctcgtccccgcctgctgccccccgcgcaacaaggacgcttcccgctagggcctttctttcgccggccgcgggggaaacgattgtgttccaaaacccaaggaaggtccgtccggggccaaaacaattgggctctgggggcgaacaaactttgtaacattgggaacatgggccccatccttgggagagtggcttgtgtcgggggggttcttttcagaagaagacccctctccatttg

SEQ ID NO: 84265 - protein, 83 aa, Zea mays
  misc_feature: Ceres CLONE 1570291
MAGGGFVEDMMREQSLLEATCGDLFDHIDDLLDFPNEDSAAAVLLLDAPAPGSPLSARIIDVGRPGNALVPACCPPRNKDASR

SEQ ID NO: 84266 - DNA, 816 bp, Zea mays
  misc_feature: Ceres CLONE 1570294
  misc_feature: Encodes the peptide sequence at SEQ ID NO. 84267
ccccgcggtggcggccgctctagaactagtggatcccccgggctgcaggaattcgtctcaccccctagaaaaaatagaaatcgaccgagcgaatccctcgcatcgcattcgcagcctttgctgcatcacaccaccgcgaaaccccagcagccgcatcgatggcgcctaaggcggagaagaagccggctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagacctacaagatctacatcttcaaggtgctgaagcaggtccacccggacatcggcatctcttccaaggccatgtccatcatgaactccttcatcaacgacatcttcgagaagctcgccggcgaggctgccaagcttgcgcgctacaacaagaagcccaccatcacctctcgggagattcaaacctctgtccgccttgtccttcccggcgagctcgccaagcacgcggtctccgagggcaccaaggccgtcactaagttcacatcatcttagatttgaggtagtagctattgggtggcgttggtagctgtgtctcaatttgtctgctactaatagtggtaggagtatccatgtgtagttggggtggcggtaagaattgtgttaaactggcaaaaaaaacggcctccttcgcccggatccccgaatccgctcgttcgctcgccgccagttgtccagcacctcggaatcgtctcatacctct

SEQ ID NO: 84267 - protein, 149 aa, Zea mays
  misc_feature: Ceres CLONE 1570294
  misc_feature (56)..(126): Pfam Name: Histone Pfam Description: Core histone H2A/H2B/H3/H4
MAPKAEKKPAAKKPAEEEPAAAKAPAGKKPKAEKRLPAAKSSGKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 84268 - DNA, 788 bp, Zea mays
  misc_feature: Ceres CLONE 1570295
  misc_feature: Encodes the peptide sequence at SEQ ID NO. 84269
ctccccgcggtggcggccgctctagaactagtggatcccccgggctgcaggaattcgtctcacccctagaaaaaaccagaagctcactcactgctcgttgccggctgcccccgcggccccggccagtccatcccctcgctcgctccccaactccagcaggcagatcagatacatccatccattcgcggaccggaaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctcccccgaaggcggcggcgacgccccgcgggggttccgggagaaacccaggaacgccgagaaagcgaccaagtacgcccgcagccccaagagcaacgcttccccgcgtgatccacccagcctcgctaagttcgctggggggaacctcatcaggaaaggctgctgccccctcttgcagcctttgctcctgggctgccgccccctgtccggggtctggcctctttcaagtcgaaagtaaccgtgggttccagcctagtgggaataagggggcctcaaca

SEQ ID NO: 84269 - protein, 177 aa, Zea mays
  misc_feature: Ceres CLONE 1570295
MSAVAVSSSLNPDAPLFIPAALLQVEDFSPQWWDLITTTAWFRDHWSRERAHLDEMAEQIDAAGLLPDDEDLFYDDQLEQGPVAAALKTDSVLKALNMTSPEGGGDAPRGFREKPRNAEKATKYARSPKSNASPRDPPSLAKFAGGNLIRKGCCPLLQPLLLGCRPLSGVWPLSSRK

SEQ ID NO: 84270 - DNA, 860 bp, Zea mays
  misc_feature: Ceres CLONE 1570297
  misc_feature: Encodes the peptide sequence at SEQ ID NO. 84271
  misc_feature (602)..(602): n is a, c, t, g, unknown, or other
  misc_feature (649)..(649): n is a, c, t, g, unknown, or other
  misc_feature (844)..(844): n is a, c, t, g, unknown, or other
ctccccgcggtggcggccgctctagaactagtggatcccccgggctgcaggaattcgtctcacccctagaaaaaacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgcctccctggagggcctccgcccacgcgccgtcatcctctccggcgggccccactcagtccacgcccccggggcgcccgccttccccgaaggattcctgggcttcgcggctgccgcgggcgcgcacgtgctcggcgtctgctatgggatgcagctcctcgtgcagtcccttggaggcgccgttgtgtccggggagcgccaggagtacgggaaaatggacgttgaggtgacggcgggctccctcgcgctctacgggcaggcggagaaccggaagcgccagaacgtgtggatgagcatggncgaaaggtggtttagctgccggaaagtttcgaagtggttgctcccancgtgcaggtagccgtcccggccatttgagaaccgggagaaacgcttttttgggctccaatacaccccgaaggtacccatccgcccaaggatggaacactgcgccgctttcccttgaagtttggggggacaaactaattgaaaaagcaaaagtgctccatgaaaatcaagaccttcaaagcccgttggccctgaanagatgttattgtgcat

SEQ ID NO: 84271 - protein, 172 aa, Zea mays
  misc_feature: Ceres CLONE 1570297
  misc_feature (22)..(160): Pfam Name: GATase Pfam Description: Glutamine amidotransferase class-I
  misc_feature: SWISSPROT Homolog: EC 6.3.5.2 GMP synthase (glutamine-hydrolyzing)
  misc_feature (154)..(154): Xaa is any aa, unknown, or other
  misc_feature (170)..(170): Xaa is any aa, unknown, or other
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGGAVVSGERQEYGKMDVEVTAGSLALYGQAENRKRQNVWMSMXERWFSCRKVSKWLLPXCR

SEQ ID NO: 84272 - DNA, 814 bp, Zea mays
  misc_feature: Ceres CLONE 1570299
  misc_feature: Translation starting site: 194
  misc_feature: SWISSPROT Homolog: EC 1.4.1.2 Glutamate dehydrogenase
ctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaagggatgctggggtgattgctggcctcaatgtgctgcgtatcatcaatgagccaaccgctgctgctattgcctatggtcttgacagaaggcaaccagcggtcggtgagaagaatgtcctcatctttgaccctgg

SEQ ID NO: 84273 - DNA, 805 bp, Zea mays
  misc_feature: Ceres CLONE 1570300
  misc_feature: Encodes the peptide sequence at SEQ ID NO. 84274
  misc_feature (529)..(529): n is a, c, t, g, unknown, or other
  misc_feature (633)..(633): n is a, c, t, g, unknown, or other
  misc_feature (635)..(635): n is a, c, t, g, unknown, or other
  misc_feature (706)..(706): n is a, c, t, g, unknown, or other
gcggtggcggccgctctagaactagtggatcccccgggctgcaggaattcgtctcacccctagaaaaactggtttgtttactgacaccttctgtttcctctcaccttccactcctggatctccagctccaggcaaggcccgaactggggaattccgatcccaagagcccccaccaagcgctcccgccgatcccaaggactcctgcctccgatgcggcaactcatcccatccggcttctaaagccgcggcccctgaggtcaattccggtggccggcggcatggattccggcgccaacagcatcggcgagtcggtgggcgagtcgccgtcgctggcgctggcgccggagccgcagacacggccggccgagccggtcaccaagggtcgcgggctccgccggtggcgccgtatcccgcgcgagcagcaccacgaggggtctccggggagcccccggggccgataccggcgttggagctagcgcgggtgaggacttggcggcgcagctccacaagcgtcgttacggtcctgccngcgacgagcccaaggaaagcaggacccggctgcagcagaggaagtcgagagctcggtcgcgtccgtggagtccagcttcgtgccgctggaaggcgtcccaccgncngcgccgactaggttgggacccgaatctaggccaccctgattgccaccgctggttttcctcggtggccgccnggcggcgcccgattcggaacaaaagcgaccgacgggaccaggcaagttggtcaacggccgccagggcgccgcggcccacgaattctccgtccgtcgggt

SEQ ID NO: 84274 - protein, 65 aa, Zea mays
  misc_feature: Ceres CLONE 1570300
MDSGANSIGESVGESPSLALAPEPQTRPAEPVTKGRGLRRWRRIPREQHHEGSPGSPRGRYRRWS

SEQ ID NO: 84275 - DNA, 967 bp, Zea mays
  misc_feature: Ceres CLONE 1570301
  misc_feature: Translation starting site: 197
  misc_feature: SWISSPROT Homolog: EC 3.1.1.11 Pectinesterase
acccgcggtggcggccgctctagaactagtggatcccccgggctgcaggaattcgtctcacccctagaaaaaataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggaccgcctggccatcaacgactgcctggagctgctgtccaccacgatggacgagctccgcgccagcaccgccgacctggcgtccccgccggcaaggggtcggcgtcggctggcgtgtctcaagtcgccaggcgcgcgacgatggagcacgtgatgacggtgctttcggcgggcatcaacaaccagtacacctgcctcgacggctttccgtaccagagcggcgggcgccggcagggctacattgaagccaactttcaacacggggccccgcatggggagcaatcgcctggccatggcccaatatgttgcccggggcccggggccttaacatggccaacgccggcccgggaatccgttcacggggtacgggcaaaatggtggaaggggttccccccgggggggtgcttccccggggacgggcgcctggtttaaaggccccgggtttcggctgttgcccccacaacct

SEQ ID NO: 84276 - DNA, 981 bp, Zea mays
  misc_feature: Ceres CLONE 1570302
  misc_feature: Encodes the peptide sequence at SEQ ID NO. 84277
  misc_feature (951)..(951): n is a, c, t, g, unknown, or other
  misc_feature (967)..(967): n is a, c, t, g, unknown, or other
  misc_feature (968)..(968): n is a, c, t, g, unknown, or other
ggagctccccgcggtggcggccgctctagaactagtggatcccccgggctgcaggaattcgtctcacccctagaaaaaatggatgtgcgtggcaacgtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcatcggcggtggcggtggccggggcggcaaaaatgatggccccctttggctgccccggggggacgtgatgctcaacggcctgtctactttcccccgccgggtttcccctgttacccgggggttcccgtccgcgccctaattcgggtttgccccggggcccaaaaggggaaaccaaaaaaccgcgcatttcacaggaacccggggcgggctagccttccattcccctctggggggtttgccaaaggtacccccttggggatttcaaacgccgagaaaccaagggttaacgtaaccaactcgggcgtctccggggtttatctctctgagaccccggggattcacttggggggaagaatgccacagaggtggcctccctcttctataaaatgaaatagggtgtctccccgcgcataataagaacctccccggtgaacttctcatcatggcgttgaggtggaggtcttttcatatatcctggctctaccgcgcgtaatttcccaacacaccacagttatctaacctcgccgccgtcccccggggcaagccacactgatatgagaaattttatctttctcccaggggttacaccactctctccgcggggtgacacaacgtggtgaaatgatcataccttcccctcaacaaagtccctcccctcagtcggaaattgctcaccgtccccccatnttcacctcgcgcgcgnntgttcttctaccg

SEQ ID NO: 84277 - protein, 83 aa, Zea mays
  misc_feature: Ceres CLONE 1570302
MASACATSIPLVSAPSACPSKKTTVARFRRRTATCRASIGGGGGRGGKNDGPLWLPRGDVMLNGLSTFPRRVSPVTRGFPSAP

SEQ ID NO: 84278 - DNA, 1333 bp, Zea mays
  misc_feature: Ceres CLONE 1570306
  misc_feature (922)..(922): n is a, c, t, g, unknown, or other
  misc_feature (1173)..(1173): n is a, c, t, g, unknown, or other
ctttctcttccctttttctcctccccttatattttttatggttaatttcttttttttttttattattttctggtgctcaccgcggtggcggccgctctagaactagtggatcccccgggctgcaggaattcgtctcacccctagaaaaagcaggggattctgaacttggggtttgttccggggactgattctggcttctgcagacgggatgtcagcccccctcgaccgacttgctatgccattgtttttaatggtttgtccccaacgatgaatggaaatagagcacattttatgccgacaactcttaattgatataagtaaaactaagatccggaatccttcccggaataaagccattttattgggggggaaaaaatttttgttctttccccgtagtatgtgaaatttaaaataagaccccaaaggggggggattcccttccatgggattatacgggtacatttataaaaacctccacttttttgtgaacaccccccccttctactcgtctttaattttttaaaaggattttgccggcctttttttccccactggctgattttttctccccttgaatgtttgaagggttgccttttaaatgacttagcgaaatttcttgatcccggtatataaaggtcttatcataatgctgctgtgcaacaatacactcttctttattgtggtatgggaaaagaaactttctttggggcttttttttacaaatcctaagcgattttttttgctcgcttctccccgtatatttttcgcactatatgctttaatcgtagtcgcgtcccctccaccttttattttatcctcccgctcgtttttccgcctctctaccttatatggttagagtatccttgtttctccctctcatattttttattatacaggtggtatagactatgttactgtcagncactaccattctactctgacgtattcactgatcgctaagtatatgtttattaatttgtgtcatcctcgccaacatgagcgtattttatgtataatagtgttttctctctttatttaaagggtgtttttcgcctcctcatctctgaactatcctctgcccgctcgtgccgctcttttattcttattgtcgtctcttatatcttattttttgttgcaactgttccccgtctgtgtactaccttttttctatcngactacctttaaagaatgattcgcgtggcggctcacatctattacgctatcctctatatgaatgctacgctctcttcgtacgtcgctaaacaagttgtgtcccttcatttatttaatacgataatatgccatgcgctaaggttagtatgcgcctcgcccc

SEQ ID NO: 84279 - DNA, 852 bp, Zea mays
  misc_feature: Ceres CLONE 1570307
  misc_feature: Encodes the peptide sequence at SEQ ID NO. 84280
ctccccgcggtggcggccgctctagaactagtggatcccccgggctgcaggaattcgtctcacccctagaaaaaggcacgagcacccacagcagttggcgcgcaccaaaaccctaccctccctctgctctcagccgccaacgccatgggctccaccgccgctgcctccgtgctcccggtgtccgccggctccggcgagaacctcgtcctcatcctcgactacggctcgcagtacacgcacctcatcacccgccgcgtgcgccagctcggcgtcctctccctctgcgtgtccggcacggcgccgctcgcctccctggagggcctccgcccacgcgccgtcatcctctccggcgggccccactcagtccacgcccccggggcgcccgccttccccgagggattcctgggcttcgcggctgccgcgggcgcgcacgtgctcggcgtctgctatgggatgcagctcctcgtgcagtccctcggaagcgccgttttgttgggggagcgccaggggtacgggaaaatgaacttttaggtgacggggggctccttccgcgctcttacggcaggcggaaaccgggaaacccccaaacgggggggataaccatggccaccaaagtggtttaggttcccgaaagggttccaagggggttgctcccaagccgtgagggagacccccccgggcctttgaaaaccggggagaaatccctttttgggggccccaaaccccccccgcggggtttccctttccccccccaaggagggaaaaaccccccccccctctttttcttttagattttgggggggacaaaaccctttgtggaaaaaacccaagtttttcccacaataaaaaaaa

SEQ ID NO: 84280 - protein, 128 aa, Zea mays
  misc_feature: Ceres CLONE 1570307
  misc_feature: SWISSPROT Homolog: EC 6.3.5.2 GMP synthase (glutamine-hydrolyzing)
MGSTAAASVLPVSAGSGENLVLILDYGSQYTHLITRRVRQLGVLSLCVSGTAPLASLEGLRPRAVILSGGPHSVHAPGAPAFPEGFLGFAAAAGAHVLGVCYGMQLLVQSLGSAVLLGERQGYGKMNF

SEQ ID NO: 84281 - DNA, 801 bp, Zea mays
  misc_feature: Ceres CLONE 1570308
  misc_feature: Encodes the peptide sequence at SEQ ID NO. 84282
tggcggccgctctagaactagtggatcccccgggctgcaggaattcgtctcacccctagaaaaaaaccgcgcactccaaacgcgcacgcgctgttcgttcctcggccgctctgtccacccccgtccttctccgccctcaacagatctccgccggccgtgcggttccttaattcgccttctccgggactgtcggatctccgcggcggctggggatgggcaactgctgcgtgacgccgaaagcagccgacgacgccggcggcggcaagaagcccaaggagccgaagcagaagaagggtaagaagccgaaccccttctcgatcgattacaaccgctcggggcaggcgagcgcgccaaagctggtggtgctgcgggatcccacggggcgggacatcgcggcgcggtacgagctcggcgcggagctcgggcgcggcgagttcggggttacctacctctgcacagaccgtgcctcaggggaggcgctggcctgcaagtctatctccaagaagaagctccgcaccgccgtcgacctcgaggacgtgcgccggggaggtggagatcatgcgccacctccccaagcaccccaacgtcgtcacgctcaggggacacgtacgaggacgacaatgcccgtgcacctcgtcatggagctctgcgagggcggtgagctcttcgaccgcatcggggcgcggggacactacactgagcgtgcttgccgcctgggtcttacgcacaatccttgagggcgtgcaaatttggcttaagcctggaagggatggcccaggggatcttcacccccgaaaattt

SEQ ID NO: 84282 - protein, 174 aa, Zea mays
  misc_feature: Ceres CLONE 1570308
  misc_feature (32)..(111): SWISSPROT Homolog: EC 2.7.11.1 Non-specific serine/threonine protein kinase
  misc_feature (139)..(164): SWISSPROT Homolog: EC 2.7.11.17 Calcium/calmodulin-dependent protein kinase
  misc_feature (135)..(163): SWISSPROT Homolog: EC 2.7.11.18 [Myosin light-chain] kinase
MGNCCVTPKAADDAGGGKKPKEPKQKKGKKPNPFSIDYNRSGQASAPKLVVLRDPTGRDIAARYELGAELGRGEFGVTYLCTDRASGEALACKSISKKKLRTAVDLEDVRRGGGDHAPPPQAPQRRHAQGTRTRTTMPVHLVMELCEGGELFDRIGARGHYTERACRLGLTHNP

SEQ ID NO: 84283 - DNA, 807 bp, Zea mays
  misc_feature: Ceres CLONE 1570309
  misc_feature: Encodes the peptide sequence at SEQ ID NO. 84284
ctccccgcggtggcggccgctctagaactagtggatcccccgggctgcaggaattcgtctcacccctagaaaaagcgactgtagtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccatactgagtacattatatctcttgatgcagaagacttatcacaagggagcaatgcatacatggggaaactgaggtgaggttcaacatgattccagagttctcctgaaccttcttggattacctctgcttatgaattggttgctgaaagtgacgtgttctggtgtgattaggtggcacatacatttcatgtagttgacaaaatatttttgaaagcataacttaagatacacaaaatgaatgaagttgcaggatccttccaactg

SEQ ID NO: 84284 - protein, 173 aa, Zea mays
  misc_feature: Ceres CLONE 1570309
MPRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLR

SEQ ID NO: 84285 - DNA, 797 bp, Zea mays
  misc_feature: Ceres CLONE 1570312
  misc_feature: Encodes the peptide sequence at SEQ ID NO. 84286
  misc_feature (550)..(550): n is a, c, t, g, unknown, or other
ccccgcggtggcggccgctctagaactagtggatcccccgggctgcaggaattcgtctcacccctagaaaaaacaaccctcctcaccgcgcactcgtgttcgtgtcatcccgaccgcaggcacgagtccatggccaccgccagcctcgcgctgtcgctgcgcctcgcgccgtcctcgacgcccgctgatcctccgcctcctgggggacgcctgtcgtctcctgccgcgccacctactccacggtcctccagctccaccccgtcgcatggatggaggaggagtactggttgccagaccgcatcagtccgacggccactacctgctgacgatcaagaggtgcatcttctccgatatgctcaagcccgtgctagggcaccgctgtctggtgtaggaggaagaacgaaatgcacccagttttctctggcagtctgtccagcacgggccccacggcacgtatgtgaggaggcacaccacgtccggggcacaccctactatggaggtcctgggcaaggctaaccatgtgaccgccatggaccatgagatgaagtcnaggatggagcacattctgcctgatcccatgatgatccgcaggacaatcatggagcactgcaacccgcagattggtgacagcatccctgatgcattctgtggatgatgggttggattcttgttatatgatatactgcgttatgttgaaaaaaataagcttcctgttcgatatggcaccacatgaccataggaagctctcctgaaattcatttagggcctctatagtgacgtctttgcgtttggagata

SEQ ID NO: 84286 - protein, 53 aa, Zea mays
  misc_feature: Ceres CLONE 1570312
  misc_feature: SWISSPROT Homolog: EC 4.1.3.27 Anthranilate synthase
MEVLGKANHVTAMDHEMKSRMEHILPDPMMIRRTIMEHCNPQIGDSIPDAFCG

SEQ ID NO: 84287 - DNA, 930 bp, Zea mays
  misc_feature: Ceres CLONE 1570318
  misc_feature: Translation starting site: 478
acccgcggtggcggccgctctagaactagtggatcccccgggctgcaggaattcgtctcacccctagaaaaatcatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcggctccatccgtcattgtcatcggcggtggcatctcgggcgttgcagctgcccgtgccctctccattcttcatttaagtgactgtttttgaatcaagagatcgtattggcgggcgcattcataccgataactcgtttggatgcccaattgatttggggagctcatgggctaccggcgtgtgcaatgagaatcaactgccccattgataacctatcttggcctgaggtataccggcacagcgatgataactcatgtctggttgatcctgattaagaaagcttgccctcctttgaaaggatgggaacaggtccccaaggaaaagtcgattaagtgggagaacattccagagaatcttgaaaaaacggtaaattgccaataagcaggacca

SEQ ID NO: 84288 - DNA, 982 bp, Zea mays
  misc_feature: Ceres CLONE 1570320
  misc_feature (318)..(318): n is a, c, t, g, unknown, or other
  misc_feature (325)..(325): n is a, c, t, g, unknown, or other
  misc_feature (461)..(461): n is a, c, t, g, unknown, or other
tccccgcggtggcggccgctctagaactagtggatcccccgggctgcaggaattcgtctcacccctagaaaaaacccctccctccattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacnctgcccngcgcgagtgcggggaggaccgtgctggtcacgggggggggcgggctacatcggtagccacgccgtgctgcagctcctcctcgcggggcttccgcgccgtcgtcatcgacaactttcacaactccttccgagcgggncgttcgccgcgtcgcccgccctcccggggggaccattccggcaaccttttttttccacaagatttgatctccctgaaaaaggaacccctggaaaagggtttttgcttcctccaaaattttgaaccggtcctttccctttcccgggaataaaaaccgtggggggtaaaaccctcccaaaaaccctttttttttttttttaaaccccccccttttgtgcccccaaaaaattttttttaaaaaattttttttttttctccggggtaaaaaaaaattggggggtcttctctcccacccggcccgttttgggggggccccccaaaaaacctccccgcggcaaaaaaaatattttctctttttttcacaaaaatctttttggggaaaaaaacccctcttgtttagaaaaaaattttgggggggaactcccccccccacccccgggggggagaattatttttttttggggggcctccccccccagggggggccccccctcccaggaatatttttgcgggcgacccccc

SEQ ID NO: 84289 - DNA, 836 bp, Zea mays
  misc_feature: Ceres CLONE 1570321
  misc_feature: Encodes the peptide sequence at SEQ ID NO. 84290
  misc_feature (811)..(811): n is a, c, t, g, unknown, or other
ctccccgcggtggcggccgctctagaactagtggatcccccgggctgcaggaattcgtctcacccctagaaaaactcccctcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaagttgctatctatagagaggagccctcccattgaagaagttatcaaatcaggtgtagttccaagatttgtgcagttgctcacaagagaggatttgccccagctgcagttcgaagcagcatgggctctcacaaatattgcttctggcacttcagaaaatacaaaggttgttattgatcatggggctgttcctatatttgtgaagcttcttgggtctggtagtgatgatgttcgtgagcaggctgtgtgggctttgggcaatgttgctggcgattctccgaagtgtcgtgaccttgttcttgcccatggtgcattgatgcctctgctagcccagntgaatgagcatgcgaagctctccat

SEQ ID NO: 84290 - protein, 213 aa, Zea mays
  misc_feature: Ceres CLONE 1570321
  misc_feature (4)..(92): Pfam Name: IBB Pfam Description: Importin beta binding domain
  misc_feature (101)..(142): Pfam Name: Arm Pfam Description: Armadillo/beta-catenin-like repeat
  misc_feature (144)..(184): Pfam Name: Arm Pfam Description: Armadillo/beta-catenin-like repeat
  misc_feature (206)..(206): Xaa is any aa, unknown, or other
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKSGVVPRFVQLLTREDLPQLQFEAAWALTNIASGTSENTKVVIDHGAVPIFVKLLGSGSDDVREQAVWALGNVAGDSPKCRDLVLAHGALMPLLAQXNEHAKLS

SEQ ID NO: 84291 - DNA, 821 bp, Zea mays
  misc_feature: Ceres CLONE 1570322
  misc_feature: Translation starting site: 334
ggagctccccgcggtggcggccgctctagaactagtggatcccccgggctgcaggaattcgtctcacccctagaaaaatccggccttcccccacctcccacccgcgatctccgcgaccgcaagcagctcggcaggcaggcctccaccgctccaccacctccactcggtctacgtgctccgtcaccaaacccacccgggccaacgccgaagcaaccccccctccgtcctccccagatccggcgccgcctccgccctcacttacactagcacgcacggcggacacgtcgcctcccccgcgcgatctgatgcaggcgcacgcggtggccagcggcgatgcggtggaagcttaactcctccgtctacaagcgcgtgccgtccagggaaaccgccatggaacccgacgtcgagacgccaagttcgtgccgcatgtttcccccggttcctcttaccaccggttaatttatgggtggtgaacgagcccttggaggtcatctccgctgaccttggcttcgccggcaacactcttgctgaagggctcgtggtgagtatctgtttgggaggagcttttgttgggtgcctcttcagcggctccatcgcagatggtattgggcgacgccgtgcgttccagctcagtgcgctgcctatgattattggtgctgccataagcagaaagttgttaatttttttgtcaaacatttatgtactactccatggaacctgggggtataccacctggtggatgggcttgcttggggaaattggtctcctgggactgggtgttagatcaggctgtttccaattggtgaaaaagtttcaataag

SEQ ID NO: 84292 - DNA, 865 bp, Zea mays
  misc_feature: Ceres CLONE 1570323
  misc_feature: Encodes the peptide sequence at SEQ ID NO. 84293
aagctggagctccccgcggtggcggccgctctagaactagtggatcccccgggctgcttgaattcgtctcacccctagaaaaaggacacttccagcaggtgctgacagcaatcggtaacttctgcatgctgctcgattggggtcggcatcctcgtcgagatcatcgtcatgttcccaatccagcaccgcaagtaccgcagcggaatcgagaacctgttggtcctcttgatcggtggtatcccaatcgccatgcccactgtgctttcagttaccatggccattggttcgcacaagctgtcacagcagggtgccatcactaagaggatgactgccattgaggagagggctggtatggacgtgctttgcagtgacaaaaacggcacactcaccctcaacaagcttagcccccataagaacctcgtcgaggtggtctggcaaaggcgtccaacaaagaccatgttgttgctgttggctggcaaagggctttcaaggaactgaaaaacccaggacccccttccaatgcctgcccctgggttggggaatggcttgcctgaatccccaaaggagggcccaggggctggggttttcaggggaaaaatcccctttttttgtggcccgttgtaaaccccgggtttgaataaaaaagaatgggtctctaaagattatttttgttcgccctaaggggaaactgggcccccgcggtgcaaaaaaggggggggtcccctgaaaaaaaatttttttaaacgggtggcccccccccccggggggagattcttggggggggaaggggggcccctcttttttcaaacaaaaatgtgcgcccaaagggggggcttcccctttgcggggggggtgggtttcaaaa

SEQ ID NO: 84293 - protein, 109 aa, Zea mays
  misc_feature: Ceres CLONE 1570323
  misc_feature: SWISSPROT Homolog: EC 3.6.3.6 Proton-exporting ATPase
MFPIQHRKYRSGIENLLVLLIGGIPIAMPTVLSVTMAIGSHKLSQQGAITKRMTAIEERAGMDVLCSDKNGTLTLNKLSPHKNLVEVVWQRRPTKTMLLLLAGKGLSRN

SEQ ID NO: 84294 - DNA, 950 bp, Zea mays
  misc_feature: Ceres CLONE 1570325
  misc_feature: Encodes the peptide sequence at SEQ ID NO. 84295
  misc_feature (409)..(409): n is a, c, t, g, unknown, or other
  misc_feature (410)..(410): n is a, c, t, g, unknown, or other
  misc_feature (440)..(440): n is a, c, t, g, unknown, or other
  misc_feature (818)..(818): n is a, c, t, g, unknown, or other
aaagctggagctccccgcggtggcggccgctcttcaactagtggatcccccgggctgcaggaattcgtctcacccctagaaaaagccccacaaaccctcgtctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatcttcctcagggagctcatctccaactcctccgatgccttggacaagatcaggtttgagagtttgacggacaagaccaagctggatgcacagccagagctgttcatccacattgtccccgacaaggccaacaacacccnnacaatcatcgacagcggcattggtatgacnaagtcagaccttgtgaacaaacttgggtaccattgcgccgtcagggcccaagggatttcctggaagcacttggctgctggggctgaatgtgtcaatgaatggcccgtttgggggccggtttccaccctgcccaaccttgttgccaaaaagggtttttcttggccccctagccacaattgttgtgttggccctccctgtgggggaagtccaggcgggggggggccccttcaagggggccccggaaaacccttgggggggaacatttggggggggggaaaaaaaaaaccccctccccccggaggagaacactgtggggagccctcggggggagccccctccctcgggtgtttttaaaaaaaaaccccccggttttttgantcccccaatttctttttgggggggagagacacccctaaaaggagtttttttttaaataaaaaggggaggaaaagagggtgggggggggtttgttgctttctttttttctcctcgcagctaagttggcgtccg

SEQ ID NO: 84295 - protein, 204 aa, Zea mays
  misc_feature: Ceres CLONE 1570325
  misc_feature (77)..(77): Xaa is any aa, unknown, or other
MASETETFAFQAEINQLLSLIINTFYSNKEIFLRELISNSSDALDKIRFESLTDKTKLDAQPELFIHIVPDKANNTXTIIDSGIGMTKSDLVNKLGYHCAVRAQGISWKHLAAGAECVNEWPVWGPVSTLPNLVAKKGFSWPPSHNCCVGPPCGGSPGGGGPLQGGPGKPLGGNIWGGGKKKPPPPGGEHCGEPSGGAPSLGCF

SEQ ID NO: 84296 - DNA, 709 bp, Zea mays
  misc_feature: Ceres CLONE 1570329
  misc_feature: Translation starting site: 149
  misc_feature: SWISSPROT Homolog: EC 4.2.3.1 Threonine synthase
ccgcggtggcggccgctctagaactagtggatcccccgggctgcaggaattcgtctcacccctagaaaaaaccagcgtccgcccctatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccgcctgcatccgcgcgccagccgcgcgcgctgcgcctcttccgacacgacggccacgaagcaccgccgcccagcggaggagaacatccgcgaggaggcggcgcggctccgaggcccggcccagggtttctctgcgtggtacgagcccttcccgccggcgcccggcggcgacccgaacgagcgctactcgctggacgaggtcgtctaccgctccagctcggggggcctcctcgacgtgcgccacgacatgggaggcgctggcccgctacccggggtcctactggcgtgacctcttcgactcccgcgtcgggcggaccgcctggccctacggctcgggcgtctgggtcatgaaagagttcgtgctccccgaaatcgactccgacaacatcgtctcccttctcgaagggaaaactcaaacctcttttggggcgggaacgccctcgggcgccaaagaaca

SEQ ID NO: 84297 - DNA, 867 bp, Zea mays
  misc_feature: Ceres CLONE 1570331
  misc_feature: Encodes the peptide sequence at SEQ ID NO. 84298
  misc_feature (842)..(842): n is a, c, t, g, unknown, or other
ggagctccccgcggtggcggccgctctagaactagtggatcccccgggctgcaggaattcgtctcacccctagaaaaagttttcgtctccaccgccgctctcctttccagtctccaccacctgtcgtctccccgtaccgcccgcaacccccctcccctgcgagatccggggcgcgatgtggcgcatctgcgtctcgcggggcctctccagggccaaggcctccgcctccaggctcctctccacggcgtcgtcgtcctacacggtggtcgaccacacctacgacgcagtggtggtgggggccggcggcacagggctccgggcggcgatcggcctctccgagcacggcttcaacaccgcgtgcatcaccaagctcttccccgcgcgctcgcacaccgtcgcggctcatggaggcataaatgctgcacttggaaacatgagtgaagatgactggaggtggcatatgtatgacactgttaagggaagcgattggctgggagaccaggattctattcaggatatgtgcagagaggcaccaaaagctgttatagagcttgagaactatggactaccattttctagagctgtagagggaaagatataccaacgtgcctttggagggcagagcttagatattggcataggtggacaagcctaccgttgtgcctgcgctgctgacggagcacgacatgctatgctgcacacactatatggctcagcaatcgagctacatcactcaatttttttgtggaatactgtgctttgggaccttctcatggacaactgaagtactgtgtcacggaatcattgccatgaaacatggtacgatggaactctttcacggntttccgtagcttcttgatacaattt

SEQ ID NO: 84298 - protein, 202 aa, Zea mays
  misc_feature: Ceres CLONE 1570331
  misc_feature: SWISSPROT Homolog: EC 1.3.5.1 Succinate dehydrogenase (ubiquinone)
MWRICVSRGLSRAKASASRLLSTASSSYTVVDHTYDAVVVGAGGTGLRAAIGLSEHGFNTACITKLFPARSHTVAAHGGINAALGNMSEDDWRWHMYDTVKGSDWLGDQDSIQDMCREAPKAVIELENYGLPFSRAVEGKIYQRAFGGQSLDIGIGGQAYRCACAADGARHAMLHTLYGSAIELHHSIFLWNTVLWDLLMDN

SEQ ID NO: 84299 - DNA, 823 bp, Zea mays
  misc_feature: Ceres CLONE 1570332
  misc_feature: Encodes the peptide sequence at SEQ ID NO. 84300
  misc_feature (664)..(664): n is a, c, t, g, unknown, or other
  misc_feature (791)..(791): n is a, c, t, g, unknown, or other
gcggtggcggccgctctagaactagtggatcccccgggctgcaggaattcgtctcacccctagaaaaaaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaacacgtcttctcctcccgcccgcgcntcctggtgtccgacatcatcatgtacggcgccaccgactcgtgcttcgcgccctacggcgaccacttccgcaaggcgcggaagctgggtcacgtgcacctgctcaacgcaagcaagtgcggtcgcancgcccccggagaaaaaaaaaaaagggtccccc

SEQ ID NO: 84300 - protein, 195 aa, Zea mays
  misc_feature: Ceres CLONE 1570332
  misc_feature: SWISSPROT Homolog: EC 1.14.13.68 4-hydroxyphenylacetaldehyde oxime monooxygenase
  misc_feature (143)..(143): Xaa is any aa, unknown, or other
  misc_feature (185)..(185): Xaa is any aa, unknown, or other
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYEHVFSSRPRXLVSDIIMYGATDSCFAPYGDHFRKARKLGHVHLLNASKCGRXAPGEKKKRVP

SEQ ID NO: 84301 - DNA, 808 bp, Zea mays
  misc_feature: Ceres CLONE 1570333
  misc_feature: Encodes the peptide sequence at SEQ ID NO. 84302
  misc_feature (797)..(797): n is a, c, t, g, unknown, or other
agctccccgcggtggcggccgctctagaactagtggatcccccgggctgcaggaattcgtctcacccctagaaaaagctacccaccgttccttttcctctctcctgatctcagccgtgtagcctctccaccgcgcccacttcttatactgccagcgtctgctccctctcgcggaggcctcgctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaaatacgccataatcaaggagcttgatgagccagttaccttgaaggatgggacagtggtcctgcagtttgaagtgagacttcagaatggccttgaatgcggaggtgcctacattaagtacatccgccctcaggatgctggatgggatgccaaggagtttgataatgagactccatacactattatgtttggtccagataagtgtggatcaaccaacaaggttcatttcatccttaagcacaagaatcctaagactggaaagtatgttgagcatcatctcaaattcccaccatctgtcccatatgacaagctctctcatgtctacacggctatcttgaagccagancatgaggtcac

SEQ ID NO: 84302 - protein, 188 aa, Zea mays
  misc_feature: Ceres CLONE 1570333
  misc_feature (24)..(188): Pfam Name: Calreticulin Pfam Description: Calreticulin family
  misc_feature (185)..(185): Xaa is any aa, unknown, or other
MGGRALLLLLLVSALVFQIHASDPLLYEPFDEDFEGRWVVSKKDEYQGVWRHAKSDGHEDYGLLVSEKARKYAIIKELDEPVTLKDGTVVLQFEVRLQNGLECGGAYIKYIRPQDAGWDAKEFDNETPYTIMFGPDKCGSTNKVHFILKHKNPKTGKYVEHHLKFPPSVPYDKLSHVYTAILKPXHEV

SEQ ID NO: 84303 - DNA, 843 bp, Zea mays
  misc_feature: Ceres CLONE 1570334
  misc_feature: Encodes the peptide sequence at SEQ ID NO. 84304
ggagctccccgcggtggcggccgctctagaatagtggatcccccgggctgcaggaattcgtctcacccctagaaaaaaagccgtgtccaccaaccggccaccacccccgctgccggctcgcacctctctgcgccgtgctcagatttgcccccctctgcctgcctgcttctactacctgctgacacggcggtgcgggtcgtgctcggtggacgccagggggctacccctacccgggatccaggatcgtgctgtctgctcgccctctcctgctccttcaatcccatcggagatccgtgctggcgtttcctccctttcagcgcccaattgtttggtttgaagaaatcaagttcagatgggctccattctaagtgctactagtactacggctaagtctatggatcagcatgaggcatctggaacagatcctaataagagggtgaagatatctacttatgagtatgggtcaaacccaaggataattccaactcttcctgatgagctctcactccagatcctggcaaggtcaccacggatccattaccttaacttgaagctggtttgccgagcctggaaggcagcaatcatcggctatgaactttcccagctgaggagagcttggtgtaagtgaggaatgggtgtatgtactgaccaaggctgaggcatacaagctccattggtatgccctggatccagtgtttcagaaatggcagaggttgccaccgatgccttctttcgtcaatcaggaggaatccaatcggacagcatcttcggcgttctggaatgtgaaatgtgtgggatcaagcattaggattgctgaatacgtgaggggcttatttttgcgca

SEQ ID NO: 84304 - protein, 91 aa, Zea mays
  misc_feature: Ceres CLONE 1570334
  misc_feature (41)..(88): Pfam Name: F-box Pfam Description: F-box domain
MGSILSATSTTAKSMDQHEASGTDPNKRVKISTYEYGSNPRIIPTLPDELSLQILARSPRIHYLNLKLVCRAWKAAIIGYELSQLRRAWCK

SEQ ID NO: 84305 - DNA, 926 bp, Zea mays
  misc_feature: Ceres CLONE 1570335
  misc_feature: Encodes the peptide sequence at SEQ ID NO. 84306
ctccccgcggtggcggccgctctagaactagtggatcccccgggctgcaggaattcgtctcacccctagaaaaactcagatccctccaactccaatttccccccaatctctgcgagctccgacaatccccggacccggccgattgatgcggcgatggtgcgcgagctccgcgtcgactccttctacgcccggctccgcgccgctgcgggctcctcgtcctcgtccccgctcctgatcctcccgtccgccgccgacgccgactcgctgtgcgcggtcagggtgctcgcgcacgtcctctccgccgactccatccgcttctccatctaccccgtctcctccgccgcctccgccagggcgctcctcgcctccttcgccgccccggccccgccctgcctcgtcctcgtcaactggggcgcgcaccgggacctgcgcgcgctgctgcccgccgcctccaccgccttcgtcgtcgactcccaccgccccgtccacctccacaacctctgcgcgcgcaacgaccgcgtcgtcgtcctattcaccgccgacgacgagcgcaccgcggatctctcctacgacttcgacctctccgcgctcgccgacgcctccgacctcgccgccgacgccggcgacgacgaccacctccgcggcggccccggctccgacgcctccgactcggaagattccgacgacgacgtagatgacgccggctgtggcaggaggtagatgcgccgcctctccgatgacgactgcgacgaccccgcccactacaccgaccccgtgaggctcttctgcaggctgcgccgcgagtactaccgcctcggcacattccacggcaaagccgtccgggtgcctcatgtacgacttcgcgcacgcgatgcgcaagtaacaccacgagctcctctgggctcgctgcgtcgccctcaccgaca

SEQ ID NO: 84306 - protein, 188 aa, Zea mays
  misc_feature: Ceres CLONE 1570335
MVRELRVDSFYARLRAAAGSSSSSPLLILPSAADADSLCAVRVLAHVLSADSIRFSIYPVSSAASARALLASFAAPAPPCLVLVNWGAHRDLRALLPAASTAFVVDSHRPVHLHNLCARNDRVVVLFTADDERTADLSYDFDLSALADASDLAADAGDDDHLRGGPGSDASDSEDSDDDVDDAGCGRR

SEQ ID NO: 84307 - DNA, 832 bp, Zea mays
  misc_feature: Ceres CLONE 1570339
  misc_feature: Encodes the peptide sequence at SEQ ID NO. 84308
  misc_feature (700)..(700): n is a, c, t, g, unknown, or other
ccccgcggtggcggccgctctagaactagtggatcccccgggctgcaggaattcgtctcacccctagaaaaaatcacggcctcccctcccctggtactatacgcgtgttccgccgcgagctccattagcgcggctagctcccatgctcatcgctttcgctgacctttgagagccatattctgttcctcctcctcctcctcctccttcagttggtagcgctcgtcatcattccaggcagcaagatcgcatgacacacagctgaagctcggctttggcgcttcttggtgaccgaagcacgcgcagcatccatccgccatggagagtgccggcggacgaccagaggcggcggcggcggcggtgctcaaggtcaagggaagagacgccggaagaagaccgaacggggctcactcgtcttcttcctgcctgcaacaccgacactccagaagaacaacgagcgcgtcgtacgtaaatgctcccgacgtgtcgccgcgactctccgccggtcacatacctgcggccatcagtcgcagtgaggtgctcgacgacacaaggcgttcgctcgacctccctgaccagtttcccgagcatcgcgtcgccgcagctacagagagagctgaaagaagcggttcgaaggtttagtgtagctggctcatgatcttggagggcagggcctagctgttttttcttttcttcaaagctngtattagagtgcaggtcttccgacttccgtccatgctttattaccatcacattcctggctgttatccatctcttgtgccgcacaatgatgctttgtcatatctagggagaagtgagtaaaagcctgagtgaa

SEQ ID NO: 84308 - protein, 107 aa, Zea mays
  misc_feature: Ceres CLONE 1570339
MESAGGRPEAAAAAVLKVKGRDAGRRPNGAHSSSSCLQHRHSRRTTSASYVNAPDVSPRLSAGHIPAAISRSEVLDDTRRSLDLPDQFPEHRVAAATERAERSGSKV

SEQ ID NO: 84309 - DNA, 869 bp, Zea mays
  misc_feature: Ceres CLONE 1570348
  misc_feature: Encodes the peptide sequence at SEQ ID NO. 84310
  misc_feature (606)..(606): n is a, c, t, g, unknown, or other
  misc_feature (832)..(832): n is a, c, t, g, unknown, or other
ctggagctccccgcggtggcggccgctctagaactagtggatcccccgggctgcaggaattcgtctcacccctagaaaaactcccacatcacgataccgcgaccacccgcctaatgccttatataaatgtctcgtcttctctcccccggatcggttcgatcgatagcgagggagaatagggaggcggcggtcctagggtggccctatctctctctctctctctctctctaggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcctggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgnccttcttcagttctgcatttaaggtgaccgttttggaatcgagagatcgtatttggcggggcgccttccatctgaattaccccgtttgggatgccccaactgaatttggggaggcctcatgggcttccacgggcttgttgcaattgataaattcccacttggggtcccttttggttaaagcctatcctttgggggcctgagagtgtttaatatccccccaccatancccgattggatatatgtttccactgttatccgttgag

SEQ ID NO: 84310 - protein, 47 aa, Zea mays
  misc_feature: Ceres CLONE 1570348
  misc_feature (41)..(41): Xaa is any aa, unknown, or other
MDPNGLKTGGLLLPTIERRCTSPPSVIVIGGGISGVAAARXLLQFCI

SEQ ID NO: 84311 - DNA, 923 bp, Zea mays
  misc_feature: Ceres CLONE 1570350
  misc_feature: Encodes the peptide sequence at SEQ ID NO. 84312
  misc_feature (769)..(769): n is a, c, t, g, unknown, or other
ccccgcggtggcggccgctctagaactagtggatcccccgggctgcaggaattcgtctcacccctagaaaaaaccatcgaccccgcggaagcgggggcgtgcgcgtatccactcctcaaccaagtggagcatcccctcacgctagaccggagctggggggcgacgacgagccagccgccgccggtttgaccagacctgtggtgatgaactgataaggtatgcctgtaggagggagagagctttcggtttagaaaataagagggtgccgcgggctggactgagagagcggaaggaaggaaggagccggcgatgggcgggtggaactggctcttctgcggccgatccaaagccggaggcggcgagctccggcctcccgagcccttccagctgccggcgcccttgcccgagtggccgcaaggaggggattttgctaagggcacaatatgcataggagaggttgatgttacaagtattaccaaattccggagtatatggacctgctcagatgctacattttatgagccagaaggaattcctgatggtttccactgccttgggcactacgcccaacagaatgaccgccccttacagggatttcttctggtggcaagggaagtggctagccaccaagttattgataccaagcccgcccttgagaaccatcagattactcccttgtttggaccagtgctgacgcaaatgaagatgacaatagcgaatgtggttgcatctggctgccatgtccaccgaatgggtataaagccctggnctatgtggttactaaaggaccaaagaagcatcactggaagcagttcggtgtgtgcgagatgaccctacgacacgcgcgaaaatttcattcattgcaatatggacacgcatgccagattggaagacaggctttgcaccgagatggggaggcgtgc

SEQ ID NO: 84312 - protein, 173 aa, Zea mays
  misc_feature: Ceres CLONE 1570350
  misc_feature (20)..(174): Pfam Name: DUF946 Pfam Description: Plant protein of unknown function (DUF946)
  misc_feature (154)..(154): Xaa is any aa, unknown, or other
MGGWNWLFCGRSKAGGGELRPPEPFQLPAPLPEWPQGGDFAKGTICIGEVDVTSITKFRSIWTCSDATFYEPEGIPDGFHCLGHYAQQNDRPLQGFLLVAREVASHQVIDTKPALENHQITPLFGPVLTQMKMTIANVVASGCHVHRMGIKPWXMWLLKDQRSITGSSSVCAR

SEQ ID NO: 84313 - DNA, 863 bp, Zea mays
  misc_feature: Ceres CLONE 1570351
  misc_feature: Encodes the peptide sequence at SEQ ID NO. 84314
tccccgcggtggcggccgctctagaactagtggatcccccgggctgcaggaattcgtctcacccctagaaaaagtttcgagggcggcgaagcactagggcatccacctcggcggtggcggcggcggcctccatgtcgggcagcaacgggaacggcggcggcgcctcctccgcgctctatggcttatacggtcccaacgcgaaacccgatgttgtttttaaggaggctgctttaaactctacattaaacctgcaggatgttcagggtctagttacttgggttattggtgacggcatgctgccttcttgggtgtttgttaagaacaaacctcttatacccaaagtcgtcctactatatgttcctggccttgatgcagctttatatatgtcacaaactcgacttctctcttctctgaaagaattatgtggcaatccaaaacctgttctagcttcaagctgtataccggatgataggcacacaattgatgcactcctaacctgcagagtaaagagaaagcttgatgtaaaaacatcaaatcagtcatctaaacctgacagagatgggaaactatcaagttttggatgatcttgggggacttcccatttcctggttacgtattacacacttttcagaaaaagacttggaaagaataatggcctactcctttcaatttaccagggttttgttccctaactggtttcagcctcccttcagggtttcttccgccaccaataaaggttctttggcactttgtaatttgggaaaaaggcgccaaaaaacaaaaaacctgggatttttaaagccttacaaaagaatgtgaccatttaaatttggaccattttaaaaggggatatcggggggggg

SEQ ID NO: 84314 - protein, 150 aa, Zea mays
  misc_feature: Ceres CLONE 1570351
MSGSNGNGGGASSALYGLYGPNAKPDVVFKEAALNSTLNLQDVQGLVTWVIGDGMLPSWVFVKNKPLIPKVVLLYVPGLDAALYMSQTRLLSSLKELCGNPKPVLASSCIPDDRHTIDALLTCRVKRKLDVKTSNQSSKPDRDGKLSSFG

SEQ ID NO: 84315 - DNA, 672 bp, Zea mays
  misc_feature: Ceres CLONE 1570354
  misc_feature: Encodes the peptide sequence at SEQ ID NO. 84316
  misc_feature (277)..(277): n is a, c, t, g, unknown, or other
  misc_feature (292)..(292): n is a, c, t, g, unknown, or other
  misc_feature (306)..(306): n is a, c, t, g, unknown, or other
  misc_feature (402)..(402): n is a, c, t, g, unknown, or other
  misc_feature (422)..(422): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (608)..(608): n is a, c, t, g, unknown, or other
  misc_feature (610)..(610): n is a, c, t, g, unknown, or other
  misc_feature (611)..(611): n is a, c, t, g, unknown, or other
  misc_feature (619)..(619): n is a, c, t, g, unknown, or other
  misc_feature (638)..(638): n is a, c, t, g, unknown, or other
tggagctccaccgcggtggcggccgctctagaactagtggatcccccgggctgcaggaattcgtctcacccctagaaaaactctgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtggttgggtcgacgattggagctnggcgtctacgtccanttgtttggcacagnttggcgcggggaagcatttcccggggccggggcattttgacgccctttcccttttttttgaaaaaaaccccggaaaataaacccacctttgccccnccttttttcccccccttttnggggataatagggggaaaaaaatgtgttggggtaaaaccccctttttccccccctttttttttttnnngggggggggagggaggcgccccccccccctatatattttttttttttccccccccccccccccctgccccccctttnnnnaaaaaaaaaaaaaaaaaaaaatttctccctttcnnncnanngggggggnaaaaaaaaaataataaatngggggggggggggggggggggggggggttttaaa

SEQ ID NO: 84316 - protein, 84 aa, Zea mays
  misc_feature: Ceres CLONE 1570354
  misc_feature (49)..(49): Xaa is any aa, unknown, or other
  misc_feature (54)..(54): Xaa is any aa, unknown, or other
  misc_feature (59)..(59): Xaa is any aa, unknown, or other
MGSGVRALMRRKQVDSERTRAAGSAHQLRKELSVTQLVAIGGWVDDWSXASTSXCLAQXGAGKHFPGPGHFDALSLFFEKNPGK

SEQ ID NO: 84317 - DNA, 1151 bp, Zea mays
  misc_feature: Ceres CLONE 1570355
  misc_feature: Encodes the peptide sequence at SEQ ID NO. 84318
  misc_feature (1)..(1): n is a, c, t, g, unknown, or other
  misc_feature (6)..(6): n is a, c, t, g, unknown, or other
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (63)..(63): n is a, c, t, g, unknown, or other
natttnttgnnttagggnttcgtggtgcgtacctgtggcttgtctgcctcggttctgttcgcnggttagggtcttttttttgttgtggggctcccctcggtggcggccgctctagaatagtggatcccccgggctgcaggaattcgtctcacccctagaaaaaaacaccaaccaacaggtggcgagagcgagagcgagagcaaagagctgagcgggacggagcagctagcgctagggataacgcacacccaccaccatggcgacgcccggagagcagccggcggaggtcgtgtccgtcgagatgcccgcacccgacgggtggaccaagaagtttactcccttgagaggggggagatctgagattgtttttgtttcaccaactggcgaggaaattaagaacaagaggcaattaagtcagtacctaaaggcacaccctggaggccctgctgtttcagagtttgattgggggaactgggtgataccccaagggcgttctggctcgtatttagccgagaaaaggcaagggtattttgataagccccgaaggggcgagaaaaatccccgtaaggccgccagcaggggaaacccccaatgggggttggtataggggtaaagccccgggggggataagaaagggaaaaccccccctcgtgagaaccccgctaagaaataagccccaaaaagaaatggcctgtgaaaaaaacttgagcgccaatagggaaaaggggcccatggaataaggaaaaggggcgccccccccaaatagcgcacgaaaatagaaaatggccctcgggccccaaatagggggaagaaaaactctggcattgtggtctggggcaattaataaggaaaaagcccccctgggcccttgaaaaaagaagagaggggtgaaatatgggagggggcgccaccccctctgcccgcgtgaaataaacaaggagaaaaataatagcccttgggaaaagatgggggcgtgataaatgcgcctgcccctaggggaacccaaggcgcaccctcaatgtgggggaatagtaaaagatatttaagggacaacctcgtacctcgtggaaggaatacctggggcgcagaaagaacgcttttttgagaacttcctctccccctccctgggtggccactttccgagtagataa

SEQ ID NO: 84318 - protein, 116 aa, Zea mays
  misc_feature: Ceres CLONE 1570355
  misc_feature (8)..(78): Pfam Name: MBD Pfam Description: Methyl-CpG binding domain
MATPGEQPAEVVSVEMPAPDGWTKKFTPLRGGRSEIVFVSPTGEEIKNKRQLSQYLKAHPGGPAVSEFDWGNWVIPQGRSGSYLAEKRQGYFDKPRRGEKNPRKAASRGNPQWGLV

SEQ ID NO: 84319 - DNA, 1061 bp, Zea mays
  misc_feature: Ceres CLONE 1570356
  misc_feature (801)..(801): n is a, c, t, g, unknown, or other
  misc_feature (1061)..(1061): n is a, c, t, g, unknown, or other
ggttgtggtgtgtgtgtgtatacaaaatatacaaattccttaatgatttcttagcccggaaaaacgagaggagagaaataaaaactggagctcaccacggtggcggccgctctagaactagtggatcccccgggctgcaggaattcgtctcacccctagaaaaatttcttgtccattgacatcagcgctccacgcctgcgcccccgaattcccaaatcctgcggcgcctccgccccaaccccgctcgtcgactcctctcttccgaacacgccggaggaatccttctccgactcgtcttccacctctctgccgggctggcgtggattggtctcttcttctgctgtggatttcctttcctagcatcaccacatgtaaaacaggggagatttaagatccaacacatcagcgaagtggcgcccttgctgacacaagaatacgtccaggtctcgtagaacacctaacgctggattgtgcagtgatctaggggattgcgtattacgatatttgaggatgggaattttcacaaatttgcaatagtcccaattaatttgtccttccccttcctacccctggataccatgcccaggattcaatctgcgttacaattgggttgttttgccttgacttggaagggcaacaatccccccgaatttccctcgcaataagggggcttgaaagttggcacaccctgcgccccttcaaattccacccgagagaataaaaaaacggaacccgcctttcccggtcgattctaaggcaaatttcctgtctctccccgagttttcggcggagattttgggnctttctgtgggccgggccacccccgtatgggggagagccagacaccaaccttctggttttttcccacaagaaaaaggggcgaaaaagggggacgcaatgaaagaattcccacacagaacccaatattcgggtgccccgaatttgccccaaacccccggtaaaggaccgggtgggccaaaaaccctcccggggaagaaatcttcctcgcgggtatccctccccccggtgtttccagggggaaccacctaaaacatcccgcn

SEQ ID NO: 84320 - DNA, 868 bp, Zea mays
  misc_feature: Ceres CLONE 1570357
  misc_feature: Encodes the peptide sequence at SEQ ID NO. 84321
  misc_feature (699)..(699): n is a, c, t, g, unknown, or other
  misc_feature (700)..(700): n is a, c, t, g, unknown, or other
ccccgcggtggcggccgctctagaactagtggatcccccgggctgcaggaattcgtctcacccctagaaaaactgccgccgccgccgctcccgctcccagctcgtgttccgcttcttgcagccgtcgccgcgaagcgctccagagaacttccgtcaacatggggaagacacgtggtatgggagccgggcgcaagctcaagacccaccgcaggaaccagcggtgggctgacaaggcatacaagaagagccatttgggcaatgagtggaagaaacccttcgctgggtcatcccatgccaagggcattgtcctggagaagattggtattgaggccaagcagcccaactccgctatccgtaagtgtgctcgtgttcagcttgttaagaatggcaagaagattgctgccttcgtgccaaatgacggttgtttgaactacattgaggaaaatgatgaggtcttgattgctggatttggtcgtaaggggcacgctgtgggagatattcctggtgtccggttcaaggtcgtcaaggtttccggtgtgtctctgcttgcccttttcaaggagaagaaagagaagccaaggtcttagattgctcttgctaccaaaatcagcaagcgtggagttgaaacgggagggcgttagatgattaagaagaatggttgcttgctatgtttgcagtgcattcgtgcaattgttaccnntaagattttgttggtgaaaacgatttcttttcagacttgctttctgttgagtgctatcatttcatatcaatgtacttcccttttctagaaaaaaaaaaaaaaaaaaaaatatgcgcacaccatgttccgtttgagaatctccgggaagggcatggaaggacccgccct

SEQ ID NO: 84321 - protein, 142 aa, Zea mays; identical to SEQ ID NO: 43537
  misc_feature: Ceres CLONE 1570357
  misc_feature (8)..(141): Pfam Name: Ribosomal_S12 Pfam Description: Ribosomal protein S12

SEQ ID NO: 84322 - DNA, 996 bp, Zea mays
  misc_feature: Ceres CLONE 1570359
  misc_feature: Encodes the peptide sequence at SEQ ID NO. 84323
  misc_feature (996)..(996): n is a, c, t, g, unknown, or other
ctggagctcaccgcggtggcggccgctctagaactagtggatcccccgggctgcaggaattcgtctcacccctagaaaaagataagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaaatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgcctcgactcccgcgtgtgcccgtcggtgacactggggctgcagcccgggcgaggattcaccggtcgcaacatcggctccatggtcccaccctaccacaagatcaagtacgccggcacggggtcccccatcaagtaccccgtgggcgcgcctcaaggggcaagtcatccgggatcattggcgcaaagcgggctggggtgggaacaagggagctccccctccctcaaggaaggggcggccccaaaaacttcacattttggggagaaaagggtcaggaatcgggagacccggcacaaaacaaaggtaaagaaaaaagaacccttcgggtcccttcaaan

SEQ ID NO: 84323 - protein, 154 aa, Zea mays
  misc_feature: Ceres CLONE 1570359
  misc_feature (31)..(151): Pfam Name: Pro_CA Pfam Description: Carbonic anhydrase
  misc_feature: SWISSPROT Homolog: EC 4.2.1.1 Carbonate dehydratase
MDPTVERLKSGFQKFKTEVYDKKPELFEPLKSGQSPRYMVFACLDSRVCPSVTLGLQPGRGFTGRNIGSMVPPYHKIKYAGTGSPIKYPVGAPQGASHPGSLAQSGLGWEQGSSPSLKEGAAPKTSHFGEKRVRNRETRHKTKVKKKEPFGSLQ

SEQ ID NO: 84324 - DNA, 827 bp, Zea mays
  misc_feature: Ceres CLONE 1570361
  misc_feature: Encodes the peptide sequence at SEQ ID NO. 84325
ccccgcggtggcggccgctctagaactagtggatcccccgggctgcaggaattcgtctcacccctagaaaaaagaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgactgtcgtcttcgccgccgtcatcttcttcgcgggcgcgctgctcatgggtttcgccgtcaactactccatgctcatggtgggccgcttcgtggccggagttggcgtgggctacgggggcatgatcgcgcccgtgtacacggccgagatctcgccggcggcgtcccgcggcttcctcacgtccttcccggaaagtgtcatcaacgtcggcatcctgctcggctacctgtcgaactttgcgtttgcgcgcctaccgctccgccctcggctggcgcgtcatgctcggcatcggcgcggcgccgggcgggctgctcgcgctcatggtgctctgggatgccgagtcgcctcggtggcttgtcatgaagggccgccctcgcgaccccagggccgtgctggagaagaccctcgcctcgccgggaga

SEQ ID NO: 84325 - protein, 231 aa, Zea mays
  misc_feature: Ceres CLONE 1570361
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVNYSMLMVGRFVAGVGVGYGGMIAPVYTAEISPAASRGFLTSFPESVINVGILLGYLSNFAFARLPLRPRLARHARHRRGAGRAARAHGALGCRVASVACHEGPPSRPQGRAGEDPRLAGR

SEQ ID NO: 84326 - DNA, 797 bp, Zea mays
  misc_feature: Ceres CLONE 1570362
  misc_feature: Encodes the peptide sequence at SEQ ID NO. 84327
  misc_feature (797)..(797): n is a, c, t, g, unknown, or other
ctccccgcggtggcggccgctctagaactagtggatcccccgggctgcaggaattcgtctcacccctagaaaaaaaccccagacatcaaccgaagccgtagagaggggcagcgaaagcttactcttttataccttcgtacttcataggatttcgggactatcctccctcgattcgtgccatctacctcgcggtcccgcctcaactgccgcctgttgattagccgctcggagccccaattctatacggctcttcgatctgggatccgctagattcgccggggcggttatgaggaggtgatgggagcgatggcggaggtggtgcaggaggggtgcgtggagaatcgacagcccctggcggcttcgagctcgtccgtgtcggatggcagcagctgtggcggcggagggcgggcggggacgtcgccgccggtgtcaagctccgggaattccatctccgttcttagacgaacaactggaccgataagaagagctaagggtggctggacaccagaagaggatgaaacactgcagaaggcagttgtagctttcaagggcagaaattggaaaaaaatagctgaattctttcaggacaggactgaggttcaaggtttgcatcgttggcagaaggttcttaatccggagcttatcaaaggcccttggactcaagaggaagatgaaaaaatcattgaccttgtgggcaagtatggaccaacaaaatggtctatcatcgcgaaatcattgcctggccgcataggcaagcaatggccgagagaggtggcataatcatctgaatccagaan

SEQ ID NO: 84327 - protein, 157 aa, Zea mays
  misc_feature: Ceres CLONE 1570362
  misc_feature (62)..(108): Pfam Name: Myb_DNA-binding Pfam Description: Myb-like DNA-binding domain
MAEVVQEGCVENRQPLAASSSSVSDGSSCGGGGRAGTSPPVSSSGNSISVLRRTTGPIRRAKGGWTPEEDETLQKAVVAFKGRNWKKIAEFFQDRTEVQGLHRWQKVLNPELIKGPWTQEEDEKIIDLVGKYGPTKWSIIAKSLPGRIGKQWPREVA

SEQ ID NO: 84328 - DNA, 850 bp, Zea mays
  misc_feature: Ceres CLONE 1570365
  misc_feature: Encodes the peptide sequence at SEQ ID NO. 84329
gagctcaccgcggtggcggccgctctagaactagtggatcccccgggctgcaggaattcgtctcacccctagaaaaagaaccccacgaagccggagccaagccacgacgggtcgaccggtcgacggcccctcgacctgcccgcctcgcttcctccgacgcctagggttttctaccggacgccgccgccgccgcagcagcggcccgggatgcaggtgtgcccgcgcagttagccgccgtcggacccaccgccgccgcgcgccatgtcattcttgcggcggcgaaagccgctgccgccctctgacggtgacgagtccgaccacgacgacaacgacaaggggaagaagccgtcctcatcctccggggtcgccgtccaaggagcccacgaagcggaccaaggccaagtggtcgtgcgtggacagctgctgctggctgggtcgggtgcgtgtgctcccgcctggggggctgctgctcttccaaaacaacgcgatgccgggcctcgttcccgcagtatggtccccgagggcctttacgggggccgcttccccggaccccccccggggggtcaagcctgcaaaaaggggggggcctgccaagtttaaaccccccccgttcggtctttggtccccggggaattccgtccaccgggggggcctggggaggttttggggaggggggggccccccccgggcgccccaagggggctcctctccccaaaacggggctttggggggggggggcccatttttgggcgggcggttttccaaagaagaaccccctattggcgggggggcgaaaaaaatatgggttttgtggggaaaaaaagggaacatggggaatttggcacaaaag

SEQ ID NO: 84329 - protein, 112 aa, Zea mays
  misc_feature: Ceres CLONE 1570365
MSFLRRRKPLPPSDGDESDHDDNDKGKKPSSSSGVAVQGAHEADQGQVVVRGQLLLAGSGACAPAWGAAALPKQRDAGPRSRSMVPEGLYGGRFPGPPPGGQACKKGGACQV

SEQ ID NO: 84330 - DNA, 835 bp, Zea mays
  misc_feature: Ceres CLONE 1570366
  misc_feature: Encodes the peptide sequence at SEQ ID NO. 84331
  misc_feature (708)..(708): n is a, c, t, g, unknown, or other
  misc_feature (795)..(795): n is a, c, t, g, unknown, or other
ctccccgcggtggcggccgctctagaactagtggatcccccgggctgcaggaattcgtctcacccctagaaaaagttccgctcgctcgcccgccaccgagagactacactctacgtgtgtgcctgcgagagcgagagcgcaccagcagccagcttcctctgcgcgcggcctgctggtcgcttcgcttcgctccagtccagggcggcacatggcggggggcgggggcggccgggacctcccgtcgacgccgacgtgggcggtggccctggtgtgcgccgtcatcgtgctcgtctccgtcgccatggagcacggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccggccaaggctggcagcatcatgctgccgtgacagccgccgaaagccgccgccgccgacgacgacgacaagagcgacggccgccggagactcctctggtacccgccgtaccctgggatacgatgaggccgggcaccacccgccgttttcctcgccgggggcgggctcccggaagaaaacattttggcatggacccaaagggaaagggggtccccccaaacccccccttgggggggggtgggtccccnccacggggggggggaacattttttttttttttttttgggggcccccggggggggttttttttatctataaatccgaaaaaggccggngtggaggcgctccacaccacccgagcccgtgggggagggg

SEQ ID NO: 84331 - protein, 94 aa, Zea mays
  misc_feature: Ceres CLONE 1570366
MAGGGGGRDLPSTPTWAVALVCAVIVLVSVAMEHGLHKLGHWFHTRQKKAMREALEKIKAELMLMGFISLLLAVGQTPISKICIPAKAGSIMLP

SEQ ID NO: 84332 - DNA, 801 bp, Zea mays
  misc_feature: Ceres CLONE 1570370
  misc_feature: Encodes the peptide sequence at SEQ ID NO. 84333
ggagctccccgcggtggcggccgctctagaactagtggatcccccgggctgcaggaattcgtctcacccctagaaaaaaaaaactgcggatagagcagcgagccatcgacacgatcgcgagcgcaagcacgtacgttgtcggaagctcaagttagaagaagcaccagtgcctgatcgatggcggcccaggctctcctctccggccggcagctgctgggccgccccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcggtcttcaaaatggcgctcatggggcttgcccgagaaccgccggcctccagggacttggtacaaccccggggctccatggggcaaagcagttactttccttcgggcctcggagaaaatttccttcgccgggcttcggggggaaacccgttccctaccccccgggcgggggccca

SEQ ID NO: 84333 - protein, 208 aa, Zea mays
  misc_feature: Ceres CLONE 1570370
  misc_feature (55)..(205): Pfam Name: Chloroa_b-bind Pfam Description: Chlorophyll A-B binding protein
MAAQALLSGRQLLGRPVQSAVSRSSARKAPFVVRASSSPPAKQGADRQLWFASKQSLSYLDGTLPGDYGFDPLGLSDPEGTGGFIEPKWLAYGEVINGRYAMLGAVGAIAPEIFGKMGIIPPETALPWFKTGVIPPAGTYNYWADSYTLFGLQNGAHGACPRTAGLQGLGTTPGLHGAKQLLSFGPRRKFPSPGFGGKPVPYPPGGGP

SEQ ID NO: 84334 - DNA, 817 bp, Zea mays
  misc_feature: Ceres CLONE 1570373
  misc_feature: Encodes the peptide sequence at SEQ ID NO. 84335
  misc_feature (764)..(764): n is a, c, t, g, unknown, or other
  misc_feature (817)..(817): n is a, c, t, g, unknown, or other
ctccccgcggtggcggccgctctagaactagtggatcccccgggctgcaggaattcgtctcacccctagaaaaagaccgccgcccgggcgccagcccactcaaaccctttggtctcctgtcctctcttcgtccaccgcgtcgtcgtctccctccctccgtccccgcacccaccgttatatacaacccccgtcgggactacactcaccaccgcgcctcgaatccatcgctcaactactcgaacccgactcaccggcgcctactcccgcctggctcccgggcccattcgtcgacccgtcgccgggcgaaagcgcgccactaaggtctccaacctccgcccgttgaagcgacggcgccgcatcggaggaactgtagctgttagtccgcctcttctcggcagcgcggggcggagatccgaccggacttgggatcgattccttcccttttctcgattcagggcgctaacagttcctgagggaagcttctggggacatggacatggcattgcccgttgtgaatgccacagcggcggtgctcgcccgtgtctcggctgccttcaatggcccccttgcccgcgcagtcgtctttggggtccatattgatggtcacttggtcgtggaagggcttcttattgcagtcatagtgttccagctctccaggaagagctacaaaccaccaaagaagccactcactgaaaaggagattgatgagctatgtgatgagtgggagccagagccactatgccctccaatcaaggagggggccnaaatagatgctccaacattggaaaagtgcgctgggacacatacgattgttgan

SEQ ID NO: 84335 - protein, 108 aa, Zea mays
  misc_feature: Ceres CLONE 1570373
  misc_feature: SWISSPROT Homolog: EC 2.3.1.50 Serine C-palmitoyltransferase
  misc_feature (92)..(92): Xaa is any aa, unknown, or other
MDMALPVVNATAAVLARVSAAFNGPLARAVVFGVHIDGHLVVEGLLIAVIVFQLSRKSYKPPKKPLTEKEIDELCDEWEPEPLCPPIKEGAXIDAPTLEKCAGTHTIV

SEQ ID NO: 84336 - DNA, 831 bp, Zea mays
  misc_feature: Ceres CLONE 1570375
  misc_feature: Encodes the peptide sequence at SEQ ID NO. 84337
ggagctccccgcggtggcggccgctctagaactagtggatcccccgggctgcaggaattcgtctcacccctagaaaaaaaccaccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagccccctcgcctccgccacccccggcgcgcgtcgcgctttccctgtacggctgctgctccaggcatctgcgctcgcgccgcgccggcgcgccttggccgtgaccgtgagggcccagagcgacgacgccgaggccgagccaaaggaggcggcggcggcggccaccaccccggcgccaaagtccaaggcggcggcggcggcgagccccgggctgtgggacgcgctggcgttcagcggcccggctcccgagcgcatcaacggccggctcgccatggtgggcttcgtgtcggcgctcgccgtcgaggcgtcccgcggcgggggcctcctctcgcaggccggcagcgggtccgggctcgcctggttcgcggccacggctgccgtgctgtccgtggcctcgctggtgccgctgctcaggggcgacagcgccgaggccaggagcggcgccgtcatgagcggcaacgccgagctctggaacggccgcttcgccatgctcggcctcgtcgcgctcgccttcactgagtacctcaccgggcgcaacgtttcatcaacggcgtagagggcggttccggtcccaagccagggggctaaaataattt

SEQ ID NO: 84337 - protein, 193 aa, Zea mays
  misc_feature: Ceres CLONE 1570375
  misc_feature: SWISSPROT Homolog: EC 4.99.1.1 Ferrochelatase
MAATVMASMSPLASATPGARRAFPVRLLLQASALAPRRRALAVTVRAQSDDAEAEPKEAAAAATTPAPKSKAAAAASPGLWDALAFSGPAPERINGRLAMVGFVSALAVEASRGGGLLSQAGSGSGLAWFAATAAVLSVASLVPLLRGDSAEARSGAVMSGNAELWNGRFAMLGLVALAFTEYLTGRNVSSTA

SEQ ID NO: 84338 - DNA, 766 bp, Zea mays
  misc_feature: Ceres CLONE 1570377
  misc_feature: Encodes the peptide sequence at SEQ ID NO. 84339
ctccccacggtggcggccgctctagaactagtggatcccccgggctgcaggaattcgtctcacccctagaaaaataaaacatttaccagtatcgaagagttccttgagccacttgagctgtgctacaaatcactgtgtgactgcggcgacaaggccatcgcggacgggagcctcctggacctcctgcgccaggttttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtgcgccagccgctgcccgtggtgccgctgttcgagaggctggccgacctgcagtcggcgcccgcgtccgtggagcgcctcttctcggtggactggtacatgggaccggatcaagggcaagcagcaggtcatgggtcggcctactccgactccgggcaaggacgccggcccgctgttccgccggctgggcaacctgtacaggggcccaagaaggaaatggccccaggtggccaaacca

SEQ ID NO: 84339 - protein, 98 aa, Zea mays
  misc_feature: Ceres CLONE 1570377
  misc_feature: SWISSPROT Homolog: EC 4.1.1.31 Phosphoenolpyruvate carboxylase
MATAPSDVLAVELLQRECGVRQPLPVVPLFERLADLQSAPASVERLFSVDWYMGPDQGQAAGHGSAYSDSGQGRRPAVPPAGQPVQGPKKEMAPGGQT

SEQ ID NO: 84340 - DNA, 814 bp, Zea mays
  misc_feature: Ceres CLONE 1570378
  misc_feature: Encodes the peptide sequence at SEQ ID NO. 84341
gcggtggcggccgctctagaactagtggatcccccgggctgcaggaattcgtctcacccctagaaaaagaaaacccaccgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaacaggtgcgcccggcgttcgtgccggacgatgtgatcggcagcgccgggagccccgacaagtactggagcccccaccccaagaccggcgtgttcggcccggcggcggtggaccccaagctggcagctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcggggagagcctggcagtggcaggcaccctgctcgtgctcggctgggctgggctcccctgctatatcactacaatatatactactagtaatgggggcttgaaagcagggggtgggctgtgccaaaacccagaaaaaaacgggttcaaccaaaaaaacaggccaattaaggcattggggtgcattaagaaaggggttgggaaaaataacccaccctgaattcccc

SEQ ID NO: 84341 - protein, 120 aa, Zea mays
  misc_feature: Ceres CLONE 1570378
MAAAAGSKGRAIAGSFVSRVLAGKAASPRRAVHASAYDKNLEEQVRPAFVPDDVIGSAGSPDKYWSPHPKTGVFGPAAVDPKLAAGGAPDAGADAAGGTVLDQKVWFRPLEDVEKPPPAA

SEQ ID NO: 84342 - DNA, 831 bp, Zea mays
  misc_feature: Ceres CLONE 1570381
  misc_feature: Encodes the peptide sequence at SEQ ID NO. 84343
  misc_feature (793)..(793): n is a, c, t, g, unknown, or other
gcggtggcggccgctctagaactagtggatcccccgggctgcaggaattcgtctcacccctagaaaaactgcctgcccctctacaaatctctcctgctccactcttctccacgtccatcccgcgccccgaatttcccgagccaactccgccctgccctgtcgctttcccttccacacgcgccgttcgctttgatcgatcaggcaggcatggccgacgagacgaagcaagaagccgccgcccccgcggccgaggtggtcgtgacggaggatgagaagaaggcagaagagaccgccccggtggcggaggaaaaggccgtggaggcggctgtagagaaggccgcggaggcggaggcgggggcggaggaaaaggtcgcggaagcggactcggaggaggagaagaaggcggaggaggccgaggaggccgccgcgggggatgaggcggcggtgatcgatggcactgggtcgttcaaggaggagagtaacctggtgtccgagctccccgaccctgagcgcacagcgctcgcgcagctcaaggagctcgtcgccaccgcgctcgctaacggggagttcaacctgccgccgccgccagccaaggaggaggccaagaatgaggagccggcaaaggaagaagctccggcggacaaggaggacgagcccaaggcagaggatgcggctgcccaagagcccgtcaaggaggaggccaagcctgaggagcccaaaacggaggcgccggcggaagcagcgcccgagggaggttaggacgagacacccgtgccggaatgagacaagactngagctcccgcgccggaagagcccaggccgaagaagctg

SEQ ID NO: 84343 - protein, 183 aa, Zea mays
  misc_feature: Ceres CLONE 1570381
MADETKQEAAAPAAEVVVTEDEKKAEETAPVAEEKAVEAAVEKAAEAEAGAEEKVAEADSEEEKKAEEAEEAAAGDEAAVIDGTGSFKEESNLVSELPDPERTALAQLKELVATALANGEFNLPPPPAKEEAKNEEPAKEEAPADKEDEPKAEDAAAQEPVKEEAKPEEPKTEAPAEAAPEGG

SEQ ID NO: 84344 - DNA, 820 bp, Zea mays
  misc_feature: Ceres CLONE 1570384
  misc_feature: Encodes the peptide sequence at SEQ ID NO. 84345
tccccgcggtggcggccgctctagaactagtggatcccccgggctgcaggaattcgtctcacccctagaaaaaagccagaaccagctccaacccaaccagaaccagctcgccccggccgccgcgaccgtcccccctcatcgactcgaggcaacgaagcggccggatgggagcagcagcctgaccctgacgcgatgagcccgcccgccatgctgctgcccgtctgctccgccgcgcccagctgctcccccctctgcccggtgacggcctcgcacgtcgtcgcgcgggtggcgcggagggtggacgtcggcgccgcgctcaggtcctacgccgactcctccatactctccccctacatcgccgcgccggacgacatcgcgcgagccttcggcgcccccgcctccgagctcccgccgctccccagcgccgaccccagccctgggctatgttgcacgggcaccgaccagccgctggcggcagtcgcggacctggccgcaactgccgtggtcaactcggctcccaccgacgccgcggagcgggccctgtcggacgcgccgttccccagcacgttcccgtctgacgcgtccgaggtcgaggactccgtggccaggctcatcgataagggtcggaagcaagtcttccaggcgggagacgcgctcaccgaggccctacaacaagctggaggctgtccgccttacaaacccccttcggtgcgtggaaagaaaaaagggggccccaaaccccaaaggggggggtctcaagggggtctggtccaacccccgggaaaaaaaacagggcccccccggaagggggtccacgggt

SEQ ID NO: 84345 - protein, 204 aa, Zea mays
  misc_feature: Ceres CLONE 1570384
MLLPVCSAAPSCSPLCPVTASHVVARVARRVDVGAALRSYADSSILSPYIAAPDDIARAFGAPASELPPLPSADPSPGLCCTGTDQPLAAVADLAATAVVNSAPTDAAERALSDAPFPSTFPSDASEVEDSVARLIDKGRKQVFQAGDALTEALQQAGGCPPYKPPSVRGKKKGGPKPQRGGSQGGLVQPPGKKTGPPRKGVHG

SEQ ID NO: 84346 - DNA, 805 bp, Zea mays
  misc_feature: Ceres CLONE 1570385
  misc_feature: Encodes the peptide sequence at SEQ ID NO. 84347
  misc_feature (752)..(752): n is a, c, t, g, unknown, or other
  misc_feature (805)..(805): n is a, c, t, g, unknown, or other
ctccccgcggtggcggccgctctagaactagtggatcccccgggctgcaggaattcgtctcacccctagaaaaagctcatgcccttccgcgcttccgcaggacgctgctgctgctggtaggctgacagcgaggaggacgagacgagggggccatggctcagatcttgctccacggcacgctccacgccaccatcttcgaggccgagtcgctctccaacccgcaccgcgccactggcggcgcccccaagttcatccgcaagcttgtggaagggatcgaggacaccgtgggtgtcggcaagggcaccaccaagatatatgccaccgtcgatctcgagaaggcccgtgtcgggcggacccggatgatctccaacgagcccgtgaaccctcgttggtacgagtccttccacatctactgcgcgcacatggccgccgacgtcatcttcaccgtcaagatcgacaaccccatcggggcctcgctcatcgggagggcctacttgcctgtccaggacctcctgggaggggaggagatcgacaagtggcttgaaatctgcgatgaaaatcgtgagcctgttggggacagcaagatccatgtgaagctccagtactttgacgtcggcaaggaccgtaactgggcgaggggtgtccggagcaccaagtaccctggtgtcccttacaccttcttctcgcagaggcaggggtgtaaggttactctgtaccaggacgctcatgtgccggaacactttgttcccagnatccagctcgctgatggcaagaactatgagccgcacaggtgctggggagattn

SEQ ID NO: 84347 - protein, 217 aa, Zea mays
  misc_feature: Ceres CLONE 1570385
  misc_feature (10)..(114): Pfam Name: C2 Pfam Description: C2 domain
  misc_feature: SWISSPROT Homolog: EC 3.1.4.4 Phospholipase D
  misc_feature (200)..(200): Xaa is any aa, unknown, or other
MAQILLHGTLHATIFEAESLSNPHRATGGAPKFIRKLVEGIEDTVGVGKGTTKIYATVDLEKARVGRTRMISNEPVNPRWYESFHIYCAHMAADVIFTVKIDNPIGASLIGRAYLPVQDLLGGEEIDKWLEICDENREPVGDSKIHVKLQYFDVGKDRNWARGVRSTKYPGVPYTFFSQRQGCKVTLYQDAHVPEHFVPXIQLADGKNYEPHRCWGD

SEQ ID NO: 84348 - DNA, 903 bp, Zea mays
  misc_feature: Ceres CLONE 1570387
  misc_feature: Encodes the peptide sequence at SEQ ID NO. 84349
ctccccgcggtggcggccgctctagaactagtggatcccccgggctgcaggaattcgtctcacccctagaaaaaaacagcggcacagcccacgggccacgcccagttgatatccctgatggcctgatgtcgcaactcgcaaccctagctcccagcctcccactcccacgcgcttcaagtcttcccaggcggccggcggcgtactcccagagtcccagacggccaatcttcccagcatcgggtggcgtcctcactccaggcggcaggcggctgcaccgccgcagtcacgaactcacgcgcaccgcgggcccgcggcagcgcgcacacgcgcacacgcgcacggcgcaccagcagccgtgagccggccagtccggcagtcccagcctcccaggcggccagtcctcccagtcccagtcccagctgcctaggtctgccgcctgtcttgaccccacccactggccacttcccctcctgtccgttcccaaatcccgtcccctccacccgcactccattggcgccgctcccctcccctcgccgccgccggagatctgatccgatccgtttgtgcttgtgctggacgatggtgggcctctctgaaggggagaacacttcatccgcggcggcattgcacaagacgttcgcactgatggacgtaggcggctgcagttccggtccctctccgtccaacccgagtcattcccaggcgaatggctcaacgccgggtaagttggggggcactgaaataatcgctaggggcaaggcggactaggaaaaccaagcattcttcacccggaacaaaggaaaagttgccatttttggccaacggtagtccaaccgctggaacctccgttttgaaggataagaggcttgtaaaaattgtgcctgcggagaacccccgggtttc

SEQ ID NO: 84349 - protein, 62 aa, Zea mays
  misc_feature: Ceres CLONE 1570387
MVGLSEGENTSSAAALHKTFALMDVGGCSSGPSPSNPSHSQANGSTPGKLGGTEIIARGKAD

SEQ ID NO: 84350 - DNA, 783 bp, Zea mays
  misc_feature: Ceres CLONE 1570391
  misc_feature: Encodes the peptide sequence at SEQ ID NO. 84351
  misc_feature (562)..(562): n is a, c, t, g, unknown, or other
ctggagctccccgcggtggcggccgctctagaactagtggatcccccgggctgcaggaattcgtctcacccctagaaaaatccccgcattcccgcagtctcagtcgcacagtgataaagccctcgagccgaggcgacaagaatctctcaagacagccagccacgcacctccgcgccgagctcctccctttgcctaccgcccttcccctccgcgcgaggaaaaagccagcagcaagcaagcaactcagcggagcacggcaaagcaaacgaagagctcgcgttggcgttgccgatttgccgtgccttgcctagctaggttcgccacgacgaacctgacgtgagagcgcggcgaccacccccaccggccaccggcgcgcgagtagcttcctgtcgttcgttcgttccctccgagcgcgtctatttacccccgagagagccggacgcgcgagatggagatggcgggggcggccgaggccgacacgccgtcgcacgagccggtgcgcacgggccggagcaacaccatcctgctccccatcgtcggcgtcctcttcgcctacctgctnctacaggttcctccgccggcgctccgccgggggcctgggcctcgaccgccacgtccccgttcccgtcggggggcctccctgcccggcttggtttccgccggccgggcggcccaagggggagcgcccgtggctgcccttactttcggggcccattgggccgaacagccttcggggggccctgtgccgtaaccttcgggccccctttgggccgaaaccggcct

SEQ ID NO: 84351 - protein, 100 aa, Zea mays
  misc_feature: Ceres CLONE 1570391
MEMAGAAEADTPSHEPVRTGRSNTILLPIVGVLFAYLLLQVPPPALRRGPGPRPPRPRSRRGASLPGLVSAGRAAQGGAPVAALTFGAHWAEQPSGGPVP

SEQ ID NO: 84352 - DNA, 945 bp, Zea mays
  misc_feature: Ceres CLONE 1570392
  misc_feature: Encodes the peptide sequence at SEQ ID NO. 84353
  misc_feature (708)..(708): n is a, c, t, g, unknown, or other
  misc_feature (856)..(856): n is a, c, t, g, unknown, or other
  misc_feature (898)..(898): n is a, c, t, g, unknown, or other
acccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcaggtcagcgctcgtgcctcctcaagagatcatgccgcacgttctcgtcggcgatctgttactacggtggcccgtgtggtacaagttcggctcctgtcgtcacgcgaccgcggtccactcgcaggtgcagtgaccgtgctgctgcctgcgactgcgacngcgaggatccctgggtcgcggcatggctagcgagaatctcgacgaggcatctcgtcgctgttctgttcccactggcacgctacctataagaccttaagcgggcgtcgcccctgctacatgatgtggcgagcgcgcgacttcccgtacntctagcggcgatttacgcggcatgtgggacatcacgtctggncaaaaccctagcctgcgggcctccagcgccctgacttgctctccccc

SEQ ID NO: 84353 - protein, 209 aa, Zea mays
  misc_feature: Ceres CLONE 1570392
  misc_feature: SWISSPROT Homolog: EC 3.2.2.22 rRNA N-glycosylase
  misc_feature (181)..(181): Xaa is any aa, unknown, or other
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSCRTFSSAICYYGGPCGTSSAPVVTRPRSTRRCSDRAAACDCDXEDPWVAAWLARISTRHLVAVLFPLARYL

SEQ ID NO: 84354 - DNA, 848 bp, Zea mays
  misc_feature: Ceres CLONE 1570396
  misc_feature: Encodes the peptide sequence at SEQ ID NO. 84355
ggagctccccgcggtggcggccgctctagaactagtggatcccccgggctgcaggaattcgtctcacccctagaaaaaacggcgcactcgtgttcgtgtcatcccgcccgcaggccgcagtccatggccaccgccagcctcgcgctctcgctgcgcctcgcgccgtcctcgcgcccgctgagcctccgccgccggggggccaccggcgtcacctgccgcgccaccaccgccacgttccaccagctcgacgccgtcgcggtgagggaggaggagtccaggttccggacggcggcggcggagggccgcaacctgctgccgctcacgaggtgcatcttctccgatcacctcacgccagtgctcgcgtaccgctgcctcgtcaaggaggacgaacgcgaggcgcccagctttctattcgagtctgtcgagcaggggtccgagggcaccaatgtggggaggtacagcgtggtcggggcgcagccttctatggaggtcgtggccaaggctaaccatgtgacggtcatggaccatgagatgaagtcgaggagggagcacttcgtgcctgatcccatgaggatcccccagacatcatggagcagtggaacccgcagattgctgacagcctccctgatgcattttgtgaagaaggggttggattcttcccaaaggaaaaatggccgttttttaaaaaaagaaacttcttttcggtaggccccccttgacgtttgggaccctcctgaaattcttttgggccccttaagggccctctttggttttatccgttgaaaaaaaaaaccatgttttccttttggggagaaaaaaaacccttctccttctttgaaaaaaaaaaa

SEQ ID NO: 84355 - protein, 194 aa, Zea mays
  misc_feature: Ceres CLONE 1570396
  misc_feature (66)..(187): Pfam Name: Anth_synt_I_N Pfam Description: Anthranilate synthase component I, N terminal region
  misc_feature: SWISSPROT Homolog: EC 4.1.3.27 Anthranilate synthase
MATASLALSLRLAPSSRPLSLRRRGATGVTCRATTATFHQLDAVAVREEESRFRTAAAEGRNLLPLTRCIFSDHLTPVLAYRCLVKEDEREAPSFLFESVEQGSEGTNVGRYSVVGAQPSMEVVAKANHVTVMDHEMKSRREHFVPDPMRIPQTSWSSGTRRLLTASLMHFVKKGLDSSQRKNGRFLKKETSFR

SEQ ID NO: 84356 - DNA, 873 bp, Zea mays
  misc_feature: Ceres CLONE 1570397
  misc_feature: Encodes the peptide sequence at SEQ ID NO. 84357
  misc_feature (371)..(371): n is a, c, t, g, unknown, or other
tggagctcaccgcggtggcggccgctctagaactagtggatcccccgggctgcaggaattcgtctcacccctagaaaaatccgctctgctccctccgccgtgcgctcgaacgaactccacacgaaattctccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggcgacggctccgccgggaagagcggcgccggcgccggcgccancaagtacctcatcgaggaggaggaggggctcaacgagcacaacgtcgtcgtcaagtgcgccgagatccagaacgccatctccgaaggagcaacttctttccttttcaccgaatacaagtatgtgggactattcatgggcatttttgctgtcctgatcttcctcttccttgggtctgttgagagcttcagtaccaagagtcagccatggccactataggcaagggcaaagacgtgcaaagcctgccccttgccaaaggcttatctttcagcacccatttgccctttgttgcttgggggcaggccaacttctcctttggtttcctgggtttcccttggaaatggaaagatttggcccccatattgcccaaatgccccaggaacaacctctttggaaggcccttgggaaagggggggtgtttggaaaaaaagggcatttttcattttacttggggctttatcccccgcttccctgtgggtggccctgtgtgaaatagggggcctc

SEQ ID NO: 84357 - protein, 131 aa, Zea mays
  misc_feature: Ceres CLONE 1570397
  misc_feature: SWISSPROT Homolog: EC 3.6.1.1 Inorganic diphosphatase
  misc_feature (60)..(60): Xaa is any aa, unknown, or other
MASSAFLPELGTQVVVPVAAVVGIAFAVLQWVLVSKVKLSPEPRRGDGSAGKSGAGAGAXKYLIEEEEGLNEHNVVVKCAEIQNAISEGATSFLFTEYKYVGLFMGIFAVLIFLFLGSVESFSTKSQPWPL

SEQ ID NO: 84358 - DNA, 877 bp, Zea mays
  misc_feature: Ceres CLONE 1570398
  misc_feature: Translation starting site: 225
gcggtggcggccgctctagaactagtggatcccccgggctgcaggaattcgtctcacccctagaaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtggttgggtgagagtggtgctgtgcccatctttgtcaagctactcaactccctcagcgagggatgtcgtgaacaggctgtatgggccttaggtaatgttgctggtgactccccaaagtgcctgatctggtactgggtcatgggggctaatccctttgctgcgcaggcttatgagcatgctaagcttcgaa

SEQ ID NO: 84359 - DNA, 1333 bp, Zea mays
  misc_feature: Ceres CLONE 1570399
  misc_feature: Encodes the peptide sequence at SEQ ID NO. 84360
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (954)..(954): n is a, c, t, g, unknown, or other
  misc_feature (985)..(985): n is a, c, t, g, unknown, or other
  misc_feature (1093)..(1093): n is a, c, t, g, unknown, or other
  misc_feature (1109)..(1109): n is a, c, t, g, unknown, or other
  misc_feature (1323)..(1323): n is a, c, t, g, unknown, or other
aaaaaaaataataaaataatatatattactataacccaccatagtatacttcccccccnnnnnnnnaaaaactggagctccccgcggtggcggccgctctagaactagtggatcccccgggctgcaggaattcgtctcacccctagaaaaaggggcgcctagcttcttactagttttttttttccttgcgcaaagcttgcacttgctgagagagagggagagagaaatccagagataaaggcgcttcattcattccctctcctgctttctctctccaacccatccgtcctctctctccacacataaaaaccaacgaagcgggcgagtgatcaggcaaaggcaccccgcacgaaataaatttgaagaaagcttgacctctgatcagcaggagcacatgggccccatggatggcctccataaccagagagctccctcttctttctagccttcatcctgctggccctccttatctttttacaccaccccgttctccaaatgccacggcacccaacccatggctacctttcagaatgaaaaaaccggcccaaccctttccccccgggccgccctcaagaaaggcccccgtcgcatccgggcaaaaattttttcggacttatattttcggggttattgatcttatgggtaaaatatttttgtgctgtcgctcccaccctatcatggtctactgggtaatgtgttttcccattcgggtttaccgagagtgagaaaaagatatccatcgggcgacgaccgcagcaaactgtgtgttctgacgttggatagtgacgattaaaaaaagtacgtaacgcgatacaacaggttgatgataagaatccaaatacttagacaggtgcggtcatgtgcaattatgacgctcggactctctaccacgttccctcgttgtctcgcctcctcccaggaaaaatgatatagcctagcaccatcaagaatatnactatatcttctcatcacaatactagccacnaacgaaatcattataccacatctcgcacaaccaattatacatttacacatcaccccctctacgcgattgtcactaacctcctagtaagcaagcttgtatttttgatcntccgtctcctactatnatatctggtcgtccctattacttcggtgttggccgctcctactgtcccttctatcccctagcagttcatacggccctacccccgcactaaattattataacgagaccgtagaatagcttatgagacgcgtcttagcgcgtcgcgaatgagtctgatgttaaagcgctgacgcggcgttcgactaatgtataagtctcatcgacaattctttacnattacactcc

SEQ ID NO: 84360 - protein, 39 aa, Zea mays
  misc_feature: Ceres CLONE 1570399
MATFQNEKTGPTLSPRAALKKGPRRIRAKIFSDLYFRGY

SEQ ID NO: 84361 - DNA, 814 bp, Zea mays
  misc_feature: Ceres CLONE 1570400
  misc_feature: Encodes the peptide sequence at SEQ ID NO. 84362
  misc_feature (720)..(720): n is a, c, t, g, unknown, or other
acccgcggtggcggccgctctagaactagtggatcccccgggctgcaggaattcgtctcacccctagaaaaaaaccagtccaccagcgccctgttgatcttccccaagagccggaacccactcaacaccacgtcctccactttcttcgtctagatagttcaaccccacctcctctcttcctcgacacgcacagcaaccacgccaagctcgacccgtcgcccagcggtctgcactaggagcctgcgcccggagttccgtccgcgacgtgctcatcccgccgtcgacggtcatcgtgagcagatatcgggccgttcgtggagtctgagggaattgcaggagaagaccctgagcagcagcagcttggtgaaggttgtccacattgcaaccactgctcaggagaagatgaagctgtggaaggagacttccaggagttccaagactacgacgagtcctaggtgtgggttggcggcaacccccagtcagctgcctgtgaaggccctatctttactgcgtttcgcttagcactttgatttacccattgagttgatgactatgtggatgtctctgacatcgtgatgtaataagttaatactcttctatgttattattcgagcactaaaaaaaaaaacttgcgtggttctcttcctgcgacggaagcaaacactgcccgagacatagacagcgggacgtcgagatggccgacggggaggaacgcgccgncgcgcgccgccggggcgccatcacagactaccggcagaagctgctctactgcagggagctagagtcgcgcgtcggcaccgtgagagaaagcctt

SEQ ID NO: 84362 - protein, 39 aa, Zea mays
  misc_feature: Ceres CLONE 1570400
MKLWKETSRSSKTTTSPRCGLAATPSQLPVKALSLLRFA

SEQ ID NO: 84363 - DNA, 950 bp, Zea mays
  misc_feature: Ceres CLONE 1570402
  misc_feature: Encodes the peptide sequence at SEQ ID NO. 84364
  misc_feature (775)..(775): n is a, c, t, g, unknown, or other
  misc_feature (779)..(779): n is a, c, t, g, unknown, or other
  misc_feature (785)..(785): n is a, c, t, g, unknown, or other
  misc_feature (787)..(787): n is a, c, t, g, unknown, or other
  misc_feature (802)..(802): n is a, c, t, g, unknown, or other
  misc_feature (817)..(817): n is a, c, t, g, unknown, or other
  misc_feature (857)..(857): n is a, c, t, g, unknown, or other
  misc_feature (881)..(881): n is a, c, t, g, unknown, or other
agctccccgcggtggcggccgctctagaactagtggatcccccgggctgcaggaattcgtctcacccctaaaaaaaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacacctttctcttcctcttcgacgacgtgggcgtgccgtccgactaccgccacatggtaagggtcggcgtgaacacgtacacnttcntgagcncngcggggaaagcgcantacgtgaagttcacntggaagccgacgtgcggcgtgcggtgcatcctgacggacnagaagcggcgctggtcggggtacngaacacaggcacgcgaccaggaactgtacgactcatcgcggcgggaagctccccgaatggaccctttcc

SEQ ID NO: 84364 - protein, 269 aa, Zea mays
  misc_feature: Ceres CLONE 1570402
  misc_feature (18)..(265): Pfam Name: Catalase Pfam Description: Catalase
  misc_feature: SWISSPROT Homolog: EC 1.11.1.6 Catalase
  misc_feature (213)..(213): Xaa is any aa, unknown, or other
  misc_feature (215)..(215): Xaa is any aa, unknown, or other
  misc_feature (220)..(220): Xaa is any aa, unknown, or other
  misc_feature (239)..(239): Xaa is any aa, unknown, or other
  misc_feature (247)..(247): Xaa is any aa, unknown, or other
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFLFLFDDVGVPSDYRHMVRVGVNTYTFXSXAGKAXYVKFTWKPTCGVRCILTDXKRRWSGYXTQARDQELYDSSRREAPRMDPF

SEQ ID NO: 84365 - DNA, 892 bp, Zea mays
  misc_feature: Ceres CLONE 1570404
  misc_feature: Encodes the peptide sequence at SEQ ID NO. 84366
  misc_feature (628)..(628): n is a, c, t, g, unknown, or other
ctccccgcggtggcggccgctctagaactagtggatcccccgggctgcaggaattcgtctcacccctagaaaaagttatcgcagggggcattaagctgcctgcctccgctgccggccgtgctacctaatcgccgcgcttgttttcccaccgcccgatggccgccatcacgccgccgacgcagtcggagccgtcgccgcagacggggcgcccggcctcgtctgccgccgccgcggccaagcgtggagggggcggggctggtgccgccggcgggccgctgatggggaagtacgagctggggcgcctcctggggcacggcaccttcgcgaaggtgtaccacgcgcggcacgtcgacacgggggacaacgttgccatcaaggtgctcgacaaggagaaggccgtgaagagcgggctcgtcccgcacatcaagcgcgagatcgctgtgctacgccgcgtgcgccacccgaacatcgtgcacctgttcgaggttatggccacaaagactaagatctacttcgtcatggagctcgtccgcggcggcgagctcttctccccgcgtctccagggccgactcagggagggacacgcgcgccgctactttcagcagctcgtctcccgccgtggggtctngcacgccggcgggggtcttcccacgcgactgaaaccgaagaattactcctcgacgagcagggaacctcagggtatcgattttgggtttcccgcgttccccgagaagtttcgtcccaaaggcttgtttcaaccttttgggggaaccgggcttattggggccccaaaaagcctcggccccccggggacaaaagccccaaagaaaaaattggggcctggggggggttccctcttttgggctctgggcgggaaatttccctttcccag

SEQ ID NO: 84366 - protein, 245 aa, Zea mays
  misc_feature: Ceres CLONE 1570404
  misc_feature (45)..(236): Pfam Name: Pkinase Pfam Description: Protein kinase domain
  misc_feature: SWISSPROT Homolog: EC 2.7.11.1 Non-specific serine/threonine protein kinase
  misc_feature (158)..(158): Xaa is any aa, unknown, or other
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEVMATKTKIYFVMELVRGGELFSPRLQGRLREGHARRYFQQLVSRRGVXHAGGGLPTRLKPKNYSSTSREPQGIDFGFPAFPEKFRPKGLFQPFGGTGLIGAPKSLGPPGTKAPKKKLGPGGGSLFWALGGKFPFP

SEQ ID NO: 84367 - DNA, 847 bp, Zea mays
  misc_feature: Ceres CLONE 1570407
ctccccgcggtggcggccgctctagaactagtggatcccccgggctgcaggaattcgtctcacccctagaaaaagaaccctttcttcctcttcctcccccagtatactccaattcccacgtactcttcctccttgttctcctcctcctctctccctctctctcgccagaggatccaagaagtaccattgcagctcgctccattcgttcccaatcccaacacagcctctcagctgagctcagctcagctcagctcagggagttcccctgcttgtttttgctctagtgctcttggctgcctcagaaaaggactgcatgtgcagcagctgcaaagatagaatttctttatttttttcaccccaccttctcccaaggtgctgttggtgccccaggtggaggcaactggcgaagtgtgtgcgttctttgcttgatcaactaggttaagccatttcttgccccagtgttctccgattcatggttgtggaactagtccgaaaaaagctggagctgctccttttccctgcaagaaaacaaaggcgggggggaaggcgaacctttgaagcggtaactggtgcgcgccctgaaggcgggcaatacaaggtcgtctttcctggataaccgaacgggcctggcggcgggaacctggaaattggtgaaaggggggcggcgctccccccgggggggcgcccacattctttcccccccttgggcccggggggcaaatatatttctttgcccgttctttcaaaaacccttgtcttgtgggaagagcggtccaaaaaaccctctttttaattaggttggggggaaaagatacggggtgggccccctcaaagagggggggcccca

SEQ ID NO: 84368 - DNA, 931 bp, Zea mays
  misc_feature: Ceres CLONE 1570412
  misc_feature: Encodes the peptide sequence at SEQ ID NO. 84369
ctggagctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagacctgaccggcaaaatatcaccctcgaggtggagtcttcagacaccatcgacaacgtcaaggccaagatccaggacaaggagggcattcccccagaccagcagcggctcatctttgctggaaagcagcttgaggacgggcgcacgctgggcgactacaacatccagaagagagcacccttcacttggtgctgcgcctcaggggagcatgcagatcttcgtgaagaccctgactggcagatatcaccctcgaggtggaggcttagaaacatctgacacgtcagggccaaatccaggacaa

SEQ ID NO: 84369 - protein, 159 aa, Zea mays
  misc_feature: Ceres CLONE 1570412
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKT

SEQ ID NO: 84370 - DNA, 911 bp, Zea mays
  misc_feature: Ceres CLONE 1570413
  misc_feature: Encodes the peptide sequence at SEQ ID NO. 84371
  misc_feature (911)..(911): n is a, c, t, g, unknown, or other
ccgctctagaactagtggatcccccgggctgcaggaattcgtctcacccctagaaaaaacgagtcgagggtttctctcctgcgcggcggctacctctctccacggcggcggcgggcgatcctgcagatcccgcggctccctccgcgattcgagactcagatgggggaaggcacagagagcggcggcggggcgaccacagcgccgcctctgaggtatataaggtgctacaagtgcgggttctgcgacgtggtccggtccaagaagtgcttgctccgcgcccacgtgcttgagcaccacaaggatgaggtggatgctttggggggttactgggaaggtggagatgctggtccgcgcaaagagatcagccgtgcgtgcgaacagtgcgggatgagcttcaagaagccggcgcatctgaagcaacataatgcagagccattcgctcgagatacagatgtgtgaagcattggatctcaaagaactccaaaatgcgaagaaggccctttgaacggaactagttaccaggatggggaagaccctccctggagaaggctccatcaaggaagttccttcattcacgcctattctttcaggtgggggtgtttttgaagctattcttaagctggcttggctgcttttttttgtgttaatagggttccctggtcccctgaacatatggctaaaggggtctggtcctgagaattgccaaggctccttttttccacacaatgttggggcgtccggccggctccagataaatatttgatgaagttggaggaattttaccccctggggctgttcttgttgaggtatattttaggcttgttccccttttgactggctcgccacttttgtggcagggggtttatttatcgccccgcctatttgcgaacccacactttcttgttctttcn

SEQ ID NO: 84371 - protein, 99 aa, Zea mays
  misc_feature: Ceres CLONE 1570413
MGEGTESGGGATTAPPLRYIRCYKCGFCDVVRSKKCLLRAHVLEHHKDEVDALGGYWEGGDAGPRKEISRACEQCGMSFKKPAHLKQHNAEPFARDTDV

SEQ ID NO: 84372 - DNA, 826 bp, Zea mays
  misc_feature: Ceres CLONE 1570414
  misc_feature: Encodes the peptide sequence at SEQ ID NO. 84373
ctccccgcggtggcggccgctctagaactagtggatcccccgggctgcaggaattcgtctcaccccctagaaaaaaccctagaaaaaaagactcaatacacaagcagagctcaaacaattcttgcttcccgctagctagctcgcaagaaataatggctccacttcttcttgcttctcgcacagcctgtcatcctggccttacaagcagccgccatgataatggccggcacggcctttcttcttcaccgggaagtagtagtaagcgaagccgtagccttagcttcataccacgagctgaaaagacgacgacaggcggtgagggtcatgttgtgagcgaaaagctgagcccctggcaaatccccaggagggagtggttcccccctagctttatctttggtgccgccacttcagcataccaaattgaaggcgcttggaacgaaggtggcaaggggccaagcacttgggacgacttctgccacaaatatccggagtggatagcggacgggagcactggggatgttggagcgaactcctactacctgtatagagaggatgtcagattgctgaaggagatgggtatggacgcctacaggttctctatcgcttggtccagaatactgccaaaggggacgctcgagggaggcattaaccataaaggcatcgagtactacaaaaggctcatcaacttgttgaaagagaacggcatagaaccatatgtgacactttttcactgggacacacctcaagcgctggtggacagctacggtggctttctagatgacaggattgtaaaagaatacacggactttgcccaggtgtgctttga

SEQ ID NO: 84373 - protein, 224 aa, Zea mays
  misc_feature: Ceres CLONE 1570414
  misc_feature (71)..(224): Pfam Name: Glyco_hydro_1 Pfam Description: Glycosyl hydrolase family 1
  misc_feature: SWISSPROT Homolog: EC 3.2.1.21 Beta-glucosidase
MAPLLLASRTACHPGLTSSRHDNGRHGLSSSPGSSSKRSRSLSFIPRAEKTTTGGEGHVVSEKLSPWQIPRREWFPPSFIFGAATSAYQIEGAWNEGGKGPSTWDDFCHKYPEWIADGSTGDVGANSYYLYREDVRLLKEMGMDAYRFSIAWSRILPKGTLEGGINHKGIEYYKRLINLLKENGIEPYVTLFHWDTPQALVDSYGGFLDDRIVKEYTDFAQVCF

SEQ ID NO: 84374 - DNA, 919 bp, Zea mays
  misc_feature: Ceres CLONE 1570415
  misc_feature: Encodes the peptide sequence at SEQ ID NO. 84375
ccccgcggtggcggccgctctagaactagtggatcccccgggctgcaggaattcgtctcacccctagaaaaaagcccaagcaggcttctccgactcccgtcccccattccgtccgccaccgccttccctctccctcgaatcattcgattcgcctcccgtcgtctcgtccgcctgattctactcggccgtcacggtgatcggagccggctagggttagggttccgtacttccgttgatctccacgcccatggtgcagctgccgagctccggtaagcggcacgcggaaccggccgagcagacgatggctccggcgcggcgcgcggcggcggtcaagctggaggtggaggagctcggagccaacgagcgcggcccgctcagcaagcgcgccaggccagctcagccgatgcccccgacgcctccgcagccgcagcaggatatgtaccacaatgtacttgatgaacctagcccattgggtctgcggctgaaaaaaagcccatcactcttggatttgattcagatgagactttctcaagcatccaacgctggggagtcttccatgggacaacagtgggttctgagcccttcaaagaagaaagacagttaaatcccggtgttggtcttcagcaagcggaacgggttaaaagcctccgaattgttccggcaaattatatggaagattgggttcatggggagtatggtcccacgggtatgaaaggtgaatttggtggggcgaatggttaccttggcaaagcaaaaacatgggggggggaaatcccggaaggggggcctaaaaaggaagaaaagaaatccagggggcgtaaattggcgcgcttgaaggcaatttgcccccgaaaagggccaggaaccctgggaccggggggtgggccaggccccctttttttcttataagaaaagaacc

SEQ ID NO: 84375 - protein, 118 aa, Zea mays
  misc_feature: Ceres CLONE 1570415
MVQLPSSGKRHAEPAEQTMAPARRAAAVKLEVEELGANERGPLSKRARPAQPMPPTPPQPQQDMYHNVLDEPSPLGLRLKKSPSLLDLIQMRLSQASNAGESSMGQQWVLSPSKKKDS

SEQ ID NO: 84376 - DNA, 803 bp, Zea mays
  misc_feature: Ceres CLONE 1570417
  misc_feature: Encodes the peptide sequence at SEQ ID NO. 84377
ctccccgcggtggcggccgctctagaactagtggatcccccgggctgcaggaattcgtctcacccctagaaaaaacacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgattcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcgctgcagcttgctgaagtctttacttgctgcattctgtgctcacacttttgaaagctgctctcttctgctctgcgttgttgatttctgcactcaagcttctcttgcctgtgcactcaagctcctctcttcctgggcaactagtgatctccttgaagcatttcagcttttacctagagatctttctgttgttgctgaaagcaagaaaagctttaaggtggatggcccaaactaacctggcctcc

SEQ ID NO: 84377 - protein, 29 aa, Zea mays
  misc_feature: Ceres CLONE 1570417
MSAEVAGGHPYFLSCYFWFIYCIKFRDFT

SEQ ID NO: 84378 - DNA, 990 bp, Zea mays
  misc_feature: Ceres CLONE 1570421
  misc_feature: Encodes the peptide sequence at SEQ ID NO. 84379
  misc_feature (990)..(990): n is a, c, t, g, unknown, or other
gcggtggcggccgctctagaactagtggatcccccgggctgcaggaattcgtctcacccctagaaaacagcccacggtatgtgcaggtatttgattctcagtagcagcggcatctccatccagaccccggtcggctagccccaacgccgccgccgccgccgccgcccgccgctcggggattgcctgctttcctctgccgaccacatctacaccgcacaactggtccttccaagtgagcttcaatcccctgcgtgtagatggagagggttctcaaggatgacgccgtcgaggagaagggcgaccgcgccagaatggcatcgtttgttgggggcatggcaatctcggatttgggcaagaccacattgggtccaaaagaatgggccaacaacctgccaatcactgggtagagggcgtaatgttacctgttacaaaggatgggggttcccctttttagaggtccctttcacaattgaacaatcctgccggccaaagggtcctttttttgaccttcccaaaaatttcccaaatgaaataaaatttgggtgaatggggaacaaccttttctttttgttttttttctaaccctgggaaaacctttttttaagggggggggctgtgaaaaattttattttttaccgtggggagaaattttctttccccgaggggaatatttttttttgcggggggtttacaaagaaaggggggtccttccggagggtgtgcccaaaaaaaatttttttttttttcaacaaaaaaaaccgcgtggggccacaacgagagaaaaaaacccccttttgttttttctaggggcggctcccccccgaaaaaaatggtgttgtaaaaactcctccttttgtgtagagaaaaaatattttcttccccaaaaaaaaaggaaacttttttctcgaaataatcggggggagagagctccctcttgggggttgtatggggggccgcccccctctgggagatattttccttagtcgtggn

SEQ ID NO: 84379 - protein, 49 aa, Zea mays
  misc_feature: Ceres CLONE 1570421
MERVLKDDAVEEKGDRARMASFVGGMAISDLGKTTLGPKEWANNLPITG

SEQ ID NO: 84380 - DNA, 979 bp, Zea mays
  misc_feature: Ceres CLONE 1570422
  misc_feature: Encodes the peptide sequence at SEQ ID NO. 84381
  misc_feature (845)..(845): n is a, c, t, g, unknown, or other
ctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggccaccaaagcggggggcaacagcagcgggatccccgtgctggtcgacgaagacgacccgctcgcgctcgaatcgtttctaaacatcactctggtgaaaaaagcagggcgctccgtaagcttgaagatggatgtatccagagcctacttcgggggttacgtaacagggcagcgctcctgcctcctcaagagatcaggccgcacgttcttcgtcggggatctgttactaccgtgggcccgttggggaaaaagttcgggctcctggtctttatcccaaccgcggtccccttctttaggggcagtgaacctttgctgctgcccggggacggcgaaagggaaagtatcctttgggtccccggcctggccaagcgaaaagattctcaaaaaggccttctcgttctggttccttggtcccccctggggacccctccttttaagaaccttatgggggggcgccncccccctcaaacttatggtgcaaaggggtgataattccccctacttcaagagtggaataacccccgcttgtggaaaataaagggtgtgcaacaaccccaccttggggggcccaggccgctggacagggcccccc

SEQ ID NO: 84381 - protein, 251 aa, Zea mays
  misc_feature: Ceres CLONE 1570422
  misc_feature: SWISSPROT Homolog: EC 3.2.2.22 rRNA N-glycosylase
  misc_feature (226)..(226): Xaa is any aa, unknown, or other
MKGGTQAVSLMVHLAVPWLCLASWAALLPALASGNVGAAAPILRADYIKLNFSTASATPDKYKSFIASVRAGLATKAGGNSSGIPVLVDEDDPLALESFLNITLVKKAGRSVSLKMDVSRAYFGGYVTGQRSCLLKRSGRTFFVGDLLLPWARWGKSSGSWSLSQPRSPSLGAVNLCCCPGTAKGKVSFGSPAWPSEKILKKAFSFWFLGPPWGPLLLRTLWGGAXPLKLMVQRGDNSPYFKSGITPACGK

SEQ ID NO: 84382 - DNA, 876 bp, Zea mays
  misc_feature: Ceres CLONE 1570426
  misc_feature: Translation starting site: 194
  misc_feature: SWISSPROT Homolog: EC 1.4.1.2 Glutamate dehydrogenase
  misc_feature (515)..(515): n is a, c, t, g, unknown, or other
  misc_feature (516)..(516): n is a, c, t, g, unknown, or other
ctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatanngtgtcagcacaaggggggaggagaaacaagttgcagccgaagagatcctctccctggttctcatcaagatgcgtggaaacgctgaaagctacctttggcagcacgatcaaaaatggctgttgtaaggggtccctggcttacttcaacgacttcaaaaagccaggcccccaaaagaatccctgggggaaatgcctgcccccaaagggccggcggtaccaacaaagaacccacccccctgccgcctattgcccatggggctctgaaaaaaaaggcaccccaccccccgggaaaaaaaaaagcccccccccttttacccctggggaggggggacccctcgaagtgccccccccccttataaag

SEQ ID NO: 84383 - DNA, 938 bp, Zea mays
  misc_feature: Ceres CLONE 1570430
  misc_feature (938)..(938): n is a, c, t, g, unknown, or other
ggccgctctagaactagtggatcccccgggctgcaggaattcgtctcacccctagaaaaaaccccccacagcttcctctcgtgcaggtttctagctcgcttgttgcctcctcctaaccgtaaagcccgcctcctttggcgatcggtgcttgcttgcttggttccttcacttcctgcttgagccagcgagagctagctgctgctgtcgtgtggttcaccttgtcttgcttctgatagcctaggtcgattcttctctctgtgggttcatcgtagggatactcatctgcggggaaagagatacgactatagacttgcgcgaccgagaccgtgggaggatgtgacgaaagacccgctcgtcaccgttctcccccccgagctggagatcacccccacaatcctcgacaactgcgtttggtattgcccaattcccacactacgaacttccggatcaccaatagccaggaccctcctcgaccgaaaggaaaaaattcacaaggattgtgcgaccagttcgatgaatccaaaaggcatactttggaccccggctgagaaatttcccgggcgtagaaaaccacaagaagggggtcccttaccctggcggccctccccttggaaaccccccccaaagatctgggtgatgtttcgggaggttgtcctaaacctttggaaaaggggggcgggtgccacaccctggaaaaaacaaacttggggggggggcccaaaagggtggggacctctcccctcatgggtgatattccctcccgttgtcccggggggggaaaacaccgtgtcgccttgaattgattatgataccactctctcgggttcatcgcggaccttccaaattttcccctctcgtatttaggaacacaccccgggtacgtattattcttgtggaaaaaatcatctcttttcctggcattaaaacgatttgcgagn

SEQ ID NO: 84384 - DNA, 887 bp, Zea mays
  misc_feature: Ceres CLONE 1570431
  misc_feature: Encodes the peptide sequence at SEQ ID NO. 84385
ggagctccccgcggtggcggccgctctagaactagtggatcccccgggctgcaggaattcgtctcacccctagaaaaaacctctctcgaaactttccccaatcccatctcctgccccccctctcccaaccctatccacgccgccgccagccctgctcgggtggtgcgcatacatgaaccatccgtcctcgtcgtcgtcctccgcccagccgccgccagcccacggcggtgtgcggccgaggcctacctcccctcgcgccgggcttccgcttccacccaccgatgaggagctcgtctcctactacctcaagcgcaaggttctcgggccgccccgctccaagtttgaagccatcgcccaaagtgggacctttaaaaaactccaaagccccgggggaaactgtgccgggcccgggttcccggccttccggtagccgggggaaaatcccccagggggtgatattttttttaaaaaccggccctttaaaaaccacaaaaagaaactgcctaaaactgtgagccccggggaaacaaaaacctggggcgcaaagtttttggggggagggggggatccctctggaaaaaaaacaacaccaccccgcgagaaaaagagaaaacaagggggggggggtgggcccccccctatggtgggcccccacaaaaaattttttttgtcggggaggataataaaaaaaaaagaaaagacgcctcctttttcttttcctcccaagtggggggaggaagacaccccccccccccaggggggggtgaaagaaaccccccccccacctgggtgggggttatccacacaaaaaaaaaaacccccccccctccgcgaggggagataaaaaaccaccccccgcttggggtataataccaacgaggagattt

SEQ ID NO: 84385 - protein, 85 aa, Zea mays
  misc_feature: Ceres CLONE 1570431
MNHPSSSSSSAQPPPAHGGVRPRPTSPRAGLPLPPTDEELVSYYLKRKVLGPPRSKFEAIAQSGTFKKLQSPGGNCAGPGFPAFR

SEQ ID NO: 84386 - DNA, 811 bp, Zea mays
  misc_feature: Ceres CLONE 1570433
  misc_feature: Encodes the peptide sequence at SEQ ID NO. 84387
  misc_feature (381)..(381): n is a, c, t, g, unknown, or other
ctccccgcggtggcggccgctctagaactagtggatcccccgggctgcaggaattcgtctcacccctagaaaaaaccccacgccttgtctctgaactctgatcagagatcaaagaggtagccgttaagttaacgatggcttccgccgacctcgcagaggccatgaagcccgggaagaagagcaacgtcaagtatgcttccgtctgtgccatcatggcctccatggcctgcgtcatccttggctacgacattggtgtgatgagtggggcggcgatttacatcaagaaggacctgaagatcacggacgtgcagctggagatcctgataggcatcatcagtctctactcgctcttcggatccttcgctggcgcgcggacgtccngacagggatcggccgccgctttgaccgtcgtcctcccccgccggtcatcttttttcgtgggcgcgttgctcaggggcttcccctcaacttagggatggccatggtgggccccttccttccccgatttggctggggctccggggggctaatccccccccctttcccccccaaaaatttccccgggggggttcccccggggttcccccaggtcctttccccggaaagttttattaaaacccggggaaccccggcggggggtacccggggaaaaaataacgctttttgggggggccccccccccccccccctcggggggggggtgttttttattccgggaatttgggggggggggcgccccccccccccctggtttgtggggccccccgggggtggttttttacacccccccaaataacccccctcggggggg

SEQ ID NO: 84387 - protein, 112 aa, Zea mays
  misc_feature: Ceres CLONE 1570433
  misc_feature (83)..(83): Xaa is any aa, unknown, or other
MASADLAEAMKPGKKSNVKYASVCAIMASMACVILGYDIGVMSGAAIYIKKDLKITDVQLEILIGIISLYSLFGSFAGARTSXQGSAAALTVVLPRRSSFFVGALLRGFPST

SEQ ID NO: 84388 - DNA, 879 bp, Zea mays
  misc_feature: Ceres CLONE 1570434
  misc_feature: Encodes the peptide sequence at SEQ ID NO. 84389
  misc_feature (879)..(879): n is a, c, t, g, unknown, or other
ctggagctccccgcggtggcggccgctctagaactagtggatcccccgggctgcaggaattcgtctcacccctagaaaaaacgccgccgacggttccgcccctgcgtactctaggtatcccgtgtccaacggtccacccccaccgcaaccgccgtccgtccgtccgcccgccgccgcaccctgctagggtttcggccaggccggatccgccgccgcctgtagattctcctatccgaccgcggcgcctcgagccgcaccggcaacctcggacctgaatacctgatacactgcacttcttcagtccgcaggaccacagcacgcacaattgttcttcaatctgcaggactgcagccgcgcacaagccgtagctgtttccttggaactttgagctttggaagatgccaaggagaacaggaaatgctgctccaaccaaatcagctgaattggtcaaacaagaccaattggagtttgatgatcctgacgaggtagatgaagaggaagaagttgagtatgaagaaattgaggaggaggttgagtatgaagaaagttaaagggaggaagcaccgaagtcttctttttatcgaagattaagaatacggcacgtgatgtcagaattttttatgtgaatggaatgaacactataatggcatatcaccattgtaattgttttaagtctgttaacaaaacagcctggaggaagctaattagaattggcgcagaggcgtgaagagagagaataatataggaaagtgaaaatgtaataaaaaagaagggtaggaaaggaagccatgaaggcaagtggtaaataagagcaaaaactgaacattaaaagacccctgtcagtcccttgaacgcgaagacagggtatattaatcatan

SEQ ID NO: 84389 - protein, 50 aa, Zea mays
  misc_feature: Ceres CLONE 1570434
MPRRTGNAAPTKSAELVKQDQLEFDDPDEVDEEEEVEYEEIEEEVEYEES

SEQ ID NO: 84390 - DNA, 871 bp, Zea mays
  misc_feature: Ceres CLONE 1570436
  misc_feature (406)..(406): n is a, c, t, g, unknown, or other
  misc_feature (417)..(417): n is a, c, t, g, unknown, or other
ggagctccccgcggtggcggccgctctagaactagtggatcccccgggctgcaggaattcgtctcacccctagaaaaagcacgaccaaaggcaagcgggcggcagactgccttcactctcactcccgcccgtgtccctcgccctgtccgcgctgcggtgcgccctccctgcgccgctgttaatggaaacggcgcggcgtttccttcccaccacctcctcctcctcctcctgcacggcctcttcttcactacgattcgccgcttctccgctcttcttctccttcccctgcagataaagcggctggttgccctggaagccttgcggtggagacggtctcggtctcgaatccaggggagacacgcggatttgctgccatggtgaggtggggcgagatggtggaggaggnagggaggaacnacgagtacgctaagctggtcaggaggatgaatcccaccgagagtggtcatcgacaaacgactcgtgtgggcacgcaactgtcatccggggttgatagggtcaataaagcatggcattttacctggaaagcagttcagggcctttgtccatcttcaacctcctcattcaccaaggcttaccttttcttccgaccggcaactgggttcattgcatgttgttccaaggtgaccgatcaaggacggggagtaaacctttcctaaacggggagggtcttggaccattttttcggaaaatgcctggaaatccaaacgggcttaccttgtttcttcccggccaaaagggtttattcccctgcccggaaagaaccagtttcacctcccattttaaccttaaaggggcgccgaaaccgcccggggcctctctcttcttaaaagggggtggccccccggccctc

SEQ ID NO: 84391 - DNA, 845 bp, Zea mays
  misc_feature: Ceres CLONE 1570440
  misc_feature: Encodes the peptide sequence at SEQ ID NO. 84392
ctccccgcggtggcggccgctctagaactagtggatcccccgggctgcaggaattcgtctcacccctagaaaaaagctgatcaacagctagcttcattcctctgcctctctctccctccttcgccaactggccatctctgttgtctctcgctagctagctcgctcgctcgctcgccagtcaccacacacacacacacacactgtgtgtctgtgcctgacgccgccccccagtttcaaacgaacgacccagccagaaacgcgcgcgcgccaaagctacgtgagtgacgtggcagcatggtgagcatgatcgccgacgagaagccgcagccgcagctgctgtccaagaaggccgcctgcaacagccacggccaggactcgtcctacttcctggggtgggaggagtatgagaaaaacccatacgaccccgtcgccaaccccggcggcatcatccagatgggcctcgccgagaaccagctgtccttcgacctgctggaggcgtggctggaggccaacccggacgcgctcggcctccgccggggaggcgcctctgtattccgcgagctcgcgctcttccaggactaccacggcatgccggccttcaagaatgcattggcgaggttcatgtcggagcaacgtgggtaccgggtgaccttcgaccccagcaacatcgtgctcaccgccggagccacctcggccaacgaggccctcatgttctgcctcgccgaacacggagacgcctttctcatccccacgccatactaccccaggttcgaccgtgacctcaagtggcgcaccgggcgcgaagatcgtccccgtgcactgcacgagcggcaaacggcttccgg

SEQ ID NO: 84392 - protein, 183 aa, Zea mays
  misc_feature: Ceres CLONE 1570440
  misc_feature: SWISSPROT Homolog: EC 4.4.1.14 1-aminocyclopropane-1-carboxylate synthase
MVSMIADEKPQPQLLSKKAACNSHGQDSSYFLGWEEYEKNPYDPVANPGGIIQMGLAENQLSFDLLEAWLEANPDALGLRRGGASVFRELALFQDYHGMPAFKNALARFMSEQRGYRVTFDPSNIVLTAGATSANEALMFCLAEHGDAFLIPTPYYPRFDRDLKWRTGREDRPRALHERQTAS

SEQ ID NO: 84393 - DNA, 930 bp, Zea mays
  misc_feature: Ceres CLONE 1570442
  misc_feature: Encodes the peptide sequence at SEQ ID NO. 84394
atagctggagctccccgcggtggcggccgctctagaactagtggatcccccgggctgcaggaattcgtctcacccctagaaaaagcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagatggccttatggctgctccaacggggaagaatgtgcgccttcagaggagggctaacttcagagtaaaagcggctaaggagctgtacttcaacaaggatgggtcagctatcaagaagctccagactggagtcgataagcttgcagacctagttggagttactctcggaccgaagggaaggaatgtcgctttggagagcaagtacggctctcccaagattgctaacgatggcgttacagttgcaagacaagttgagctggaggaccctgtggaaaacattggagctaaattggtcacgcaagctgcagctaagaccaacgatcttgctggagatgggacaaccacctctgtggtccttgctcaggagctagattgctgatggtgttaaggtcgtagcagctggtgctaatcctgttcagattaactcgtggtattgagaaaacagctaaagcactagttgaagaactacgaacgtgtcatagggaggtgaagatagtgagcttgcagatgttgctgcagttagtgctgggcacactatgaaatgggtacatgacagcggagacatgaaccaggtcgtctgaaaggcgtgtcaccttgaagaaggaaggattccgaaactttcccaaggtggggaaggatgcaatttgacgggtttcctccctcgcccttgtaacaaaatg

SEQ ID NO: 84394 - protein, 135 aa, Zea mays
  misc_feature: Ceres CLONE 1570442
MASTFGATSTDGLMAAPTGKNVRLQRRANFRVKAAKELYFNKDGSAIKKLQTGVDKLADLVGVTLGPKGRNVALESKYGSPKIANDGVTVARQVELEDPVENIGAKLVTQAAAKTNDLAGDGTTTSVVLAQELDC

SEQ ID NO: 84395 - DNA, 842 bp, Zea mays
  misc_feature: Ceres CLONE 1570445
  misc_feature: Encodes the peptide sequence at SEQ ID NO. 84396
  misc_feature (393)..(393): n is a, c, t, g, unknown, or other
  misc_feature (693)..(693): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (803)..(803): n is a, c, t, g, unknown, or other
  misc_feature (804)..(804): n is a, c, t, g, unknown, or other
  misc_feature (816)..(816): n is a, c, t, g, unknown, or other
  misc_feature (817)..(817): n is a, c, t, g, unknown, or other
tggagctccccgcggtggcggccgctctagaatagtggatcccccgggctgcaggaattcgtctcacccctagaaaaagttcttctctctccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgttcaactnggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgaatcatgggggcctcggcgtcatcagttggtacaaccctcaagtgtcgcacccgaccaaagaagcgccccgtcatcgactaacagctcgcgttgctcctccagcccatgcttatgctcgcattacccatcggcgtaggagttcagcgtcantctctccataatgggctaatcactgtcctcaatataatcctccttcgtaggcacccctgtctcagatccttctacaaggcaaattctgaggnnnnnnnntgagggagagnntcagattctatnntgaacaccccgcggaaaaaagcaat

SEQ ID NO: 84396 - protein, 124 aa, Zea mays
  misc_feature: Ceres CLONE 1570445
  misc_feature (22)..(22): Xaa is any aa, unknown, or other
  misc_feature (122)..(122): Xaa is any aa, unknown, or other
MASASACPRAHRASGPTSRSTXRVVVATVVGFLGSAFGTVGGVGGGGIFVPMLNLVVGFDTKSAAALSKCMNHGGLGVISWYNPQVSHPTKEAPRHRLTARVAPPAHAYARITHRRRSSASXSP

SEQ ID NO: 84397 - DNA, 873 bp, Zea mays
  misc_feature: Ceres CLONE 1570447
  misc_feature: Encodes the peptide sequence at SEQ ID NO. 84398
ccccgcggtggcggccgctctagaactagtggatcccccgggctgcaggaattcgtctcacccctagaaaaagtgctgccgccagatctaaccaaaccccgcgccctcctcaccgtccggcgagctacggactcagcagatcaccgtcgctcgagttgtacctgaaggcgcgcccgtggaaccggccgcgagataagggcggcgggaaggcgggcgacgatgccggtggcagcgtcggccatctacttcctcaaccttcgcggggacgtcctcatcaaccgcctctaccgtgatgatgttgggggaaatatggttgatgcgttcagaatgcatatcatgcaaacaaaagaacttggcacatgccctgttcgtcaaataggaggctgctccttcctttatatgaggatcagtaatgtttacattgtgatcgtagttagcagcaatgctaatgttgcatgtgctttcaaattggttggcgaggcggtggctctcttcaagtcctactttcgggggaagcttttggatgaaaaccctattcgggaataacttttgttttggaaatatgaaacttccttgatgaaaaccgggggattttgggtttttcctcaaaaacctggtcaccctggaaaattttgaaagttggttttttaacccccaaaaagggggggttcgggcaacccatttttccctccaaagccccccaaagaaacccgggttccaaaagggcgaactctttcagatcccatgggcgcccttttgggtttggaaaaaaaacaagggaatttttggttacaaaaaaaaaaatgagggttttttttgtgggcacatatgtttgagagagggaaaaacccctcttttatgggctctttaaag

SEQ ID NO: 84398 - protein, 108 aa, Zea mays
  misc_feature: Ceres CLONE 1570447
MPVAASAIYFLNLRGDVLINRLYRDDVGGNMVDAFRMHIMQTKELGTCPVRQIGGCSFLYMRISNVYIVIVVSSNANVACAFKLVGEAVALFKSYFRGKLLDENPIRE

SEQ ID NO: 84399 - DNA, 792 bp, Zea mays
  misc_feature: Ceres CLONE 1570450
  misc_feature: Encodes the peptide sequence at SEQ ID NO. 84400
ctccccgcggtggcggccgctctagaactagtggatcccccgggctgcaggaattcgtctcacccctagaaaaaatccttcgaccaaaacggcagctcctttctcccgcggcgttgccgtcgcactcgcacgcacgcactcaccgccggcctgagcctaatcctaatcctaatccacataccgggacaatccagacgaacgagcgaaccaacgcacggacggccaccagccgctgcgtgcgttcgctttcccccgaaacgtgacccgagccaagcttcagagagagaaaggagaagccgccatgaagcagcagcagctgcagctgcctcctagtcgtcccagttaaatccgtgctcgccaagccacgactacgagcacctgccccggtttttctcctcccgcccccgttccccgtcccgactcccgaccgacccaacccatatcagagattccttccttggtggcgctggcgttcccgtgaggcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccacgcctcctccgagtacagcgccagcgccgtggccgacgactcgcccaggaagccgccacaggcgcccgccaccacggacgcccacgcgccgccgcccgccaccgccaccgtcaccgccgccatgaggcgcggcggggccggcgcgccgcctga

SEQ ID NO: 84400 - protein, 76 aa, Zea mays
  misc_feature: Ceres CLONE 1570450
MGNACGGALRSKYQHSFKHAASSQRHASSEYSASAVADDSPRKPPQAPATTDAHAPPPATATVTAAMRRGGAGAPP

SEQ ID NO: 84401 - DNA, 899 bp, Zea mays
  misc_feature: Ceres CLONE 1570454
aagctggagctccccgcggtggcggccgctctagaactagtggatcccccgggctgcaggaattcatctcacccctagaaaaaatacttcgagcaatacggcagctcctttctcccgcggcgtagccgtcacactcgcacgcacgcactcaccgccggactgagcctaatcctaatcctaatccacatactgggacaatccagactaacgagcgaaccaacgcacggacggccaccatccgctgcgtgcgttcgctttcccccgaaacgtgacccgagccaagcttcagagatagaaaggataagccgccatgaagcagcaccagctgcagatgcctcctaataggctcagttaaatccgtgctagacaagccacgactacgagcacctgccccggtttttccccccccccccccgttccccgtcccaactcccgaccgacccaacccatatcccagattccttccttggtggagctggcgttcccgtgaggcggcccgcgcgcgaacgcggacgtgaccgaacgtccggagcttcatgcgccaagggcggcagctccaccccgtcgtttgatgggcaacgcatgcagcggctcccttaaatccaagtacaaatacagcctcaagcacgccgcaatcgtcgcaaacgccacacctcctccgagtaaagcaccagcgccgcggtccgacgacctccccaagaaaacccaccacaggggacccaaccaccatcgaaatccccaaagcgccaggcgacccggaaaacggccacattccaaatatcaaaaaatttaaggccccttccgggggacccggtaaagcccagcccgggaacaatggaggtgtccctttgatttctggccccacctccatactccccacaaaacttccccggcaaaag

SEQ ID NO: 84402 - DNA, 769 bp, Zea mays
  misc_feature: Ceres CLONE 1570455
  misc_feature: Encodes the peptide sequence at SEQ ID NO. 84403
ccgcggtggcggccgctctagaactagtggatcccccgggctgcaggaattcgtctcacccctagaaaaagcccgctagggttttagtgtttttagcctcctgcgtgactcccctgtgccctcaacacttctctcctccacctcttctagacagccgctgccacccgaaaccttctcgcagagacgctatgtgggctctccgccgaactaggaaacccctgaggttccatgcccaaaaagttgtgagtccccgtggttgtgcgagccttgaggtgctgctaactgctgagacaaaaaatgtcgaagaacaccatgaggcagactgtcagaaagtgagctactgtcataagcacaaagccaccatacttctaattatcatttacatctggccaatttgcttggagtacgagtttctcatctcagccaggtgcaaattctagtgactacgatgatgagttagaggatgtattggatgatctcaatgctccaccacaagctggtaaaaaggatgctgggttgacatctgaagatacttctgatgagagatgccactgatgatattggcttgactagtatggatgctgatgcataagctgagacagagcacattatatagacttttggtctcacccttctcaagactgtgttggaagctccaacgcatcaagacacttcagcgcttgagaaatgcgcagaggatggcaatgcacttgataggggcgaaatcgattatgtgctcctcaatcctcgaaagcggaagtggtacact

SEQ ID NO: 84403 - protein, 83 aa, Zea mays
  misc_feature: Ceres CLONE 1570455
MWALRRTRKPLRFHAQKVVSPRGCASLEVLLTAETKNVEEHHEADCQKVSYCHKHKATILLIIIYIWPICLEYEFLISARCKF

SEQ ID NO: 84404 - DNA, 827 bp, Zea mays
  misc_feature: Ceres CLONE 1570459
  misc_feature: Encodes the peptide sequence at SEQ ID NO. 84405
tggagctccccgcggtggcggccgctctagaactagtggatcccccgggctgcaggaattcgtctcacccctagaaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatccccatcaacctggtggtgggccgtgatcgcggaggtcatccctcgtcggccggcgccgattactaccgggatcacccaacggactggaccttagaggacaagcctgcacccccggtggggccccttccaacccccctggggcctgggccaagcgaacccccaacccagggccggccattccttta

SEQ ID NO: 84405 - protein, 231 aa, Zea mays
  misc_feature: Ceres CLONE 1570459
  misc_feature (83)..(221): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLNYFGNSIPINLVVGRDRGGHPSSAGADYYRDHPTDWTLEDKPAPPVGPLPTPLGPGPSEPPTQGRPFL

SEQ ID NO: 84406 - DNA, 756 bp, Zea mays
  misc_feature: Ceres CLONE 1570460
  misc_feature (1)..(1): n is a, c, t, g, unknown, or other
  misc_feature (11)..(11): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (284)..(284): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
nagagataaanaaccaattatataaaagggaaaggggttgaaagggatcccggggnnnnnnnaaaatttttcaactggactcccgcggtggcggccgctctgaatagtggatccccgggctgcaggattcgtctcacccctagaaaaaccgtcttgccttctcttctctacctgccgcacccgcacagccacagccaacacacaccccacatcacaacactcctctgcatctcgcctcgtcccgtctctgctgcacaccttctctcatctctctcctcttcgcntgccacctcccagcaccgaggaaagcaaaacccccaccccaggaattctccgttcccgctttcccggggccgcccgtcccctttctaataaatccccattcccgaatccgggtttttttggggggggtttttttttccccgggttttttaggggggggggcccccccaaaaaaaaaataaaaacccccccccccctttttttagtgggggggggaaaataatatgtgctccccccaaaaaaaaaaaaaaaaaaaaatattttgttggtggggcctcttctttgttggcacaacccccaccctcttttttttgcgtataaaaaaaaaaaaacaaccacccccccccccccctctttttttttttttttnnnnnngggggggggggggggagcaaccctttttttctttgttttcccccccggggcgaaaaaaaaaaaaaaaaaaaaannnccccccccccctttttttttttt

SEQ ID NO: 84407 - DNA, 841 bp, Zea mays
  misc_feature: Ceres CLONE 1570462
  misc_feature: Encodes the peptide sequence at SEQ ID NO. 84408
ctggagctccccgcggtggcggccgctctagaactagtggatcccccgggctgcaggaattcgtctcacccctagaaaaacccttctgctttgccttttccccttcctctctcccctgtcccccctccgtcccagccgagcgagaaagcgaaggggccaaaaaagccgcaccggcttccttcccccacccgaagagatggaactgttctacgaactgctcctcacggcggcggtcaccctcctcgctgccctcctgctcgccacgctcttcgcagccaatgattcccatcgccggaccgatcgcgccgcagccgcgatcgccgaggaggtggcggaggaggagaggatcatcgaggtcgacgaggtgatgcgtagcgaagggatggcggcggtggcgccgtcggaggcggatgggtgggttgaggcggagaaggcgccggcggtggtcgtcgcggaggtgaaggagccggaagccttgcccgaggaggagggggttcccgtgaaggctgttcgggaggtgcgccttgcttgccggaaatggaggagggggaggaaccgtggtggcggccgtgaaaccggcctgattttgaccccccaacggttcgtggcagcgggggggtgcttgaagcaagccagctgggggtcggggggctgaaggttgttgcctaaaggagggtttccgggtgccggcagggtttggaaagaaaccaaaccctgcccggaatatttgttggggcaaaccacctatgaagcccgggggtgccctaaagagcaaccttctgtgttttcccccatataaaaatgttctcacatagacaaggaaaccggagatcaaaacaac

SEQ ID NO: 84408 - protein, 152 aa, Zea mays
  misc_feature: Ceres CLONE 1570462
MELFYELLLTAAVTLLAALLLATLFAANDSHRRTDRAAAAIAEEVAEEERIIEVDEVMRSEGMAAVAPSEADGWVEAEKAPAVVVAEVKEPEALPEEEGVPVKAVREVRLACRKWRRGRNRGGGRETGLILTPQRFVAAGGCLKQASWGSGG

SEQ ID NO: 84409 - DNA, 922 bp, Zea mays
  misc_feature: Ceres CLONE 1570464
  misc_feature: Encodes the peptide sequence at SEQ ID NO. 84410
ccccgcggtggcggccgctctagaactagtggatcccccgggctgcaggaattcgtctcacccctagaaaaaaaaggctgcggcctgcggccgtcgcagtcccatcgattcctcccgcttggctttcccacccctcgaagccgaatccgatggttccacccgttgaccgcctccgccatcggaggccgcgccgcctcatccccgccttcttcctcggtccccgcgcccgcctcctcctagagatataccgcccgcgcatcgctccatggcggtcggcggacacgacaacagcatggagcgggacttcgccgccaggctgcgcctgacgcattcgccctccccggccacgcctgccgccgccgcctcatcctcccccaccgcggctggggggatcaccttccgcgcgccgcaggagcagttcaccgccgacgacttcctactcggcaagatctactgcgtcggctcgtactccaaagtggtgcggggcaagaagaaagacactggtcgcgtactcgcgcttaaaatcatgaacaagaaattcatcgccaaggagaacgagatctcctacatcgagatgcagcgtattgtactcgaccagctcgacagcctggcgtcatcacgctcttctgcagtttaaggacagatactccctctacatgtcactctagtcccgcgaacgccggaagatattctgacaaagtgttcaggagaagctgctctctgatgacgatgcacgctctatgctgctgaactgttgatatatagaagtacttgcatggactgtcctagtactccgggtgccaagccgcaaagtcacgcttactttggatggggccatcagattgccgactttggtgggaggagcctgcagggataccctctcaaagtctcccaatccacttctgtaaaggccgttcctttt

SEQ ID NO: 84410 - protein, 123 aa, Zea mays
  misc_feature: Ceres CLONE 1570464
  misc_feature: SWISSPROT Homolog: EC 2.7.11.1 Non-specific serine/threonine protein kinase
MAVGGHDNSMERDFAARLRLTHSPSPATPAAAASSSPTAAGGITFRAPQEQFTADDFLLGKIYCVGSYSKVVRGKKKDTGRVLALKIMNKKFIAKENEISYIEMQRIVLDQLDSLASSRSSAV

SEQ ID NO: 84411 - DNA, 861 bp, Zea mays
  misc_feature: Ceres CLONE 1570465
  misc_feature: Encodes the peptide sequence at SEQ ID NO. 84412
  misc_feature (85)..(85): n is a, c, t, g, unknown, or other
ctggagctccccgcggtggcggccgctctagaactagtggatcccccgggctgcaggaattcgtctcacccctagaaaaaaaaanacccaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgacgacgtcggccttgcccccggcggggaccccttcgtggcgtgcaacgagtgcgccttccccgtctgccgggactgctacgaatacgagcgccgggagggcacgcagaactgcccccagtgcaagactcgatacaagcgcctcaagggctgccagcgtgtgaccggtgacgaggaggaggacggcgtcgatgacctggacaacgagttcaactgggacggccatgactcgcagtctgtggccgagtccatgctctacggccacatgagctacggccgtggaggtgaccctaatggcgcgccacaagctttccagctcaaccccaatgttccactcctcacaacgggcagatggtggatgacatcccaccggagcagcacgcgctggtgccttctttcatgggtgggtgggggggaaagagatacatcccccttccttatgcggatcccagcttac

SEQ ID NO: 84412 - protein, 195 aa, Zea mays
  misc_feature: Ceres CLONE 1570465
  misc_feature: SWISSPROT Homolog: EC 2.4.1.12 Cellulose synthase (UDP-forming)
MEASAGLVAGSHNRNELVVIRRDGDPGPKPPREQNGQVCQICGDDVGLAPGGDPFVACNECAFPVCRDCYEYERREGTQNCPQCKTRYKRLKGCQRVTGDEEEDGVDDLDNEFNWDGHDSQSVAESMLYGHMSYGRGGDPNGAPQAFQLNPNVPLLTTGRWWMTSHRSSTRWCLLSWVGGGERDTSPFLMRIPAY

SEQ ID NO: 84413 - DNA, 953 bp, Zea mays
  misc_feature: Ceres CLONE 1570467
  misc_feature: Encodes the peptide sequence at SEQ ID NO. 84414
ggagctccccgcggtggcggccgctctagaactagtggatcccccgggctgcaggaattcgtctcacccctagaaaaaatccatccatccaaccgctcctccctcgtccggcaggcgacgactcgattccttcctcccttcctcctcctcgtctctttcatcggcgactccgatcttctctgccgtcgccgccgccgccaagagatcgacccgaccccgagcgcccgacccgaccccccaatccaaccaccaaccgccggcgcgcgcggaagattcagatttggcccctcgccggtaagggagaaagcgaggatgggtgcgtggatgtcgcgcgtgtggttcctcatgttcccagcgcgggagtacaagctcgtcgttgtggggctcgacaacgcggggaagaccaccacgctctacaagctccacctcggcgaggccgtcaccgccgcgcccaccatcggcagcaacgttgaggaggtcgtcttcaagaacctgcgcttcgaggtctgggatctaggagggcaagaaagcctgcgcacttcgtgggcgacgtactaccggggaacacacgccgtgatcgtggtgatcgacagcacggaccgcgcccggatcaacatcatcaaggacgagctgttccggctgctgcagcacgcggacctggagggcgcggtggtcctggtgttcgcgaataagcaggacctgaaggacgccatgggcaccgcggagatcaccgatgccctctcgctcacagcattaaggacacgactggcacatccaggcctcgtgtggcatcaccggcgatgggctctacgacggcctgggctggatcgcgcagaaagtcgccggcaaggcgaccgcgagctgacgtgcaggagagcattggttgtgtgttcatgaaccgattggattgttgaaaggtaagggtgggggccaaggccggttttggtttctct

SEQ ID NO: 84414 - protein, 194 aa, Zea mays
  misc_feature: Ceres CLONE 1570467
  misc_feature (5)..(184): Pfam Name: Arf Pfam Description: ADP-ribosylation factor family
MGAWMSRVWFLMFPAREYKLVVVGLDNAGKTTTLYKLHLGEAVTAAPTIGSNVEEVVFKNLRFEVWDLGGQESLRTSWATYYRGTHAVIVVIDSTDRARINIIKDELFRLLQHADLEGAVVLVFANKQDLKDAMGTAEITDALSLTALRTRLAHPGLVWHHRRWALRRPGLDRAESRRQGDRELTCRRALVVCS

SEQ ID NO: 84415 - DNA, 752 bp, Zea mays
  misc_feature: Ceres CLONE 1570469
  misc_feature (13)..(13): n is a, c, t, g, unknown, or other
  misc_feature (313)..(313): n is a, c, t, g, unknown, or other
  misc_feature (350)..(350): n is a, c, t, g, unknown, or other
ggcggccgctctnaactagtggatcccccgggctgcaggaattcgtctcacccctagaaaaagttacatcgccctacccgccgtaccacatgccagacgctggccaccggcttcgccgccgcagcgactacatcgggggtgtgcagcctcccatcagactcccgccagcgccaaacccttcgactcggcgatggccacaccggataagaagcatacccacctgccatggtcgcggaggaggtgagggcgtgaggctgactggcgattggacccgtccccccattccacccgtcgtcgccgacgtgtctgtccnaggtgagtccgccaacgagtacatataaaagtcatcnagggaaaggttgttcgcccaaaagctttaccaggactcgtggactatccacaaaaagaattattttttattaaccggaattttggggtggattttggaccttggggggatggccagaggggaaaaccatcctagggatttgaggatcccgaggcttcttaactgacttttataaaaaccaggcccgggggtaatttttggtcccaaggggttggctaaaatttttgctttaaccttggggcattctggagaaacaggggtccccccccctttcctttaatggggggggccccgctttttttttcccacccccacccccctgtaaaaagaaagcccttttcgaggggggcgggggaaaccccaaggccccaaaaaatttttcttggttccccaaaaatttgat

SEQ ID NO: 84416 - DNA, 896 bp, Zea mays
  misc_feature: Ceres CLONE 1570471
  misc_feature: Encodes the peptide sequence at SEQ ID NO. 84417
ggcggccgctctagaatagtggatcccccgggctgcaggaattcgtctcacccctagaaaaagtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggccccttcgccggcgacgagccgcaccaggcgtacatgtgtacacccagcccaggcccttaactgcgcccgcccctgcgactggttttcctgctggtttctgtggatttggctgccggaggattggtgcagcctttaggatcacggtagattcgctgtgaaatccgaagggtgctcaggtcatgttgggggaccagcgcatgatactgggcttagactcggcaacctcatcaagcactgcccctgatttgacccgcgctgaagaggatccttctgtgagcaggagctgcgtgatcgaccgcctgcaggtggggtgggcgcagaaaggaggacaggtggagggtctggtgaattgttatagcaagaagaagaaaagaccggcagtggttcgaggaatcttgcagccagagcctggtcctccgagatggagggttctgatgagggggggagaaatcaacacgggcgacctcatcggcgggatcggcaggtagttggccatttcatgcctgctccgtcttccccgggcttatatttaagagggggcaggggttaaccatctttctacccccttgggaggttgggggaactttacaagttgaagcctgaaggtgggaaccctccagcaaatgacctactggcccatgcaaagttccccaaaggggaaggtgttgtta

SEQ ID NO: 84417 - protein, 102 aa, Zea mays
  misc_feature: Ceres CLONE 1570471
MLGDQRMILGLDSATSSSTAPDLTRAEEDPSVSRSCVIDRLQVGWAQKGGQVEGLVNCYSKKKKRPAVVRGILQPEPGPPRWRVLMRGGEINTGDLIGGIGR

SEQ ID NO: 84418 - DNA, 1195 bp, Zea mays
  misc_feature: Ceres CLONE 1570472
tttttgttttggggggggctactccgcaggccgcgccgggccccccccattttttatgttgattctcaacaaagaatgggctccccgcggtggcggccgctctagactagtggatcccccgggctgcaggaatgtcgtctcacccctagaaaaagttcacatcgcactacccgccgtaccacatgccagacgctggccaccggcttcgccgcctcaacgactacatcgggggtgtgcagactcccatcagactcccgccagagccaaacccttcgactcggcgatggccacaccggatacgaagtcatacccacctgcaatggtccgcggcggaggtgagggcgtgaggctgactggcgattggacaccccacctcgttccacccgttcggggcctacgtgtccgtccaaggtgagttccgccaacgagtacctttaaaagccttcggggaaggttgggcgccccaaagccttatacagagtccccccccttatgcgaaaaagaggtttttcccctctcaactgaaatcttcggggaagcctcgtttctccctttgcactttaatgacgagaagggcaagaacagattcattcgcatttctctatcccctaagccaaccagaacgggattgttcataaaaaagcgcgtatcgcgggtgagcgagaaactatcctaactctgggttccatcgaagttcttccgcgttagaggctttgcagctaattttggtgaaaatacaatgggatacgcggtacgcgcccgtgcggatttagagtcatacgaccccacgctcagttattgtgtatccataagttagcacgcacatcagatctatcacttgaaactgccggcttcctggagctgccttgtctgcaataacagcagatgggcaaatgcgaattatctaggccggtttctgctggaatctctcggctcgcagaggacgaacccctgcgaggcgagaggggaaggtgacggccgcacgcgacagaagattgtgtgtaggtctgcaaacttaggaataaatgataaaagattttacaatgatatataataaagtaaaacgacatatatctagagatcccgataggttctgtgctcctaccggattcagacacaaccctcccctggcgggaagtgagagtgggagaccgactaacgtctcacacaaatactcttcaacaggttgtctgat

SEQ ID NO: 84419 - DNA, 827 bp, Zea mays
  misc_feature: Ceres CLONE 1570475
  misc_feature: Translation starting site: 715
tccccgcggtggcggccgctctagactagtggatcccccgggctgcaggaattcgtctcacccctagaaaaaacctgtcgttgctctccgccgccaccagtgcccgtagcgctcgccgccgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccggcctcgccgtccgcttcctcgtgccgcggccggccgaggtaaccccagaggcctggcagctcctctccatcttcctctccaccatcgcggggctcgtcctcggcccgctccccgtcggagcgtgggcgttccttggcctcacagccaccgtcgccacccgcacgctccccttcaccgccgcgttcggggcgttcactaacgaagtcatctggctcatcgtcatatccgtcttgctcgcgcgcggctttgtcaaaacggactcggcgaccgcgtcgccacgtacttcgtcaaatggatggagcgcagcactttggggctatcctatgggctttgcatcagcgaggctctcatctccgctgtcatgcccagcaccacggcaggggctggacgtgtttttcatccccatcg

SEQ ID NO: 84420 - DNA, 1179 bp, Zea mays
  misc_feature: Ceres CLONE 1570476
  misc_feature (938)..(938): n is a, c, t, g, unknown, or other
  misc_feature (1071)..(1071): n is a, c, t, g, unknown, or other
ctccccgcggtggcggccgctctagaactagtggatcccccgggctgcaggaattcgtctcacccctagaaaaacaccctcccacccgcctcgcctccatcctcagcgaccacgcccatcttcgctctgtagcgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacgtcgtgagcgtgcatggcaactaaacaaagcagggcttggttctagataaaccaaaattcagggggtccttccgggaaaaccatttctagattgggcctgggcccattcaaaggcctaataacctcagaatggaggagggcccacccagttttttggctttaaagcaggcttcccgggaatggacatgttttttcccgaaactttccacctccttttttggaaaaaaaggtggaaaaaaagggggccctggaaaacgggggccccttgggcgtggaaatttattccccttgtgaatagcgcccccaccccctccttttttgatgtgtggaacaaaatctttcctccgggggtggcgtttctctcccaagagaagagaaatatatctccccgcgatattttgttgcctctctctctccccaggtttttacccacaaaggggggcccggggtggaaactgttgtgggacccctcaagaacacctacccctcccttcttgtggggctcgttatgtgggagagagaaacaaaaaggccgcacggctgggggagcccacaaatatttcntcttgtgggggggaagcccctccacaaattggcgcgtgtatagggtggaaaaaccccgagagaccctcctcattatatagaattctcccaaaaccagggtgggaggagactgtttcttcgaagaacacctgtntggcttgaggagaatgtgttgggcccaccaccatagaggtggcgctttttggcccgcccgcggagggaggtggtgcgggtttctatttctgcccgggattttttacaa

SEQ ID NO: 84421 - DNA, 871 bp, Zea mays
  misc_feature: Ceres CLONE 1570478
  misc_feature (475)..(475): n is a, c, t, g, unknown, or other
ggagctccccgcggtggcggccgctctagaactagtggatcccccgggctgcaggaattcgtctcacccctagaaaaaacggcagtccgcaccgcacacacacgcacaggcagcagcacagcgatctgccttctgctgtgccccgcccccatccagcccagagcagcagcgcgcggtgccggccggcaaccgcagctggtcggtcatcaggtctctgggcctccacctcctccttccccctctcaaccctccccgtgtcgcctcctcccgaatcctcacacgtagccccgcgcgccacctcgctgccggccgccggcacacagatatagagagagagagagagagactgagagagagagagggaggggaagcgaagagaccagaacaagagcgaagatggtccgactcctccccgagaacaatgccgcggcggagacggacgtcctcctcgacgcctgggacttcaaggggcggncgggcccgcgcgccaccaacgggcggctggggcgccgccgccatgatcctagtggcggagctgaacgagcggctgacgacgctgggcattcgcgtgaaacctggtgacgtacctgaaggggaaccatggacctggggcaacgccgaagtccgccaaagttggtccccaaatttactggggaccctcctttcatggctttgcctccctcggggggttttcgttgcccaaattccttccttcggccggctaacctcaaccattggccaatcttttacccggccgttccagggcgcttgggggcggtgaacaaaattccttagaaaatattttaaaaagggggggccccccggggggctataggggccggggggttttctttgtttctccgaaaaccgg

SEQ ID NO: 84422 - DNA, 877 bp, Zea mays
  misc_feature: Ceres CLONE 1570479
  misc_feature: Encodes the peptide sequence at SEQ ID NO. 84423
  misc_feature (406)..(406): n is a, c, t, g, unknown, or other
ccccgcggtggcggccgctctagaactagtggatcccccgggctgcaggaattcgtctcacccctagaaaaaaagctccttcgcctcgaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatacttaagatgtgggaaagtgagcatccagccgcccaggggttctgtgagttggctgagctccnagatcgtgaggtaggagatgaactacctcccgtgtcatcataggcggcgagttactcaagaaagcaatgatcttgggaagaataggatccttcccacctctaaaacaggggcaccaggctggctatgcttgaaggctggcaaattttttgaggaaaaattacccttcaggggttaaaaattgggaaaaaaatcccttaaaaccttggaaaaaaagaagtgttttcaaattgtttaaaaggggccggggtttttttttgaattttggggtggtgggggggtttcacacccgggggaaaaccaagggcccggggggaggggtggaaattccctccccggggggcgccttttttttaaaaaacctcgggtgaaaacacccccaggagaaatatttttgggggtagagagggtgtggcaaaaaaaaccgagggggcggggctctttaagaggggcctcccccaaaagaaaatccc

SEQ ID NO: 84423 - protein, 98 aa, Zea mays
  misc_feature: Ceres CLONE 1570479
  misc_feature (85)..(85): Xaa is any aa, unknown, or other
MAITAPTPDILGERQSGQDVRTQNVMACGAVANIVKSSLGPVGLDKMLVDDIGDVTITNDGATILKMWESEHPAAQGFCELAELXDREVGDELPPVSS

SEQ ID NO: 84424 - DNA, 951 bp, Zea mays
  misc_feature: Ceres CLONE 1570480
  misc_feature: Encodes the peptide sequence at SEQ ID NO. 84425
ctccccgcggtggcggccgctctagaactagtggatcccccgggctgcaggaattcgtctcacccctagaaaaagcaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcccccaaggatcagcatctactcttgattgtggactttgtcgcatctgatatcaacttcataaatctttatccaagatggcgctgcaaaacattggtgcttcaaacagggatgatgccttctacaggtacaagatgcccagaatgattaccaagatagaaggccgtggtaatggtatcaagacaaatgttgtgaacatgtttgacatagcaaaagcacttgccaggccagcttcctacacaaccaagtactttggatgtgagctgggtgcacagtccaaatttgatgagaagacaggtatttccttgggtaacgggggctctggatactgcaaagctggctgggctccttgaggtattctccaagaggatggccatgtgtaggggggtggaatcctgaaacagagattctcctctcaaaacccagatgaattcctgaaatgggcgcccgggggttcctctcataatgtgatttgaggacaagcttcaaacttctttttaaataccccccgaaacaaaaaaggcggaataaacaaaaggcctgagaaagctgaaaggacg

SEQ ID NO: 84425 - protein, 91 aa, Zea mays
  misc_feature: Ceres CLONE 1570480
  misc_feature (1)..(92): Pfam Name: eIF-5_eIF-2B Pfam Description: Domain found in IF2B/IF5
MALQNIGASNRDDAFYRYKMPRMITKIEGRGNGIKTNVVNMFDIAKALARPASYTTKYFGCELGAQSKFDEKTGISLGNGGSGYCKAGWAP

SEQ ID NO: 84426 - DNA, 796 bp, Zea mays
  misc_feature: Ceres CLONE 1570481
  misc_feature: Translation starting site: 164
  misc_feature: SWISSPROT Homolog: EC 1.4.1.2 Glutamate dehydrogenase
ctggagctcaccgcggtggcggccgctctagaactagtggatcccccgggctgcaggaattcgtctcacccctagaaaaatctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagcaatgattgttgtccagcacaagggtgaggagaagcagtttgcagctgaagagatctcctctatgggtcttatcaagatgcgtgagaatgctgaagcttaccttgggtagcacgaatcagaatgctgtggtcacagtccctgcctacttcaatgactcccaaaggcaggccacaaaggatgctggggtgaatgcctgccctaatggggctgccgtttcatccacggaggccacaggctggcacttattgcccttgggccctgaacagaaaaggtacccaggggtcggggaaaaaaaaaaggcccccctcccttggaaacct

SEQ ID NO: 84427 - DNA, 803 bp, Zea mays
  misc_feature: Ceres CLONE 1570484
  misc_feature: Translation starting site: 157
  misc_feature: SWISSPROT Homolog: EC 3.4.25.1 Proteasome endopeptidase complex
  misc_feature (499)..(499): n is a, c, t, g, unknown, or other
  misc_feature (549)..(549): n is a, c, t, g, unknown, or other
  misc_feature (550)..(550): n is a, c, t, g, unknown, or other
  misc_feature (641)..(641): n is a, c, t, g, unknown, or other
tggagctccccgcggtggcggccgctctagaactagtggatcccccgggctgcaggaattcgtctcacccctagaaaaaaaaccctacacccgcccgccggcgcactcggggaccgtcgaatcgagcaggttgacggaggagaggaagcctcgaagatgttccggaaccagtacgacaccgacgtgacgacatggagcccccaggggcggctgttccaggtggagtacgccatggaggccgtcaagcagggctcagcctgcgtcgggctccggtccagcacccacgccgtcctcgccgccgtcaacaagcccgcctccgagctctcctcctaccagcggaaggtgttccgcgtcgctgaccacgccggggtcgcgctcgccggcctcaccgccgacggccgcgttctctcgcgcttcctccgcaacgagtgcatcaaccactccttcgtctacgaggcgccgctccccgtctccaggctcgcgctcaagctcgccgacnaggcgcaggtttgcacacagcggtcatggaagaggccctatgggtgtggnncctctagttgctggactggacgagtcaggggctcatctgtactacaactgccccagcgggaactactttgagtaccaggcattcgcattcngttctcggttcccagccggccaagactttcctgggaagccaaggttccagggctaccaatgaactaccccccggagccagttatcaagggacccccttttcggccataaagggaaaccccttcagggtgaaaaaacttttccactccaaatgggcggggggg

SEQ ID NO: 84428 - DNA, 984 bp, Zea mays
  misc_feature: Ceres CLONE 1570485
  misc_feature: Encodes the peptide sequence at SEQ ID NO. 84429
acccgcggtggcggccgctctagaactagtggatcccccgggctgcaggaattcgtctcacccctagaaaaaagcccaccccaggtcgccacgcccgccacaagaagcagcagccttacccgaaccgaagacgaaccctaccgcgccttgatatcatatcgtctccgtgtcgttctcgcagcgcagcgagcgagccacgcgctcctgcgcagtagcgtaatggcggtgcaaggcggcgaggagagggagagcgggaagggcgccgccccggcggtggtgtcaggcggcgaggcgggcccgccgggccggaggacggcgaggggccacccgctcctgcgcggcgggtggaggcgcgaccggtacacgcacgggatgcggccggcgcagatggaggcgctccgcgccatgtgcggcgcgctcatcccctcgctgcccgccgacgccgacgccggccgcggcgacccgcccggcggcaaggacctcgagcgcttctacctcgcctccgcggccgactccaccatccccgacgaggtcgcggagctgatggtgacgcggtgcatccgcgaggcggtggcgctggcgtgagtggtgctttgggcgctgagcacgcgggcgggcacgctgctgctgtgcggccggctcagcctcggcgccggcttcccccacgtgcgcaagttcgccgactgggcgccagaacggcgggaggcggccctgcggcgctggaaccgggtgcgctggcttctcccgctccgcatcggctttcgcatcgtgaagatccctctgccactacgttttcttacccctgggtgaacaaaaaccccgaagaatccttactgggaaagcgatgggatacatcgggggtacaacgcaccgggagagatccggggtccggaaggggaaccccttcgtccgttcccgggccctttgacattcgggggtgtggggaaaacaagggcggttgggaagcacaacaaaaggtggctt

SEQ ID NO: 84429 - protein, 121 aa, Zea mays
  misc_feature: Ceres CLONE 1570485
MAVQGGEERESGKGAAPAVVSGGEAGPPGRRTARGHPLLRGGWRRDRYTHGMRPAQMEALRAMCGALIPSLPADADAGRGDPPGGKDLERFYLASAADSTIPDEVAELMVTRCIREAVALA

SEQ ID NO: 84430 - DNA, 819 bp, Zea mays
  misc_feature: Ceres CLONE 1570486
  misc_feature: Encodes the peptide sequence at SEQ ID NO. 84431
  misc_feature (695)..(695): n is a, c, t, g, unknown, or other
ggagctccccgcggtggcggccgctctagaactagtggatcccccgggctgcaggaattcgtctcacccctagaaaaaaaaaaaaaaaaaaaaatccccccattaatttaaggggtttttatgtccaccgccgccgccagcgccaactaaacccgcgacgacggtcgaccatggcgtcctcgctgctctcctcccccgctaaacccaccatcaccaccaccaccaaaacgaccccggccccaagacccgcccgctccgcccatgtccatgtcctctcggccgcccgctgcctccgcctccgcctccgcgcgtcgtcgcagcatcctccgcctccgcccaccccgcggtcgcggcggccggagtacgtcccgaaccgcatcgacgaccccaactacgtgcgcatcttcgacaccacgctgcgcgacggggagcagtcgccgggcgccaccatgacgagcgcccagaagctcgtcgtcgcgcgccagctggcccgcctcggcgtcgacatcatcgaggccgggttcccggcctcctcccccgacgacctcgacgccgtgcgctccatcgccatcgaggtcggcaacccggcgcccgccggggaggacgccgccgtccacgtgccggtcatctgcggcctctcgcggtgtaaccggagggacatgacgccggctttggggaagccgtgccccccaccncgccgggccccggattccccaccttcatcggccaccaggcgacatttcacatggcggattaaagcccaagaaaaaaccccccgaaccagggtggttccgccatttgccccaggggaaaaatgga

SEQ ID NO: 84431 - protein, 123 aa, Zea mays
  misc_feature: Ceres CLONE 1570486
  misc_feature: SWISSPROT Homolog: EC 2.3.3.13 2-isopropylmalate synthase
MTSAQKLVVARQLARLGVDIIEAGFPASSPDDLDAVRSIAIEVGNPAPAGEDAAVHVPVICGLSRCNRRDMTPALGKPCPPPRRAPDSPPSSATRRHFTWRIKAQEKTPRTRVVPPFAPGEKW

SEQ ID NO: 84432 - DNA, 832 bp, Zea mays
  misc_feature: Ceres CLONE 1570487
  misc_feature: Encodes the peptide sequence at SEQ ID NO. 84433
ccccgcggtggcggccgctctagaactagtggatcccccgggctgcaggaattcgtctcacccctagaaaaagcactgcgtccctgtcaggcctgctaagctccagccaaaaaatcgttggcctcggtctggtgcctgctcctcctgccgtcctcgctcctccccacctcccgcggcctcccacgcgacatgattgcattgcgggctgccgcggagctcagctctcctgtcctgccaccaccacgccgctgacgatgccttcctctcgcctgcctctgcctgcgcacaaccgaaacggctagcccgcccttcctcccctcccctttgcttccgcaccaagatttgggcgggcgttccttcttccgataaagttgacacccgtcgtctcgtcgtgggcctggcagatactgataggtggtctggttcgtgacttgttcagtcctcctctccaggtgccgagccagggtgactgttccgaggagcgtggcgtggacccatggggaagaagggcaagtggttcggcgccgtcaagaaggtcttcagccccgaatccaaggagaagaaagaggagaggctaaggaggaaatcagcagctagcaacccagcaccggtagatctgaccccatctacctccctggaaagtcatgtttcggtgccaccccctccggctcctccctcaggttcctcgccagaccgacgagggtcagggtcccccaagccgaagcaggaagcagagcaaggcatggtcacccctggaggaggccccctggcttgttggcggctgcccccaacacaagggcgtcgggggctggcaaccctgggtggcgccaaa

SEQ ID NO: 84433 - protein, 112 aa, Zea mays
  misc_feature: Ceres CLONE 1570487
MGKKGKWFGAVKKVFSPESKEKKEERLRRKSAASNPAPVDLTPSTSLESHVSVPPPPAPPSGSSPDRRGSGSPKPKQEAEQGMVTPGGGPLACWRLPPTQGRRGLATLGGAK

SEQ ID NO: 84434 - DNA, 898 bp, Zea mays
  misc_feature: Ceres CLONE 1570489
  misc_feature: Encodes the peptide sequence at SEQ ID NO. 84435
ggagctcaccgcggtggcggccgctctagaactagtggatcccccgggctgcaggaattcgtctcacccctagaaaaagccgcacaatccatccatccatctattctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctccccccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaagcagggtgagggctcaatcgattgtgacgcctttaaaccgagttgaccaccctgagaaaagagatgctctgtacgctatggagctggctcttgcccctggaaagctggtcaatgagaagctgcacaacctgcatggtgtgggcaacaaggtgcaatgatcctcagctgaacgacttcctcaggagggaagtccttccagggagcaggtggaaaccataaacaagaatttccaagtatgtcgcccaacctgaggaaaatggc

SEQ ID NO: 84435 - protein, 202 aa, Zea mays
  misc_feature: Ceres CLONE 1570489
  misc_feature (90)..(201): Pfam Name: Ferritin Pfam Description: Ferritin-like domain
  misc_feature: SWISSPROT Homolog: EC 1.16.3.1 Ferroxidase
MLRVSPSPAAAVPTQLSGAPATPAPVVRVAAPRGVASPAAGAACRAAGKGKEVLSGVVFQPFEEIKGELALPPQSPDKSLARHKFVDDCEAALNEQINVEYNASYAYHSLFAYFDRDNVALKGFAKFFKESSDEEREHAEKLMEYQNKRGSRVRAQSIVTPLNRVDHPEKRDALYAMELALAPGKLVNEKLHNLHGVGNKVQ

SEQ ID NO: 84436 - DNA, 827 bp, Zea mays
  misc_feature: Ceres CLONE 1570492
  misc_feature: Encodes the peptide sequence at SEQ ID NO. 84437
tccccgcggtggcggccgctctagaactagtggatcccccgggctgcaggaattcgtctcacccctagaaaaagtaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctggggcagggggccgttcggtcgcctcgggaacggccgcgaggacgacaagctggtccccaccgcggtggcgcccgcggtctctgccagcgggacaccgcggcccaggttcgtcgccgtcgcggctggtgcctaccacagccttgcgctggacgatgaaggttcactctggtcatggggttacaatctctatggtcaacttggctatggggaccagaattccctttttccatgtttcgttgagcaatttcaggatttaggttctcctgaaacactgaatgatgaagaccagaacacacgtggtcgcacttgtttgaagctgtcttctgtcacagctggtggcatgatgtcgcttggcatagacagtttggggagcctttggatgtggggggagttgcccacagcagactgatgccggagagttttgtatttcaagtagctctatcccactacctgtgtgggaattccatggacacacccgttgtttaaagttgcctgtgggtaacgagcatgtagtagcctgcagtttagtggctggggagaaccaatactggaaggggaccctttttta

SEQ ID NO: 84437 - protein, 162 aa, Zea mays
  misc_feature: Ceres CLONE 1570492
  misc_feature (21)..(76): Pfam Name: RCC1 Pfam Description: Regulator of chromosome condensation (RCC1)
  misc_feature: SWISSPROT Homolog: EC 2.7.11.1 Non-specific serine/threonine protein kinase
MPPKVVAVAAGEAHTLALTGDGQVYSWGRGPFGRLGNGREDDKLVPTAVAPAVSASGTPRPRFVAVAAGAYHSLALDDEGSLWSWGYNLYGQLGYGDQNSLFPCFVEQFQDLGSPETLNDEDQNTRGRTCLKLSSVTAGGMMSLGIDSLGSLWMWGELPTAD

SEQ ID NO: 84438 - DNA, 972 bp, Zea mays
  misc_feature: Ceres CLONE 1570495
  misc_feature: Translation starting site: 761
  misc_feature: SWISSPROT Homolog: EC 3.2.1.39 Glucan endo-1,3-beta-D-glucosidase
ctcaccgcggtggcggccgctctagaactagtggatcccccgggctgcaggaattcgtctcacccctagaaaaaataaccccaagttgccttcacacctctgcctgactgcctgcctccactcccctcccttcccttcccgtctcttcttcccccttccacttcttggccgagcccctcttggtgttggcatcctgctcgatcgaagaatgctggatcaggcatattggaggttgcagtaaaggcggtaggtgcttttcttcttccccgttggtggttagagggactggggagaactacaacagattggaggctgcaagttctcgggaggagccgggcttctcttgcggcggcaaacatgaggaagctcttcttcgtctacctcgtcctcctgctggccgctccactagttcacggtgaagatggtcgtacattggcgtgaacattggcacggccatgtcgtcggtcccggcgccgacgcagatcaccacgctgctccgctcgcagaacatccgccacgtccgcctctacgacgccgaccccgccatgctagcggcgctctccaacaccggcatccgcgtcatcgtgtccgtgcctaacgagcagctgctgagcatcggctactccaaacgcaaggcgggccaactgggtggcgcgcaacgtggccgcgcacttccccgccgtcaacatcacggccatcgccgggggcttccgaggtgctccccccgcagcccaacgtggcggcgctgtctccggcccgcatggggtaccctcccgaaagcgcttggtgggcccggcgcctggaccgggtccttaagatctctaaggcccgattggtcgtccaaaaaccttcaactctttccccccgtctcaaggccttctctcaaaataggcccctgtgaaaactggcgttgggtgcctatcctacatttctcgtgtgtctcaaggggtgttccccccctatgtgctaaag

SEQ ID NO: 84439 - DNA, 700 bp, Zea mays
  misc_feature: Ceres CLONE 1570496
  misc_feature: Encodes the peptide sequence at SEQ ID NO. 84440
tccccgcggtggcggccgctctagaactagtggatcccccgggctgcaggaattcgtctcacccctagaaaaaaaactcgcgagcgagtcgaggctccaaccccggcacatcacaggaggaggaggacgacgcgcccaccatggccatggcgacggccctccgcaagctctccgccaacgctctgcgccgccagccgctctcccgcatcacgccgctctactacatggcgtcccttccggcgacggaggagagatccggaatcacctggactaagcagttgaacgcgccgctggaagaggtcgaccccgagattgctgacatcatcgagcacgagaaggcccgccaatggaagggtctggagctcatcccgtcggagaatttcacgtcggtgtcagtgatgcaggcagtgggttccgtcatgaccaacaagtacagcgagggggtaccctgggcgcaagataactacggggggaaaatgagttttattgatatgggagaaattcccttgtggtcaaaaaacgggctttgggagggttttccctttttggaccccggggaaaaatgggggaagggaaaaggtgcaaaaccctctttttcccgggttttcccccccccaaaaaatttttccaggggggaataaacccctgggggcccctctttttggtaaaaggccccccccccctttgaaaaaaaaggggg

SEQ ID NO: 84440 - protein, 166 aa, Zea mays
  misc_feature: Ceres CLONE 1570496
  misc_feature: SWISSPROT Homolog: EC 2.1.2.1 Glycine hydroxymethyltransferase
MAMATALRKLSANALRRQPLSRITPLYYMASLPATEERSGITWTKQLNAPLEEVDPEIADIIEHEKARQWKGLELIPSENFTSVSVMQAVGSVMTNKYSEGVPWAQDNYGGKMSFIDMGEIPLWSKNGLWEGFPFLDPGEKWGKGKGAKPSFSRVFPPPKNFSRGE

SEQ ID NO: 84441 - DNA, 787 bp, Zea mays
  misc_feature: Ceres CLONE 1570500
  misc_feature: Encodes the peptide sequence at SEQ ID NO. 84442
  misc_feature (654)..(654): n is a, c, t, g, unknown, or other
  misc_feature (655)..(655): n is a, c, t, g, unknown, or other
ctccccgcggtggcggccgctctagaactagtggatcccccgggctgcaggaattcgtctcacccctagaaaaaaaacagctgcgagtcagccgatcctgatccctagccggaggtgggaggtcaccgtcaccgcgcctcgccgccggggcgtcacaatggcctaccgccggaagcctcagccccatccccagccccagcccacgccctcgttggagcaccactacccgtcgtccgtgggccccgcctcacccgactccctcgccgcgcaggccatgcgcgcctccgccgcacaccgcgatgcctcctccctcacctccgcctactccgcctcagcctcgctggcggcctctcgccggagccaccacgagccctccgtgtccacaccgtccctggatagttcaggctatgaatacacgtccatgaagaacctcaacgaggccaagtatggattctggggcacacttgcgcggaaggcaaagtcatttctcgatgaggactgctccccggagcagtacaaatcgccaagagatgatgtgcatgttggtgtccagcttccacattcaaaacaattgccaggagagacgtggaaacctgagacaccctcatctcagaagagatctgagtctataacttcctcccttacctatatggnnagcacattaaaaatgcaccttgagaaaggtcggaccattgtagaagataaaacggctgacattatccaaggagacgcgttaactgaacataagaagaaaagggactggtctaaatacacaaggagagcctgc

SEQ ID NO: 84442 - protein, 122 aa, Zea mays
  misc_feature: Ceres CLONE 1570500
  misc_feature (78)..(78): Xaa is any aa, unknown, or other
MKNLNEAKYGFWGTLARKAKSFLDEDCSPEQYKSPRDDVHVGVQLPHSKQLPGETWKPETPSSQKRSESITSSLTYMXSTLKMHLEKGRTIVEDKTADIIQGDALTEHKKKRDWSKYTRRAC

SEQ ID NO: 84443 - DNA, 903 bp, Zea mays
  misc_feature: Ceres CLONE 1570506
  misc_feature: Encodes the peptide sequence at SEQ ID NO. 84444
ggagctccccgcggtggcggccgctctagaactagtggatcccccgggctgcaggaattcgtctcacccctagaaaaaaaataggtgctgagctccaggttttggttctctttttttttggcatgatttgttttctgcaggagcggaatgtagttccctctttgaaaaaaaacttgaatgacatttctttggagaaagatgctgctgtagttgctaaggaggatgctctagctcaactcaggagcatgaagaaacggctcaaggaagcagaagaagaacagtataaggcagaagaagactcagcctccttgagagcacagctaaacaccctgcagcagcaagtaatgggacactcttacagtggatatacaatgggaatatcgagtgaggaatctgttccccccccaaaaggagatacaagatttacaggcacaggctaaagcaagagtcactgcttagacaacaggagccaacaaaattttcctgaaaaagtcccaacctgaggccaccaagagccaaaaaaaacttgccaaagaaacaaatcccttattgcttcctctggagggctgaaaaaaacaaaccgccggggagaaccaaatttacttttttttgaccaaaaaaaacctcccgggtattggaggggaaacaaattacctttttgcccaaactcggcccctttttaatttggcccgggaaaaaaaaaaaaggcccatggccctgtaaaaccagtgtaagtttcccctctattttaccaaaaatgggggggttctctttcccaaataaaaaaaaaagggagggtgtggttttgaaatgggctctcaccggggagagggtttaattaaaaccatttctctgcccccacggcgtcgggggtagttttttctctttgggtgaaatccccag

SEQ ID NO: 84444 - protein, 105 aa, Zea mays
  misc_feature: Ceres CLONE 1570506
MICFLQERNVVPSLKKNLNDISLEKDAAVVAKEDALAQLRSMKKRLKEAEEEQYKAEEDSASLRAQLNTLQQQVMGHSYSGYTMGISSEESVPPPKGDTRFTGTG

SEQ ID NO: 84445 - DNA, 896 bp, Zea mays
  misc_feature: Ceres CLONE 1570509
  misc_feature: Encodes the peptide sequence at SEQ ID NO. 84446
tccccgcggtggcggccgctctagaactagtggatcccccgggctgcaggaattcgtctcacccctagaaaaaagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaggacggtcttgtttgcacggccaggaagccctggatcgctgttggcatgcgcaacgtggactacaagcgtgcgaggcatttcgaggtcgacctttcttccttcaggagcatccttgagatcgacaaagagaggatggttgccaaggtcgagcccccttgtcacctgggtcagataaccaggagctacttgccaaatggacctttgcccttggggggcgtcgcccgagctccaacaacttccttggtggggggggctggatcaacgggttacggggcatcgaggggggaagctcctcccccctctatgggccctttttctcccaaaaccgggtttgttcccccaaatgggaggggttgttcccccccaaagaaggggcccgggggtccctcctaggaggcccccccccgggggggcccaaacccgagtttccctctccttggaaccctt

SEQ ID NO: 84446 - protein, 211 aa, Zea mays
  misc_feature: Ceres CLONE 1570509
MADVHEPLVRRKRKKVLVDYLVKFRWILVIFVVLPISTLIYFNIFLGDMWSAMKSEKKRQKQHDENVQKVVKRLKQRNPKKDGLVCTARKPWIAVGMRNVDYKRARHFEVDLSSFRSILEIDKERMVAKVEPPCHLGQITRSYLPNGPLPLGGVARAPTTSLVGGAGSTGYGASRGEAPPPSMGPFSPKTGFVPPNGRGCSPPKKGPGGPS

SEQ ID NO: 84447 - DNA, 980 bp, Zea mays
  misc_feature: Ceres CLONE 1570511
ggagctccccgcggtggcggccgctctagaactagtggatcccccgggctgcaggaattcgtctcacccctagaaaaaacacacatgacggagtacattcgttcccgtctcgtcttccactgcttgcatcagactcccccacgcgtcgtctagtgcttcccaatccacatagagccggttgatccccaaaagcccatggttttctccgacaccgcgtcgactctcatagccactgacactgactctgattcctcctgagatacccacctccgctgctgctgtcgcattagatgttgcatgtagacgttgatcacccattgctcactcacggtcatagattctaaccgatcgacccccgaactatcacgctatggatctctcggagacaacatcatcagacctctagatggggctgcattcgcatgctcacgcccacgctcgagtgatacaggtagcagatccagtgcacttgttcgacgcacacctagccagaggacctcatgggcggcttacgccaaacccggaatggaacatcgggaaagggggggaaccaaaattttttcccccggcgggacccccccttaaattagagggccagttcccaaccttttaaccttttgggggtgggggggaaaaaaaaacccccttgttttcccccactccccaggttccccccccgtaaaatgggaagggggggggggaaaaattgggggggttatttctggaacccccaccaacaaagggggcccttggggaaaaaaccccgtggggagccaacccgaaaaaccccccccaaaggagaaaggccccccccccggggggggccacaaaaatttttcttagaaataataccacccgggaggaaaaaaactcggccccccccataattttttatgggggcgccggggtttaaaaaaagaaaaaaaatttttgttgccggggtggcataaaccccctatttttttttcctcccgggggag

SEQ ID NO: 84448 - DNA, 831 bp, Zea mays
  misc_feature: Ceres CLONE 1570515
  misc_feature (642)..(642): n is a, c, t, g, unknown, or other
  misc_feature (712)..(712): n is a, c, t, g, unknown, or other
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacactaccgcagcccaagcagctgatggcggccaccgtatcttctgcctgagcctcgtccccacgtgcacacggggcgcgggttccccagcgtgtggactgagaaaacctttacgcccttttttttttgccccttttttgtccccccctcggaaaaaaacccaaaagggggcccccccgggacaattgagaaagggaacccctctccttttagggccgggcaaaaaaagggaacccccccccgggggggggggggccccggccaaaaaaaccggggggggggggggggacccccaagggggggggcccccaaaaaacccctccccgggggggggcccccccccccccaaaaaattttttaaaagacccccccccccccccgggggggttttaataaaaaaaaattatttttttgtggggcncgggggcgggaaaaaaaaaaggggccccccccccccccgaaaaaaaaaattttttttttttttttttttnctacccccagataaaagggggaggggtgtcgttgttttttttttttctaaaaaaaaaaaaaaaaaagaaagtacctcctgcgtacgggggtcctcccccctccttcgtggggaggagaa

SEQ ID NO: 84449 - DNA, 694 bp, Zea mays
  misc_feature: Ceres CLONE 1570518
  misc_feature: Encodes the peptide sequence at SEQ ID NO. 84450
tggcggccgctctagaactagtggatcccccgggctgcaggaattcgtctcacccctagaaaaaattctgcagcgccagctcgctcctcgccccgcccccttctctcagcggcgacgcctcgggcgttcctaccctgccccctctccggacccccacgccgtcggcgaagcagccgggcaagagcccgatccagaccccgcgagcaatccttgatatacctgatggctatgattgatgagcctctgtacccaattgctgtactgattgatgagcttaagaatgaggacatccagttgcgtctaaactccattagaagactttcgacaattgcacgggctcttggagaagaaagaaccaggaaggagctgattccctttttctttagtgaaaaccaatgaccatgaaaaattaagggggctttctttgccatggggctgaggaaaatgggggggggggtctcttccctcttaggtggggggggggggaaaaaaaagccccccggtttttgccccccccccttgggaaaaaattttggttcccacaaaaaaaaaaaaattgtgggcccccccgaaaaaaaggcgggggggaaaaaattttttttgggggccattattggggggggcccccccccccttggggggggagaaaacaccccccccctcttttctcgcccggggggggggggtggttttt

SEQ ID NO: 84450 - protein, 58 aa, Zea mays
  misc_feature: Ceres CLONE 1570518
MAMIDEPLYPIAVLIDELKNEDIQLRLNSIRRLSTIARALGEERTRKELIPFFFSENQ

SEQ ID NO: 84451 - DNA, 885 bp, Zea mays
  misc_feature: Ceres CLONE 1570522
  misc_feature: Encodes the peptide sequence at SEQ ID NO. 84452
aaccgcggtggcggccgctctagaactagtggatcccccgggctgcaggaattcgtctcacccctagaaaaattaaactcacaacacggtagcagggggtggtagtagaaggcataagctctgttctctgaccctcaagtgtttgagcctatttgcgcaacgaaaaaatgagcatcaaaagcattaatggaaagagccccatagtggttggaccttggggagggacaggagggtacccttgggatgacggcgtgtactcaacaatacgccagatcgtgattggccatggtgcagctattgactcaataaggattgaatatgatctgaaaggaaggtcggtttggtcagaaacgcatggaggtactgatggtggctccgaaacagataaggtgaaactagattttccagatgaagtcctcgtgtctgtaagtggacactacggatctgtctgcgggacaccggtcatcataagatcgttgacgtttcagagcaacagctcgacgtacggacccttcggcaccgaggatggcacacctttctcactcccagttagcagtggcaagatcattggattccacgggcggtctgggtcgtatctcaactcaatcgggttctacctgaagcaggtgcattttcccactccagtgaaatcctctccagcttcacctctgagccttccgagttcacaaagtagaaacagcgccctatggcttaacgggtggcgacgcttgacctgacatgggtcttccccctgcgaaaccaaggaaacagcttttcttttctaccccgagcaatcccccccaaacggcggtacacaaacccgttcacggacggaacaatttggaaacaaaatgggtttcggtccccagttacctacgggaaaat

SEQ ID NO: 84452 - protein, 189 aa, Zea mays
  misc_feature: Ceres CLONE 1570522
  misc_feature (22)..(153): Pfam Name: Jacalin Pfam Description: Jacalin-like lectin domain
MSIKSINGKSPIVVGPWGGTGGYPWDDGVYSTIRQIVIGHGAAIDSIRIEYDLKGRSVWSETHGGTDGGSETDKVKLDFPDEVLVSVSGHYGSVCGTPVIIRSLTFQSNSSTYGPFGTEDGTPFSLPVSSGKIIGFHGRSGSYLNSIGFYLKQVHFPTPVKSSPASPLSLPSSQSRNSALWLNGWRRLT

SEQ ID NO: 84453 - DNA, 889 bp, Zea mays
  misc_feature: Ceres CLONE 1570523
  misc_feature: Encodes the peptide sequence at SEQ ID NO. 84454
ccccgcggtggcggccgctctagaactagtggatcccccgggctgcatgaattcgtctcacccctagaaaaatgacccctggtgcctttccatcttcctcgatctccctagctcactctccaatctaccatttatctatctctctctctcgtcttcaccatccacaatgccataccgtcgtcgtgatagatggcagcagtccatccgtccgtggagatgacgacgcagcaagggccgccagccgtccagctattctccggccagggatggcggcggcggcaggagcgccgaggatgaggagaaggagaaggcggcggcgatcgacaactggcttcccatcagcgcgacgcggaatgccaagtggtggtactccgccttccacaacgtcacggccatgatcggcgccagcgagctcagcctcccctacgccatgtcccagctcggctggggtgccggcatcacgatcatgctcctgtcgtgggtgatcacgctgaacacgctgtggcaaatggtggagatgcacgaaatgatgccggggaagaggttcgaccggtaccacgagctggggcaggacgcgattcagggaccggctgggcctgggaattgtggttcccgaaccagcgggaagaagaaaggggggggaaacatcttgttacagggtgaacgggcgggacgctctttgccgaaaggtccaccaaccggttggtgtggccccaacccccgcgatcctaagggagagccccaatattcagggctcaccttactttactccaggaccttgtgggcgccctggcaaaattccggggctgggaaaacatattggcccaaattgtcaaaacccccttcttcccaggggtgtttcccctgtgagacggcgcggccaataaat

SEQ ID NO: 84454 - protein, 165 aa, Zea mays
  misc_feature: Ceres CLONE 1570523
MIGASELSLPYAMSQLGWGAGITIMLLSWVITLNTLWQMVEMHEMMPGKRFDRYHELGQDAIQGPAGPGNCGSRTSGKKKGGGNILLQGERAGRSLPKGPPTGWCGPNPRDPKGEPQYSGLTLLYSRTLWAPWQNSGAGKTYWPKLSKPPSSQGCFPCETARPIN

SEQ ID NO: 84455 - DNA, 800 bp, Zea mays
  misc_feature: Ceres CLONE 1570525
  misc_feature: Translation starting site: 165
  misc_feature: SWISSPROT Homolog: EC 2.7.1.6 Galactokinase
ctccccgcggtggcggccgctctagaactagtggatcccccgggctgcaggaattcgtctcacccctagaaaaaacgccatacgacacggaggacaccgagccggaggcgaagccggtgcgcagcgcgagagtagcggcgagtcggcgaccatcaagcaactgcatggccgcgttacccgccagcgcccccgcccccgcccccgccccctccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtcaatctgatcggggagcacatcgactacgagggctactcggtgttgccgatggccatccgccaggacatgatcgtcgccatccgaagggccaacggcgcccaggtgagggtcgccaacgtcgacgacaagtaccccctctgcgtctagcccgccgacccagacaaggaaattgacgtaaaaaatcacaaatgggggcactaatttcatgtgtggatacaagggagtttatgaatactgtagatcaaaagggatagatctggggcaaacctgttgcgctttgacgtcgttgttgatggcacaggtccctcaaggctctggactgtcaagctcagcaaccctttgtctgttcagcaacaattgctatccaggggaatcccttgacaaaaacttgccaaagaaagaagttgctcaattcccttgggcggt

SEQ ID NO: 84456 - DNA, 851 bp, Zea mays
  misc_feature: Ceres CLONE 1570526
  misc_feature: Encodes the peptide sequence at SEQ ID NO. 84457
ctccccgcggtggcggccgctctagaactagtggatcccccgggctgcaggaattcgtctcacccctagaaaaaatccgaacctagccaaccagccccagcgcccaacgcacgaactgtaagaaaccctagcggagcaactgacacactcgcctacatcctcggccgccagctcgccaccatcgcctcccggtcggccgcgccacctcccggaagattggataacaatatcatgccattaggtggataacacttgacgtgctcctggtttgttcatttccgggcatcatcaaaatgtcaggaccgctgaattcaaacattagtgggggcccctcgaaccttagagattccacaggaaggccatttacatcatcgttttctggtcaatctggatcacttccaggttttcatcactcaggggttcaacaacccagtggtggcatttccagtggccgtttccctccaaataatcttcaagcttccttgtctcagattcctcatgggcattctgggattagcaacagaggaggtatgaatgttgggggaaatcctggatttggtagtagcatgaatgctattggtggttcaatacaaggtttatcctcaaacttggctaatgtgggtaaccgcaattctgctcctgggttggcagcttctccagtcttaggaaatttaggcccaagaatagcaagttctgggaatattttggggtgggagcaatattggggagaagtataagctctgggagactgtctatgcctggtattgcatctcgcatgaatttagtggcaactctggtagtggggctatcaacattcagggatccaaccgtatgggtatggcttcacagca

SEQ ID NO: 84457 - protein, 147 aa, Zea mays
  misc_feature: Ceres CLONE 1570526
MSGPLNSNISGGPSNLRDSTGRPFTSSFSGQSGSLPGFHHSGVQQPSGGISSGRFPPNNLQASLSQIPHGHSGISNRGGMNVGGNPGFGSSMNAIGGSIQGLSSNLANVGNRNSAPGLAASPVLGNLGPRIASSGNILGWEQYWGEV

SEQ ID NO: 84458 - DNA, 767 bp, Zea mays
  misc_feature: Ceres CLONE 1570527
  misc_feature: Encodes the peptide sequence at SEQ ID NO. 84459
ctggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcggtcggcgatctgttactacggtggcccgtgggggaaacagttcgggctctgtcacgccacctgctgctgctgccggcgacggcgaggatcctggggtcccggcatggccaaccaaaaatctcgaacaagccatctccgtccctgttcctggtccccaacggga

SEQ ID NO: 84459 - protein, 197 aa, Zea mays
  misc_feature: Ceres CLONE 1570527
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSVGDLLLRWPVGETVRALSRHLLLLPATARILGSRHGQPKISNKPSPSLFLVPNG

SEQ ID NO: 84460 - DNA, 979 bp, Zea mays
  misc_feature: Ceres CLONE 1570528
  misc_feature: Translation starting site: 197
ggagctccccgcggtggcggccgctctagactagtggatcccccgggctgcaggaattcgtctcacccctagaaaaagtccacccattcctccgctcttccttaattcctcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagtgcaaccgtacaacgccgtcttatgtcgcgttcaccgattcggagaggctcgtcggcgacgccgccaagaaccaggtcgccatgaaccccatcaacaccgtcttcgacgcgaagcggctcatcggccgggcgcttctctgacacgtcggtgcagagtgacgccaagctatggcccttcaaagtgatccctggctccggcgacaaggccatgaatcggggtggcagttcaggggcgaggagaaacagttcccggccgaggagattagctccctgatccctgaaccaaaataaagggaaacgggcgaaagctttacctcgggccccaccttttaagaaacgctgtcggttaaccgttccctggccttattttaaacaactccccaagggccatggcccccaaagagaacccctgggttctttcctcccggcctcaaaggtttgggcgcatcattcaatagaggccccccccccccgggccatctccattatgggggtttaaaaaaaaattctaatctatccaacgggcgaaaaaaaaaactccctcctccttccatacctggggggggggggccctttgtgagcgtctccgccccccacaccacaaggaggggggcatttttgggggaaagggcccccgtgtggagaaaaccaacttgggggggggggagaactcct

SEQ ID NO: 84461 - DNA, 792 bp, Zea mays
  misc_feature: Ceres CLONE 1570529
  misc_feature: Encodes the peptide sequence at SEQ ID NO. 84462
  misc_feature (764)..(764): n is a, c, t, g, unknown, or other
  misc_feature (765)..(765): n is a, c, t, g, unknown, or other
gcggtggcggccgctctagaactagtggatcccccgggctgcaggaattcgtctcacccctagaaaaatccactgccagtgccatcccattcccatccgaggtaaacgcgtcaacgcgaccagctcacctcgtcatctcccattctctttcatatttgcatgcatctcggttctcggatctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgactaccaggactacaccccctgcaccgaccccaagcgctggcggaggtacggcaactaccgcctcagcttcatggagcggcactgcccgccgccgcccgaccggcagcagtgcctggtgccgccgcccaaggggtacaagccgcccatccggtggcccaagagcaaggaccagtgctggtaccggaacgtcccctacgactggatcaacagccagaagtccaccagcactggctcgtcaaggaggggcgacgcttnncggttcccggcggcgggcacatgttca

SEQ ID NO: 84462 - protein, 189 aa, Zea mays
  misc_feature: Ceres CLONE 1570529
  misc_feature (180)..(180): Xaa is any aa, unknown, or other
MKYSKEDKPERAGGAGAGSRAVPVALVVVVLCAFSFYLGGIYSTGRSLLDSIQPAPTALLALGAATTTRRPSDDGQARPALASTAAVAFPECPADYQDYTPCTDPKRWRRYGNYRLSFMERHCPPPPDRQQCLVPPPKGYKPPIRWPKSKDQCWYRNVPYDWINSQKSTSTGSSRRGDAXRFPAAGTCS

SEQ ID NO: 84463 - DNA, 1104 bp, Zea mays
  misc_feature: Ceres CLONE 1570530
  misc_feature (14)..(14): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (1073)..(1073): n is a, c, t, g, unknown, or other
gtatggtggggtanaaaactaatatagcatgtaaaaatttattggttttcttttcaggggnnnnnnagnnntnntnnnncaaagctggagctcaccgcggtggcggccgctctagaatagtggatcccccgggctgcaggaattcgtctcacccctagaaaaaaattcccgttccattccagactcgcagtacagtacacacagcaaaagcaccacccgggccggcttcctctagactagattagtgttgctaagagcctttttaactacgggattacgcaagtctggtatactcatccagagagagacacggaggacctgggtttggttgcgctgcttgactcgctccgtgttccaagcgccttttgagcattcaagcagatataaaattcctctttttacactacaatccccgctgaatcagcagcagcaactctctccctctccgttcttggtggtccgagacccgtggccgtacgctctgcctcactcctccgtctcttgcttcccttgccgccgggcggcgcgcggcgccggggcgcggatcagcggcggggcaatgggtgggaggccgcccgccggggcgccgagacagggcaaccatccgttctggcgggccctaaccgacaaacggaaaggggaacaacccgtgacccctggttccgtcggttccgcccattcaacccgccgccgccattaaggcatttgggtccacccaacccccgggttccgctggggtggtcctaggccagcaatataaccccagtaaaaatgtttaaaagttgggagctggggaaagcctattcttttaaaacaaaaaagcccccgtgggccccgcctgtgggatagatggagaggataaaaaaaaggacatggggaaaggaaacttctacatacaaaacgtggccccctcccccgcggtcttattcattctcgggccaccttttatagagaaacatctaaaacatggggggactctagggcgggtgagtctgagctccctacacgtcgggggtagaatcctgacgcggcccccctaaaaggatgggcccacactcggagtggggaggctntatcccaatgggaagagaccacggagtaccc

SEQ ID NO: 84464 - DNA, 803 bp, Zea mays
  misc_feature: Ceres CLONE 1570531
  misc_feature: Encodes the peptide sequence at SEQ ID NO. 84465
ctccccgcggtggcggccgctctagaactagtggatcccccgggctgcaggaattcgtctcacccctagaaaaaatcgaaagaccgccctctcgctctcgctctccacagccgctagggtttccaccgcccccggcgatgggcgccctcactgacagccggaagcgtctctaggcggacagctgcctctcggccgaccatcgcctcccctatccctcgttccccccaccgccccttacgcctccctccaagcggaccgagctcgccccattccctgaactcggatccctccacctccgccgtcccgcctatccggccttctccccaaatcatccactccgccgccgcggcatccgcctccttcacgccgggcccttcctcctcttcgaccatcgcttccaccaagcttccgcagatgtgcagactcccgccgccgccgacattgtcgcgcccgatgctcggcccacagcagatcctccgcgtcttccggcttggtggggctgctcggacacacgctgccggccgctcgttgttctccccggcatcacccctgacctgctctctcggatacgagcagtacgtagagctcgtctacagcgactgacacccggagaccatgcatttcccgcaagccacaacgtatgctgcgatggcaagcagggccccctcgtaggtgttgggccatcgaagaagatgaggttgggggaggaaattgacggggccctccccttaacaatcatttattcccccccaatgggaaattgtattttcggtttggagacaaaacggctcccgggttagcct

SEQ ID NO: 84465 - protein, 62 aa, Zea mays
  misc_feature: Ceres CLONE 1570531
MCRLPPPPTLSRPMLGPQQILRVFRLGGAARTHAAGRSLFSPASPLTCSLGYEQYVELVYSD

SEQ ID NO: 84466 - DNA, 968 bp, Zea mays
  misc_feature: Ceres CLONE 1570532
  misc_feature: Encodes the peptide sequence at SEQ ID NO. 84467
acccgcggtggcggccgctctagaactagtggatcccccgggctgcaggaattcgtctcacccctagaaaaacgtctcacaaaacgccgcccttggatgagccaatcttcctctcgcacggcccactccttacccccgtctcacaaaacaacgccgccgccgccgctgccgccgtcgacagccaactccccacgcccccaccgcctccgcgcaccgccccacacctgattgcgcgtccagaggtattcagagctctctgctgtgggagcaacgagggcagggatgaaggaggtggtgacggtgcaggtcggcggtttcgcgaacttcgtcggctcccacttttggaacttccaggtgattagctgatcgtttccccggaagatccttccctccccgggtccttgcactcactgtgcctgagctcgatgacgcctctgcaatctaccttcctctgctccgcaggatgagctgctcgggctcgcccaacaccccggcgccgacccggtattcaggaacgcccgcggtccaaatggacgtccctggaccgggcccggcgagacccaccaagagcggtgcccaggctacgccccctcgctggggatcaaaccgggtccccgagggcttcctgggccccttaaaattccccccgggccccccaaggtcccaaaccctggcaacctgccaatgaaacccaatatctttcacaggtggggggaaagggaaaaaaaatcagggggaaaaaccccccggggcgaaaaatggtcccccaaagggttttcctaaaaaaaaaaaaaccccgagcccctgggaggggccaaaaaaatggctgggggtaaaaaaaaggcccgggccaaaaccgggagaagggagccaattttgggcgggtttttaaagagccggttcccccccaaaaatatataatgtttgtggaacacggaaaccctatgagggtgaataatggagacgcc

SEQ ID NO: 84467 - protein, 32 aa, Zea mays
  misc_feature: Ceres CLONE 1570532
MKPNIFHRWGEREKKSGGKTPRGEKWSPKGFS

SEQ ID NO: 84468 - DNA, 827 bp, Zea mays
  misc_feature: Ceres CLONE 1570534
  misc_feature: Encodes the peptide sequence at SEQ ID NO. 84469
  misc_feature (485)..(485): n is a, c, t, g, unknown, or other
  misc_feature (748)..(748): n is a, c, t, g, unknown, or other
ctggagctccccgcggtggcggccgctctagaactagtggatcccccgggctgcaggaattcgtctcacccctagaaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgctccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgancacaacatccgcctcgttgctcgaggtggcgcagcccctttggcgagaaccatggtggccgccccatcgctatgggacgggcccggaggggggttgtccgccgggccagggcggtccctaaaaaaatggggtccccccataacccggggcctttttggggggggggcccccccttgggggcgccccctaaaaaaaggttttttttggggggggacccccttttattttaaaaaaagggggggggggtttttttagaaaaaaanaaaaaaactattatccctccccttttttttatattattgggggagggaccacccccccccccctctttttttttttttt

SEQ ID NO: 84469 - protein, 196 aa, Zea mays
  misc_feature: Ceres CLONE 1570534
  misc_feature: SWISSPROT Homolog: EC 3.6.3.14 H(+)-transporting two-sector ATPase
  misc_feature (112)..(112): Xaa is any aa, unknown, or other
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLXHNIRLVARGGAAPLARTMVAAPSLWDGPGGGLSAGPGRSLKKWGPPITRGLFGGGAPPWGRPLKKGFFWGGTPFYFKKRGGGFF

SEQ ID NO: 84470 - DNA, 1082 bp, Zea mays
  misc_feature: Ceres CLONE 1570536
  misc_feature (1)..(1): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
ngtgtttttttggggggttttttattaataactcaattaaaaaaaacttaaacggaggnnnnnnnnnnnnnaaaactggactccccgcggtggcggccgctctagaactagtggatcccccgggctgcaggaattcgtctcacccctagaaaaatggacgacagatcctctctggacgaactgaaaggttaccagcagcaccacggcgagatctccccttggcgggccaaaaccgacggcgagcttcaccggcgttggtcggctccaatctcttcgccgttttattttcctcccaagttaaggttgcaagcttctaacttgcgattcctgaaagatggggacctcttctggcgcgaatattccatcaacaaccttcctccgaacctggggatgttgcctcccagggatggtccacccccctcaaggttgccaacctccctccccattggcccttcggaaaaaggtgggctcccccccacccaccaaaaaccctggttcaaaacccggaaacccccgggcattgatttcccccccccctaaaaaggccccccccttccccaaaaaaacagaattgggtcctaggcctcaaaaccccccaaaaaccatttaagacccactttgtgtttgtgggggggtttgttcctctttccccccaccaaggggggagtgtttgttttcgctccaaacaaaaaacgattaaaataagtgcggccccgtgacccgcggggaaaatatataaaaaaggagggtgtaagttgtgtgcaccgccacacaaaaaaaaaaaaggaggggggggggtgtgtatgtctcccccccacaagaacttctcgccccgcttggccgaggagaggagggaggttttacatctcttatgccaaccaccgacggctgacagaccatgaaatgcccgggccccctaacctcgccgactaaattaatgatagaaataatattaccttgaggaggcgaggacagtactcacaccacctctcataccacattttgcatatgaccgggggcacgaagggcggaacggtattattactatctcttctgtctgtaccgtgaattggagcgaggaa

SEQ ID NO: 84471 - DNA, 998 bp, Zea mays
  misc_feature: Ceres CLONE 1570538
  misc_feature: Translation starting site: 108
gctgtggcggccgctctagaactagtggatcccccgggctgcaggaattcgtctcacccctagaaaaatcagctgcagcagtcgtgctccggaccggagaagtcgaaatggaggagaggctgttcgccacggagaagcacggtggccgggcgctctacaggctccacgccgtcacggtgttcctggggatatgcctggtgctctgctacagggccgcacgtcccggctgccggctccggcggcagggcggcgtggctggagatgctcgcggcggagctctggttcggcttctactgagtcatcacgcagtccgtgcgctggtgcccccatcgccgccgcaccttccacgacatgctcgcccgcaggttcggagagcggctcccatgcgtggacatcttcgtgtgacagcggacccgcggtcggagccgccgaagcttgtctgggcacggtcttgttgggtaatggcgtcaaattcccggccggcgaagcttaaggtttaccttttcaaaaaagggggttccatcccccctttttaacgtttttgggggaaggccccccctttcccaaaaaatgggcccctttctgcaagaaaagtaggggttaaacccatgtccccgggcccttttttttccccaattttggaaaaccctttttttttcccccccccaccctttgggggagggggctttcctctaaaaaccctttagatataaagcgggggggtgttttccccccccctcccgagggaatttttttttttaaaatatattggggaaaaacccgggtgttttttgtggggagagagtgttttcccacaaaaaccccccccccttttttttttttttatgtagaaaaaaaaaggggttgttaaaaaaaaaaaatgttccccccccccgggtgggtgggcaaaaaaaaaaaccccccccccccacctctgggggggggaaaaactcttcttttttttggggggaaacacccccccttttttttttgttttt

SEQ ID NO: 84472 - DNA, 838 bp, Zea mays
  misc_feature: Ceres CLONE 1570539
  misc_feature: Encodes the peptide sequence at SEQ ID NO. 84473
  misc_feature (556)..(556): n is a, c, t, g, unknown, or other
ccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctggggagcagcttgaggacgggcgcacgcttgccgactacnacatccagaaggagagcaccctccacttggtgctgcgcctcaggggaggcatgcagatcttcgtgaggaccctgaacgggcaaactatcacccctcgaggtggagtcttcagacaccatcaaacacgtcaaaggcaagatccaggacaaaggagggctttcccccagaccagcaggcggttcatcttttgctggaaaagcaacttgtaggacggggcgcacgcttgggccgacttacaacatccagaaaggagaggccccctccaccttggtggctgcgccc

SEQ ID NO: 84473 - protein, 204 aa, Zea mays
  misc_feature: Ceres CLONE 1570539
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (136)..(136): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGEQLEDGRTLADYXIQKESTLHLVLRLRGGMQIFVRTLNGQTITPRGGVFRHHQTRQRQDPGQRRAFPQTSRRFIFCWKSNL

SEQ ID NO: 84474 - DNA, 875 bp, Zea mays
  misc_feature: Ceres CLONE 1570540
  misc_feature (875)..(875): n is a, c, t, g, unknown, or other
gcggtggcggccgctctagaactagtggatcccccgggctgcaggaattcgtctcacccctagaaaaaggccgaagcgacagcctgcgctcacgagctgccgcagctcttggtccccggcgagccgtgctcagccgcggatgctgcaggcagcctggccagcagcaggtacggcgatacgtccgtccacgctaaacctcacgggcgtgccatgcatggcgcgcgcgctctgcccgcgtcgccagaccccagtggcgctcacgtgccccgccgctatatagcccacggcgtcgcgccaccgtccgtccgtccgtcgtctcgcgctctcgtttcgtcgctacgctagcttccagtcccgggcttagcaactgtgctgctgttgcactgcacccggcgcacgcaaagatgcgccgtgtcgggaccggtgtgaggaagcttttgcggcgcggccctgttcggtgcttctggctcctccccgggcgaggcgggcggcgttcccactcccgcctcgttctggcccccgcccccgcccgccggaaagcgggggaaaaacccttggcagggggtcgccaccgccttttcggggcccgggctccgcccccccgggccccccgggggaaaggggggggccccttctttggggggggggggttccctggtggggaacccagggcgttcccggtgaaaaccaatcccggggttggctgttacccggggaccccctttgggcggggggcggggagcctcccccccccccggttataccccccccaattcgtgtttcggggggggggaatcctgtctttgaaaaaacccttaaaatatatcttgtggtccgggggaaaaaactctctgggacggccccccccccaagan

SEQ ID NO: 84475 - DNA, 917 bp, Zea mays
  misc_feature: Ceres CLONE 1570542
  misc_feature: Encodes the peptide sequence at SEQ ID NO. 84476
ctccccgcggtggcggccgctctagaactagtggatcccccgggctgcaggaattcgtctcacccctagaaaaaaccaccaccaccggtcaccgaaacgcagcaactgacaggcacctgacggagagctagccgctctgcagccgagtcgagtcgaactagcgcgcgagcgagcgaggaagaagaagagctagctatactgctgcttcctcgcgcgcagcagcagcagcaaacgaagaaagctccatctgcttgcgcacacacacacatacacacacacaccagctagctccatgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctcatcgccggcatcaccatcgccagcctcgccatcccgcagggcatcagctacgccaagctcgccaacctgccgcccgtgctcggactctactcgagcttcgtgccgccgctggtgtacgcgctgatggggagctccaagactggcgtggggaaacggggggcggggggctctctcgcccttttccccctgtctctggtagagggggccccaaaggaaaaacccctggctttactggaccttgcctgtccgggccccttccttgccggtgggtttcggggcctatccgggctccccgggtggtggtttaaccgtgtgcctttgcgtcccacccgcattctttggagtcctagggcggcgctgtgtacagcggggggctcgtctcccc

SEQ ID NO: 84476 - protein, 208 aa, Zea mays
  misc_feature: Ceres CLONE 1570542
MGGSADANGAGSVRVPVPPARPFLDTFRGNLKETFFPDDPFRGVVRERGAGRRTVAALRYFFPFLEWAPAYALSTFKSDLIAGITIASLAIPQGISYAKLANLPPVLGLYSSFVPPLVYALMGSSKTGVGKRGAGGSLALFPLSLVEGAPKEKPLALLDLACPGPFLAGGFRGLSGLPGWWFNRVPLRPTRILWSPRAALCTAGGSSP

SEQ ID NO: 84477 - DNA, 768 bp, Zea mays
  misc_feature: Ceres CLONE 1570546
  misc_feature: Encodes the peptide sequence at SEQ ID NO. 84478
ctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaccacgtcttctcctcccgcccgcgctccctggtgtccgacatcatcatgtacggcgccaccgactcgtgcttcgcgccctacggcgaccactttcgcaaggcgcggaagctggtcaccgtg

SEQ ID NO: 84478 - protein, 174 aa, Zea mays
  misc_feature: Ceres CLONE 1570546
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYDHVFSSRPRSLVSDIIMYGATDSCFAPYGDHFRKARKLVTV

SEQ ID NO: 84479 - DNA, 817 bp, Zea mays
  misc_feature: Ceres CLONE 1570549
  misc_feature: Encodes the peptide sequence at SEQ ID NO. 84480
ggagctccccgcggtggcggccgctctagaactagtggatcccccgggctgcaggaattcgtctcacccctagaaaaaatcggaccggcagcagtcgcctggcctgcaaggcagagcagcgagcggctatgggaagagaggcgccggcgatggcggtagcgctgctggcggcgctaggcgcttccgcggccgtgttggcggggaaccgcgagcgcgtccccggcggaggggatccacccgctgtcctagatcgccgtccacggggaccgccgtcgaattgctgccgtcggacgtgcgtgcgggcgacaccgtcgctcctcggctagcacggagaagacaccgagtgggtgacggtgaagttcggctggagagaaccatccgatgacgactggatcggcgtcttctctccgtcgtgaattctactcgtcagctacatgtccgaacccatggacagcagaagaaccctatctctgcacagcacccatcaagtatcatgttcgcaccactactctgcgaactacgtctactggggctggggcggcttccagctgcggctcatcaacgagcgctccaacttctccttcgccctcttcaccgagggcctcagcgacccgaggttgatcgcggcgtctgagcccatatcgttcgagaacacgctggcgaccgtgttcccgcgcctggcgcatggcacgtcccacgacgagatgacggtgacttggaccagcggctacacctgcgatgaggcatacccactcgtgcagtggagcgcccctgatcaccggctgcggcgccatgcacactgtgggcgtgcccgcct

SEQ ID NO: 84480 - protein, 123 aa, Zea mays
  misc_feature: Ceres CLONE 1570549
MDSRRTLSLHSTHQVSCSHHYSANYVYWGWGGFQLRLINERSNFSFALFTEGLSDPRLIAASEPISFENTLATVFPRLAHGTSHDEMTVTWTSGYTCDEAYPLVQWSAPDHRLRRHAHCGRAR

SEQ ID NO: 84481 - DNA, 1268 bp, Zea mays
  misc_feature: Ceres CLONE 1570551
  misc_feature: Encodes the peptide sequence at SEQ ID NO. 84482
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (927)..(927): n is a, c, t, g, unknown, or other
tatttttagttagggcgtgtgtttgggggttttnnnnttaattttcttatggttggggcgccccccaagattggttattctggaactccccgcggtggcggccgcttcattggccagatcgcctccgggctggttgagttcaacccggagataacattcttctccgtcaagcgcttcatcggccgctagatgaacgaggtcgacgaggagtccaagcatgtctcgtatctcgtcatcagggacgacaacggcaacgtcaagctcgattgcccggcgattggcaagcagttcgcagctgaggagatctccgcacaggtgctgataaagctggtggatgatgcatcaaagtttttgaatgacaaggtcacaaaggcagtgatctcagtccctgcttacttcaacgattcacaaaggacagcaaccaatgatgctgggcgcattgtctgggctgaacgttctgcatattataaatgagtgggggcccccccgggggggggtatttggttcttgagaaagaagaacagtggatccgatttctggggttgttgaccctcgggaggtgggcactctttcggatgtctcaagttccctcgaaagtcgggggggaatggctgttttttctgagggttccttatacttatcatcaaggggggaatacacaccaccgcctgggcgggggggagagggacgctgtttgggcacgaggaggaaattgttgcagacaattttcgagtgttagcgcctggtaagtaagccttctccgaagaggaataatcacgatcacaaatgtgtgtcttatgtgagcatgtttggggctttaaagataatgtatatatatgtatgtggagtggacggctagtgacccaaacacgcgaactggagagacaggtaaaatggtaagagtgacgatgaaataaaaagtggagngtaatatgaaactttatgaaagcgttgtgttaatgtggcggtgtaatcatttgccggagtcgttgttattgcgtattaggggaatctttattaactgacatcatattagcgcaccctcctcgatttatcttggaacgcgtcttcagcggtatctacctgactgtccatttctgtgcacttctgtgttctttgggtctgtgtatgctccgtagtatctatttgggaggtcctgtaattaatatagcgtgaagtgtgcggagagaaaatacaagctgactgctgtggaggagtgtgtgaaatgagatgaaccccgcttagagtcagaattgacatatgcgacg

SEQ ID NO: 84482 - protein, 94 aa, Zea mays
  misc_feature: Ceres CLONE 1570551
MNEVDEESKHVSYLVIRDDNGNVKLDCPAIGKQFAAEEISAQVLIKLVDDASKFLNDKVTKAVISVPAYFNDSQRTATNDAGRIVWAERSAYYK

SEQ ID NO: 84483 - DNA, 881 bp, Zea mays
  misc_feature: Ceres CLONE 1570552
  misc_feature: Encodes the peptide sequence at SEQ ID NO. 84484
tccccgcggtggcggccgctctagaactagtggatcccccgggctgcaggaattcgtctcacccctagaaaaacccatcccacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttccgcgcggcgcaggtcggggacctcgaggccctggacgcgctcctcgacgccgacccctctctcgcccgccgcgccacgctctacgaccgcctctccgcgctccacatcgccgccgcgaatggccgcctcgaggtgctgtcaatggtcttggatcacggggtgccgccggacgtggtgaatcggcacaagcagacgccgctgatgctcgcggcgatgcacggcaagactgactgcgtgctgaaagctctgcaggccgggcgcaatatcctcaggttcgatttccagcacgggcggacttgccttgcccaagcgttcctacttggccacgttcggttgcctgcagggcatccttcacgggggggcggaaccacgcccgggggccgaacctctgggggtttcgccccggtttccccaacgtggagggaagaaaaagggggccaagccggtttaaccttttccccccagagaaggggcccccccccgggttggtttgaaagggccttttctgagaaaaaaggggccctttgtttttcctcttttacccgggtttaaaagggggtttcctcgtgggaa

SEQ ID NO: 84484 - protein, 200 aa, Zea mays
  misc_feature: Ceres CLONE 1570552
  misc_feature (46)..(78): Pfam Name: Ank Pfam Description: Ankyrin repeat
  misc_feature: SWISSPROT Homolog: EC 2.7.11.1 Non-specific serine/threonine protein kinase
MGHGVSCARTGDEHDYFRAAQVGDLEALDALLDADPSLARRATLYDRLSALHIAAANGRLEVLSMVLDHGVPPDVVNRHKQTPLMLAAMHGKTDCVLKALQAGRNILRFDFQHGRTCLAQAFLLGHVRLPAGHPSRGGGTTPGGRTSGGFAPVSPTWREEKGGQAGLTFSPQRRGPPPGWFERAFSEKKGALCFSSFTRV

SEQ ID NO: 84485 - DNA, 917 bp, Zea mays
  misc_feature: Ceres CLONE 1570553
  misc_feature: Translation starting site: 334
  misc_feature: SWISSPROT Homolog: EC 3.2.1.21 Beta-glucosidase
  misc_feature (773)..(773): n is a, c, t, g, unknown, or other
  misc_feature (856)..(856): n is a, c, t, g, unknown, or other
  misc_feature (865)..(865): n is a, c, t, g, unknown, or other
ctggagctccccgcggtggcggccgctctagaactagtggatcccccgggctgcaggaattcgtctcacccctagaaaaaacacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttggaatgaagatggaaagggggaaagcaactgggatcacttctgccacaatcatccggaaaggatactggacgggagcaattcagacattggagcgaattcgtaccatatgtacaaaacggacgtcagattgctcaaggaaatgggcatggacgcatataggttctctatctcttggcccagaatactgccgaagggaaccaaagaaggaggtattaacccggatggcatcaagtactacagaaacctcatcaacttgttgctagaaacggcatagagccatatgtaaacattttccactgggatgtacctcaagcactagaagaagagtacggcggcttcctagantagagtcataagagcattgtagaagatacacatacttttgctaaggtgtgctttgataacttcggcgacaaggtgaagaaatngggtgaccnttatgagccccagacattttactccttttccatacggaactggggtctttgc

SEQ ID NO: 84486 - DNA, 794 bp, Zea mays
  misc_feature: Ceres CLONE 1570556
  misc_feature: Encodes the peptide sequence at SEQ ID NO. 84487
  misc_feature (720)..(720): n is a, c, t, g, unknown, or other
ctggagctccccgcggtggcggccgctctagaactagtggatcccccgggctgcaggaattcgtctcacccctagaaaaaaccaccacctataataaattgcacgagatttgccgcgagaccgcatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcaggggcaagaagccntcctccaccttgctgccccatcacttcgatggactcgccaagggctttgacaccaggtgcaacgatatttgtgt

SEQ ID NO: 84487 - protein, 142 aa, Zea mays
  misc_feature: Ceres CLONE 1570556
  misc_feature (30)..(142): Pfam Name: PK Pfam Description: Pyruvate kinase, barrel domain
  misc_feature: SWISSPROT Homolog: EC 2.7.1.40 Pyruvate kinase
  misc_feature (127)..(127): Xaa is any aa, unknown, or other
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEAXLHLAAPSLRWTRQGL

SEQ ID NO: 84488 - DNA, 945 bp, Zea mays
  misc_feature: Ceres CLONE 1570562
  misc_feature: Encodes the peptide sequence at SEQ ID NO. 84489
gcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaagccgcacgttctcgtcggcgatctgttactacggtggcccgtggggtacaagttcggctcctgtcacgcgacctgctgctgctgccggcgacggcgaggatcctggggtcgcggcttgtcgagcgagagatctcgacgaagccatctcgtcgctgttcctgttcccactgtcaacgctaccgagtagagctgaaacgggccgtcgccgcctgcgacatgatggtggcgagcgcggctacgttcccgtacgtcaagcgcggaatgacgcggcatgtggtaacacacggcttgccaacgacccgagctgggggggctcaagcccgctggcgtgtttctcgccgcgttcagaattctacaatgcggcttc

SEQ ID NO: 84489 - protein, 260 aa, Zea mays
  misc_feature: Ceres CLONE 1570562
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSSRTFSSAICYYGGPWGTSSAPVTRPAAAAGDGEDPGVAACRARDLDEAISSLFLFPLSTLPSRAETGRRRLRHDGGERGYVPVRQARNDAACGNTRLANDPSWGGSSPLACFSPRSEFYNAA

SEQ ID NO: 84490 - DNA, 1135 bp, Zea mays
  misc_feature: Ceres CLONE 1570563
  misc_feature: Encodes the peptide sequence at SEQ ID NO. 84491
  misc_feature (917)..(917): n is a, c, t, g, unknown, or other
  misc_feature (922)..(922): n is a, c, t, g, unknown, or other
atacggaagatttattaggggagtggtgagggagagacatttaaaattgtgtatatgatatactgggctcccgcggggcagcgctctgaacagaggagccctcccggcgtggcggccgctctataactagtggatcccccgggctgcaggaatcgtctcacccctagaaaaaagcccactccagcgctgaaggcctgcagcgccagcgcagcgcctctctgctactgtgctggctgacgccggtggggtgtgagcgaactgcgagctgctgccacccgtgctgccgcggtcgaccgccggccccggaccgagatggacgctcggtgggcggtgctgctcgcgctgctggtcgccagcagcggcgtccttgtctgcgccggccgctgggccaaggggcgccaactgggctgggcgggggtgaccctcccgtcgttccccaaaggggatccggggtaccgggacaggcaaccttgggggttcccattgtgcaaggggacccaatttttaaaacaaaccccccagggggacccccccccgaataggggggaaaaaccatttgtgggggataggattgccccaggggggaaatatatttgggcggcggggggaaaatccacaaaaactggtgcgataaaaccttatgtgggaactgggggagaaactctcagggagtcccaacctttctctgttatccacaagacaggagcgaaaagaaaaaacactcgccgtcaagaaaaaactatcgacaagagggagaaaaaacaaaaacccccccacgagaaaaagaatatttggtggatacccccccgacctggaggggggggggggtgtgccccccccccaaaaaaacgtattgtatgagacgatccagccagagaaaaagggccaccccccccccccccctcccaaaaaaaganagcanaaaggacggaattatgtaatattattttagaaacaccaccccaacaaataataggggggcgcctccccctccccgcttttagggggttaagacaacagatagtggaacaaccacaaaaagatatatatgttgtctcttctttactgggggtcaacggcgcaatagagtgggagtagcccgccttgtattgtgagctatcacacccacctaccg

SEQ ID NO: 84491 - protein, 182 aa, Zea mays
  misc_feature: Ceres CLONE 1570563
MDARWAVLLALLVASSGVLVCAGRWAKGRQLGWAGVTLPSFPKGDPGYRDRQPWGFPLCKGTQFLKQTPQGDPPPNRGEKPFVGDRIAPGGKYIWAAGGKSTKTGAIKPYVGTGGETLRESQPFSVIHKTGAKRKNTRRQEKTIDKREKKQKPPHEKKNIWWIPPRPGGGGGCAPPPKKRIV

SEQ ID NO: 84492 - DNA, 858 bp, Zea mays
  misc_feature: Ceres CLONE 1570564
  misc_feature: Encodes the peptide sequence at SEQ ID NO. 84493
  misc_feature (690)..(690): n is a, c, t, g, unknown, or other
ccccgcggtggcggccgctctagaactagtggatcccccgggctgcaggaattcgtctcaccccctagaaaaattgctcggtcgtgctggcctgggccgtcggcgcgcgttgatcttgcatgtgttctcaggtcgcccccggagggccttccttgctgctgtgttccgctagacctggagtatctcgacgacggtggcaggcacacgcagtgacggcaccactacgtctgttccgccacgagagcctatgtaacgcaagggtcgcgacgtcggcatcgatggctggccagggggactgatggtgggaggcgcaacaagctggtgggggagtctgacggaggccagcatgctggagggcaggtgtcacacccgggtttcggggccaaaacccgagcgcgaaataatcaccatggtgtgggacaaagtctcacacatatgataaacagtggtgtggtcgtcttctgccttccttttctgctatccgtgagacaatgaagcaagcagtgatgggctgctagagggtcagagaccgggatatcgagggcttgggcatcaacgtcgtggatcctatggggcaccgtcggccggcggtgactctgctgcttgataacatgagcgggcccacatggggggttcagatgggcccttggcacccccctaagctagggcccacggaggaactcaccgggncaatctgggcgtcggcaggttcaaactttcccaactttctacgccaaatctggatccctttctggggggcaaaccacctcaacaaataacagctttcctggttccttgccttcctgccctgggctgccttgggaaacctattttccttggtgggggcgggcgaagact

SEQ ID NO: 84493 - protein, 59 aa, Zea mays
  misc_feature: Ceres CLONE 1570564
MCSQVAPGGPSLLLCSARPGVSRRRWQAHAVTAPLRLFRHESLCNARVATSASMAGQGD

SEQ ID NO: 84494 - DNA, 960 bp, Zea mays
  misc_feature: Ceres CLONE 1570565
  misc_feature: Encodes the peptide sequence at SEQ ID NO. 84495
ctccccgcggtggcggccgctctagaactagtggatcccccgggctgcaggaattcgtctcaccccctagaaaaaaccaagcaggcgacacccgttcggtccgtacaggaggggtccaccatgccgtgctcctcctcttcgtcgtccaaccccttccactccctcgcctccgccttccccttcctctcctccacatccccacccccatccccacccgcctcgcccgcgcccgccgctccccacctcgccgtcccgctcctcctccccgtctcctcggcttccgagtcccgccgcggggcgcagccgctgccgggcacgcggatggtcggcgcgggcgcgaccggcgggggtaacatggccagcggtggtggggggcccgcgttcgtgggccaggtgttcaccatgctcgacccatccgggaacgggctcatggccgttaccacacgcttcgagctcccgcgcttcctcaccaacaggactcctatgtggttcaaaaggatgctatcaccgtcgaagaagactgaaaatagtccagtatttaggttttttatggatctgaatgatgcagtatcctatgtaaagcgactaaatgtgccaagcggcatggtgggggcttgtcgccttgatgtagcatatgaacatttcaagggaaagcctcacatgttccagtttgttcccaatgaaaagcaggtccaggctgccaataagctattgaagtcacttccacaaagggggcagaaaggaaaaacctgatgggggtcctgtttttagtgcgcaaaacttgaatattgcagtggcaaccaatgatggaattagatggtacacacaatacttttttgaataaaactggttggaaaaatccctggaggctctatggatcacatttccatccataagcaaaacgccataacgttctaaaagggaaattgccatgaaggtttacatcgaataattgaaaaa

SEQ ID NO: 84495 - protein, 210 aa, Zea mays
  misc_feature: Ceres CLONE 1570565
MPCSSSSSSNPFHSLASAFPFLSSTSPPPSPPASPAPAAPHLAVPLLLPVSSASESRRGAQPLPGTRMVGAGATGGGNMASGGGGPAFVGQVFTMLDPSGNGLMAVTTRFELPRFLTNRTPMWFKRMLSPSKKTENSPVFRFFMDLNDAVSYVKRLNVPSGMVGACRLDVAYEHFKGKPHMFQFVPNEKQVQAANKLLKSLPQRGQKGKT

SEQ ID NO: 84496 - DNA, 869 bp, Zea mays
  misc_feature: Ceres CLONE 1570566
  misc_feature: Encodes the peptide sequence at SEQ ID NO. 84497
tccccgcggtggcggccgctctagactagtggatcccccgggctgcaggaattcgtctcacccctagaaaaacctcaagcccgccatcgagatggaggatctcatcaactcttcctccacggatccgatccagtccgggtcgagctcacccgcctcgagaacgaactgcagttcaaggagaaggagctgggcgatgcgcaggcggagatcaaggctcttcgcttgtcggaccgcgcgcgcgagaaggccgtacaggatcttaccgaagaattggcaaaggtggatgggaagctgaagctcacagagtctctccttgaaagcaaaaacctcgaagcaaagaaaatccacgacgaaaaaaaagcagcgcttgccgcacagttttggcagctgaggcaacccctaccaaaggggttcattgcgggccccgaaagggaggatggccctgcccctccctatttggggggcctttccctttggcccccccctggggaaaaccttgaaaactttaaaacctgggccccctttaaagaaaattggccaaaattttcccggaaatgacaccacgggggctttggggacatcccctttaacaaaagttcttaaggggaaacccctctcctccctttttaaaccgaaaaaaaggcggggtttaaaaggggggcccgggggaaaaaaacttctcctttggggggggggaaattttccccgcaaaaaaaaaaccccccgggggtttttttgtataaaaaaccactttgtggaaaattcccccccccgaagaaaaaaaaaaaaaaaactattttgtgttaaaaaaaaaaacaccccccccccccacaaaaaaaaattttttcgggggggggggtgaaaaaacc

SEQ ID NO: 84497 - protein, 67 aa, Zea mays
  misc_feature: Ceres CLONE 1570566
MEDLINSSSTDPIQSGSSSPASRTNCSSRRRSWAMRRRRSRLFACRTARARRPYRILPKNWQRWMGS

SEQ ID NO: 84498 - DNA, 846 bp, Zea mays
  misc_feature: Ceres CLONE 1570568
  misc_feature (262)..(262): n is a, c, t, g, unknown, or other
  misc_feature (263)..(263): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (279)..(279): n is a, c, t, g, unknown, or other
  misc_feature (280)..(280): n is a, c, t, g, unknown, or other
  misc_feature (289)..(289): n is a, c, t, g, unknown, or other
  misc_feature (290)..(290): n is a, c, t, g, unknown, or other
  misc_feature (336)..(336): n is a, c, t, g, unknown, or other
  misc_feature (339)..(339): n is a, c, t, g, unknown, or other
  misc_feature (353)..(353): n is a, c, t, g, unknown, or other
  misc_feature (418)..(418): n is a, c, t, g, unknown, or other
  misc_feature (419)..(419): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (760)..(760): n is a, c, t, g, unknown, or other
gcggtggcggccgctctagaactagtggatcccccgggctgcaggaattcgtctcacccctagaaaaagccccctccaggccgaggccgccgccgccaactactgacacagtgacacgcaccaatgaccaacccggcggccggccacgaacgataacacgccggcccgcctcgccacgctcccaccctcctgcctccgcgcgccacgaccagccgccccagcagcagatgtcgcctccgtccgtcctggcttcccttccacnntcccgnnncatcccgnncttcagccnnccgccccttcagggaaatgaactccccgggggcaggctccggaagncangggggttcggtcgntcccttgcttccccggttcggcggtccttaccccgggagggggggggtttcactaaaaaaatacnncnnnnnttcaattctatctccatattcctctttactcatatttttatatccactcttctaaataatcacaataatacacacaccctatttacctacctttatttcttttttcattctctcaaactaaacctcctcaactcttttattttttaatatacttctttctaacctattctaaaaccaacaatatatattaatctgatacacttatcgtataaactttaattactaatcacactcttctccccatcgacattaaatccgatcatagttcccgccttggcgtggcgacccgtaagatttaacgcgcttcaggtccagcaggacaggagttgtaagtncgcacccatacccggagatggcaattaagagtcctgcgggtgggggtgggagaacgctcgaatgatgctgagccatacacgacttg

SEQ ID NO: 84499 - DNA, 822 bp, Zea mays
  misc_feature: Ceres CLONE 1570569
  misc_feature: Encodes the peptide sequence at SEQ ID NO. 84500
ctggagctccccgcggtggcggccgctctagaactagtggatcccccgggctgcaggaattcgtctcacccctagaaaaacctctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggggtctatcaagatgcgtgagattgctgaagcttaccctggtagcacgaatcaaaaatgctgtggtcacagtcccctgcccaacttcaatgaacccccagagggcaggcccccaaagggatgcctgggggtggattttccggggcccttaaaggtggcccgggggtttcttctccacaggaaggccccacagggggtggggggggggtttttttttccccctcaaaaggggggtggggtgtgtgaaaaaaaaaaaaaagaacaacccacgctccctccc

SEQ ID NO: 84500 - protein, 219 aa, Zea mays
  misc_feature: Ceres CLONE 1570569
  misc_feature (9)..(218): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMGSIKMREIAEAYPGSTNQKCCGHSPLPNFNEPPEGRPPKGCLGVDFPGPLKVARGFLLHRKAPQGVGGGFFFPPQKGGGVCEKKKKEQPTLPP

SEQ ID NO: 84501 - DNA, 750 bp, Zea mays
  misc_feature: Ceres CLONE 1570572
  misc_feature (263)..(263): n is a, c, t, g, unknown, or other
  misc_feature (357)..(357): n is a, c, t, g, unknown, or other
  misc_feature (384)..(384): n is a, c, t, g, unknown, or other
  misc_feature (488)..(488): n is a, c, t, g, unknown, or other
  misc_feature (617)..(617): n is a, c, t, g, unknown, or other
  misc_feature (618)..(618): n is a, c, t, g, unknown, or other
  misc_feature (635)..(635): n is a, c, t, g, unknown, or other
  misc_feature (638)..(638): n is a, c, t, g, unknown, or other
  misc_feature (717)..(717): n is a, c, t, g, unknown, or other
  misc_feature (722)..(722): n is a, c, t, g, unknown, or other
  misc_feature (724)..(724): n is a, c, t, g, unknown, or other
tccccgcggtggcggccgctctagaactagtggatcccccgggctgcaggaattcgtctcacccctagaaaaagccacacccacacccacaccgcaccaaccaaccccggccggccagccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctangaggaggcgcggcgccggcggagatggggtccaagtacacgcgcgggtgctgcggctggctgatcgtggcgctgattgcggcgctggtggccancggcccgcgatggttcgcccatcatgnaagccgcaaagcccggggggcccgcccacaatcaaaacccccttcccccggttccccggggccccccccggggggggccccttcccaactccccaaaataaacngggaaaacacccccccccgggggggcccccccccccccaagagggtgtgaaaacttataaattttttaaaaaaaaaaagggggggggggaaaaaaccctgggggggaaaaaaaaaacaccccccaaaanncccccccccgccctttnttntattttgggggggggggggaccaccaccccccccccccccttctttttttctctttcctccccccccccccgccccccntaaantnttagaagaggggggaggagggggggg

SEQ ID NO: 84502 - DNA, 938 bp, Zea mays
  misc_feature: Ceres CLONE 1570574
  misc_feature: Translation starting site: 611
  misc_feature (756)..(756): n is a, c, t, g, unknown, or other
ggagctccccgcggtggcggccgctctagaactagtggatcccccgggctgcaggaattcgtctcacccctagaaaaaagcaggcaccagtgcatcgccaccgtaccggagggggcagcgcccaaaaaaggcaaacgggagggtgggcgagcctgctcttcctgtctgggagagagaccgaagaagaggagagagaggcgcagcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcgcgcgtagcggcgtaggtaccatcatcatccatccccgcgacgacccaccacccacccctgcagtctgcagcatccccttccccactcccggctggtctgctgcggccacccctgcgccgatccacctccgctgcttcctgcctcaatatattcgcccgcctcgtcgcgtccgaccccgccacagaaggccttccagaaccctccgacccctcacctccgccccgctccactctcctcctcctcccgggccggccgactccgatggccgtcgtcgaggccgccgccgccgaccacgccgcgccgccgctccaggaggaggcaccgggcgcgggcgcgggcgctggcgcctacgcccgggagcgcgagatgcgggatctggaggactgctctccagctcaacccatggncgaaggatttgtcccgccgtccttggctcccccgcgcccttaagcccgggccggtctccccggcggcttaagtttctacccggccggcgccggctcccggtcgcctcgccgggcccaggggggtctccggctttccggcggtccggaacccaaccccccagagcaaggaaaaaggcggacca

SEQ ID NO: 84503 - DNA, 875 bp, Zea mays
  misc_feature: Ceres CLONE 1570575
  misc_feature: Encodes the peptide sequence at SEQ ID NO. 84504
  misc_feature (512)..(512): n is a, c, t, g, unknown, or other
gcggtggcggccgctctagaactagtggatcccccgggctgcaggaattcgtctcacccctagaaaaatagatccagaccaaacgaactccacactaccctctgcccagctcgcgcacgcatgaaaccctagtgaccccgtccagatctcggcgtccggatcactgcgcggcgccgccatggcgccccccgcgctggactctctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccttacttcaactaccgcaccacgctcttcctcaccgagaacggcttcaggcgagttctgggaactggtttggacttcgaaaggctggtaccccgctcggggcgcgttggtcgggggggacgcctctaccccgggttcttgatggggaacccgccgcggnctggctccaacggcctttcctcccgggggggctgtttccctcccccgggcccaacattcccggtgagggggccgggggttgcttgaacccgggcggccctttttttttgggtgggcccaacaaccaagggcttgctggtgggcccttaaggcgtttcgtgggcggggggggggaataggggggagctccgggggggggggggggtttctgttcccccgcgtgttcccggtgaaatcccccaccttcccccccggggtatttaatttgtccccgcctcccgtgtgggggggggtggcgtcccacacaaaccagatgggggggcgggccccctttttttccgcgcgggggtgtggtcaccatctt

SEQ ID NO: 84504 - protein, 139 aa, Zea mays
  misc_feature: Ceres CLONE 1570575
  misc_feature: SWISSPROT Homolog: EC 2.4.1.119 Dolichyl-diphosphooligosaccharide--protein glycotransferase
  misc_feature (112)..(112): Xaa is any aa, unknown, or other
MAPPALDSLPAPLRSLRLKTKQQELLLRVSALALIYVLAFAVRLFSVLRYESMIHEFDPYFNYRTTLFLTENGFRRVLGTGLDFERLVPRSGRVGRGGRLYPGFLMGNPPRXGSNGLSSRGGCFPPPGPTFPVRGPGVA

SEQ ID NO: 84505 - DNA, 854 bp, Zea mays
  misc_feature: Ceres CLONE 1570578
  misc_feature: Encodes the peptide sequence at SEQ ID NO. 84506
ctccccgcggtggcggccgctctagaactagtggatcccccgggctgcaggaattcgtctcacccctagaaaaactcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcacccgaccaaggaggcgcccgtcatcgactacaagctcgcgttgctcttccagcccatgcttatgctcggcataaccatcggcgtagagctcagcgtcatcttcccatactggctaatcactgtcctcattataatcctcttcgtaggcacctcgtcgagatccttctacaagggaattctgatgtggagggaggagacaggattctgacggagacacgcgggcgaagagagcaatccagtctacctgcgctgcaggtgatgtggtcattgatcccagttatgggggagc

SEQ ID NO: 84506 - protein, 209 aa, Zea mays
  misc_feature: Ceres CLONE 1570578
MVMEGRTGSLYGRLNKSSTRGFLAYTAAGAACAAVLACFVLSAADSPASAARNDGARLRLSSRSPRVWPDLAFNWRVVVATVVGFLGSAFGTVGGVGGGGIFVPMLNLVVGFDTKSAAALSKCMIMGASASSVWYNLQVSHPTKEAPVIDYKLALLFQPMLMLGITIGVELSVIFPYWLITVLIIILFVGTSSRSFYKGILMWREETGF

SEQ ID NO: 84507 - DNA, 895 bp, Zea mays
  misc_feature: Ceres CLONE 1570579
  misc_feature: Encodes the peptide sequence at SEQ ID NO. 84508
ccgctctagaactagtggatcccccgggctgcaggaattcgtctcacccctagaaaaaattgcattgtgcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggaccgcctggccatcaacgactgcctggagctgctgtccaccacgatggacgagctccgcgccagcaccgccgacctggcgtcccccgccggcatggggtcggcgtcggcgggcgtgtcgcaaggcgccaggcgcgcgacgatggagcacgtgatgacggtgctttcggcggccatcaccaaccagtacacctgcctcgactgcttcccgtacataaccggcggcgcgtgccgcgcttcatcgaggccgactttccccacgtgtcccgcatggtgagcaactcgctggccatggccaaaaaactgcccggggccgggcccttagcggcggcaggccccccgccggaaccctttacggggttaccggcaaatgggtaaagggttcc

SEQ ID NO: 84508 - protein, 193 aa, Zea mays
  misc_feature: Ceres CLONE 1570579
  misc_feature (34)..(182): Pfam Name: PMEI Pfam Description: Plant invertase/pectin methylesterase inhibitor
  misc_feature: SWISSPROT Homolog: EC 3.1.1.11 Pectinesterase
MPPIPKRGEHLLVLLIVACAATAATAAGTVPFYPSAESAAAAHCDGTLYPELCLSTLADIPDLHKKPLPDVICAAVNRTEDVVVATSSNCSYYLQDRSLSARDRLAINDCLELLSTTMDELRASTADLASPAGMGSASAGVSQGARRATMEHVMTVLSAAITNQYTCLDCFPYITGGACRASSRPTFPTCPAW

SEQ ID NO: 84509 - DNA, 764 bp, Zea mays
  misc_feature: Ceres CLONE 1570580
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
ctggagctcaccgcggtggcggccgctctagaactagtggatcccccgggctgcaggaattcgtctcacccctagaaaaaacctccctttcctcttcctgctgctcctcgcccagacttgttccccgcaggagcaaggcggcggcggcggcgccctccacgggagcttcgtccgctgcgtggcgcgcctctcgccggccaccgccgacacgtccaggctcgtccacgccccgtcggccgcttcgtacccttccctgctgaacgccaccatccagaacctccgcttcgcgtccccgcggacaccgcgcccggcgctgctgctgaccccggcgaccgtcgccgaggctcgggcctgcgtcgcctgctgcaggcgccacggcctcacggtccgcgcccgcagcggcggccacgactacgagggcctctcctaccatcgggtggcgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnn

SEQ ID NO: 84510 - DNA, 859 bp, Zea mays
  misc_feature: Ceres CLONE 1570581
  misc_feature: Encodes the peptide sequence at SEQ ID NO. 84511
ccgctctagaactagtggatcccccgggctgcaggaattcgtctcacccctagaaaaaagttcgtctctctcctctcctcgcctaaggtttcgcctcctgtgatcccgtctcgccgtcgtcgccatgggggacaactacgacgacgaaggcgagccaatcgtggacctcgacgaacgggagccctctcctgagccacagccctacgaagatctcgatgacgacctcggcgacggcggcgattggacccgcagccgctccccgacccccgtccacggcgacgacggtgaggcggggtcctccgccaagccccggaagcgcctcctcaagaagggcggcggtggcggcatgcccggcgacgacgggctcgatgactttgggttggaggacgaggacgcggaccccgcggctgaggcgaggaagaggaaggggtcctcggcgctgagggacctcgcgaggggcggggcgggcaaagagaagaaggagaagaaaaaggcggagggaggacgacgggaggggaagtgatatgggaatgggtgagggacaggcggggaacccttggaggaagggacctcacgccttaatgaagtaacagtatggtccgcggtcacgggtcgcgggctctatatggtggttggcgagtggcgggtgtattcgcggtatttgtgttcttatggacgcggcagcgtactcattttgtctcgagtatttctcatcgccgtcttcaacgatcgtcatcgaataatcatattgatatatttggttaaacctatctgtgaagtggtaacagtgcttttgtgtgacgtaaggacggaatactctcattgatgagaaggggaagttaggtgatcgccggagagg

SEQ ID NO: 84511 - protein, 132 aa, Zea mays
  misc_feature: Ceres CLONE 1570581
MGDNYDDEGEPIVDLDEREPSPEPQPYEDLDDDLGDGGDWTRSRSPTPVHGDDGEAGSSAKPRKRLLKKGGGGGMPGDDGLDDFGLEDEDADPAAEARKRKGSSALRDLARGGAGKEKKEKKKAEGGRREGK

SEQ ID NO: 84512 - DNA, 918 bp, Zea mays
  misc_feature: Ceres CLONE 1570584
  misc_feature: Encodes the peptide sequence at SEQ ID NO. 84513
  misc_feature (918)..(918): n is a, c, t, g, unknown, or other
acccgcggtggcggccgctctagaactagtggatcccccgggctgcaggaattcgtctcacccctagaaaaagccccacactcgtccactcaccccctctttgctctgcctcgccgcgccgcagagcagagcatggcgccccctcgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaggtcgcggcggcggcgtcgcgcgcgtcctacgcgctgctgtgggtgcgccggaacgtggcggcgtaccacccggccacgcagatccagggcatcgccgtgggcaacgaggtgttcgcgtcggccaagaacgtgacggcgcagctggtcccggccatggccaacgtgcacgccgcgctggccaggctcggcctcgacggggccgtcaaaggtgtcgtcgcccatcgcgctcacggcgctcgcgtcgtcctacccgtcctcggcgggcgcgtttcgggaggacctcgcgcaggccgtcatgtaagccatgctcgacttcctggggcaaaaccgggtcgttcctcatgggggaacgcgttaccgtttcttcgcttacttcgggaatgcgggagaaaatctcacatcgaaatacggcccgggttccgcccccaacgaccgggggtgttttaactgccgggtaaaacggcttccaatgtattaatagccctccctccaatcccgctatctggggaacgccttgtgttctccccn

SEQ ID NO: 84513 - protein, 234 aa, Zea mays
  misc_feature: Ceres CLONE 1570584
  misc_feature (29)..(234): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVVVALPNEQVAAAASRASYALLWVRRNVAAYHPATQIQGIAVGNEVFASAKNVTAQLVPAMANVHAALARLGLDGAVKGVVAHRAHGARVVLPVLGGRVSGGPRAGRHVSHARLPGAKPGRSSWGNALPFLRLLRECGRKSHIEIRPGFRPQRPGVF

SEQ ID NO: 84514 - DNA, 1266 bp, Zea mays
  misc_feature: Ceres CLONE 1570589
ttttttctcatcatttggaaaatcacctccctttcatccgccctattttttaccaaatacattatttctggagtccccgcggtggcggccgctcctgactagtggatcccccgggctgcaggaattcgtctcacccctagaaaatgccctcccccaacacaaagcgagattcttgcttgcttggcagagccatgtcaagaaagatttatctggtcggccgatcgagctcctctcctccgaagcactgaagctccagcggctgccctgcctgacagccactccgcacgacaaaattaaacgcgggcgatcaagatggcgcacgaccccagcctgggcttctcggactacttctcggcggctgcggcggcgggcgccacggctatggacgacgacttcttgggcgccggatctctatggcctgcacgccgacgacatggagtttcctcggcatgattggcctggtatgaatgccaccccgccgcggcacaccttctgtacctccaccatcactgccacagcatggccggtgctctctctcgactaagtttttcacgtgggtggggccatgacttcatggggctccttcgtacgactccccactggcgctttcctgaagctgatacatacagcttgatgctttcttccatggcgcccacttgttccctgttctcatgtgccccacccggtaatcttggccgtattaaaatattgcaacgaggcaagcatgatccctccgtcacggacgttagagtatccctctgtccctcgtgaaagccctgtctttgataacattccactctccgacagttacttcggtggtgtctattctatcatctttccatcatataaggacaaagctccactgtacgtatcctgaatatcttttttaaaatgagggtgagcgtaacatgggtggcttcgaagtgatccaatgtatatcatattcggtcgccatggggagcgaaatcaatggtacactcctgcacggggtatatctttttctagtcatcttcacccccattagtagaatgtaattcagtagtgtgttgtgcgttgctctatagtgtgagggtaggttcacaaaagatgcggtataaagataaacccggtgactcccacgtattacactgtaattcctacaagattataagtctgtgagaactaccacaaaatgagcgcccgattctttataatgatgtcatagaggcccactttcccccctttactcatgtgtatgagctgtccccaggcttacttctacatcgc

SEQ ID NO: 84515 - DNA, 814 bp, Zea mays
  misc_feature: Ceres CLONE 1570592
  misc_feature: Encodes the peptide sequence at SEQ ID NO. 84516
ggagctccccgcggtggcggccgctctagaactagtggatcccccgggctgcaggaattcgtctcacccctagaaaaaaagattctgccaaaagatcctctcggatgcccccgcccccgcccacccatttcgccagtcgccatcgagctctcgcttccgccgcccgctgccgctctatcaccccggtgctgagccctaggatgtgactggcggacgtctctatggccgagccgtaggtggaggcggcacctcggcgccgtgggagatggaggacgatgacaccgagggtgtaggcgagagcacctgtccccccgccgccgaccgaggaggctcctcctcggccggcggcggcggcggcgactcgcacagttacactgacatagagaaggaggtcttcgaccgtctcatggagaagagaatcccggaggtcgtcgcggacccggtggccttccgcgaagagctccgccgccacttcgagcgcctgccgctgagctacgccgtcgatgtgaacgtcgacaaggcggaggacgtgctgctgcaccggaggattctcaacgagtgcgctcaccctgaaaatcgccccatcttccatgtgggccttcctgaactgcatcccgccctcggtggatccacagtataacactcagtccatctctacgagcgaaaacggtaatttgtggggttctcaggattccactttgagaaaatttgagccatggcgagggatcgaggacgtcagttttactggaccaaaagtggtggttgactctggggcccagttcttgaggggagatgagaaatcctcctggtcatg

SEQ ID NO: 84516 - protein, 124 aa, Zea mays
  misc_feature: Ceres CLONE 1570592
MEDDDTEGVGESTCPPAADRGGSSSAGGGGGDSHSYTDIEKEVFDRLMEKRIPEVVADPVAFREELRRHFERLPLSYAVDVNVDKAEDVLLHRRILNECAHPENRPIFHVGLPELHPALGGSTV

SEQ ID NO: 84517 - DNA, 823 bp, Zea mays
  misc_feature: Ceres CLONE 1570593
  misc_feature: Encodes the peptide sequence at SEQ ID NO. 84518
ctcctcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctgaaagcccccgggcagcgactagaccgcgcccgccggccgccccccgccggctagctagctagctagctcctgcgtgagctagtagctagtgccatgcgtcgtctctgtcgttcggttttgcttcgggtcaccgtgtaccctttgcttgcttggttcctcctttcattttttcctttttttcctcttttccccggcatgga

SEQ ID NO: 84518 - protein, 163 aa, Zea mays
  misc_feature: Ceres CLONE 1570593
  misc_feature (58)..(163): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIA

SEQ ID NO: 84519 - DNA, 854 bp, Zea mays
  misc_feature: Ceres CLONE 1570599
  misc_feature: Encodes the peptide sequence at SEQ ID NO. 84520
  misc_feature (545)..(545): n is a, c, t, g, unknown, or other
gcggtggcggccgctctagaactagtggatcccccgggctgcaggaattcgtctcacccctagaaaaaagccgccgcctccttccctctcctcctccacgtctcctcaacagccgctgccacccggagccttcccgcagcgacgccatgtgggctcttcgccgagctggcaaccccctcaggttccgtgcccaaaaagttgcaagtgcctatgtctgtgcgagtcttgaggtgctgctagctgctgatgcaaagaatgtagaagagcaccatgaggcagactgccagaaaatgtgctgctgtcataaaccaaggtcaccagcctttcaattgtcattttcatctggccagtttgcttgcagtaggggtttctcctctcagccaggtgcaaattctggtgacaaagctgatgagttagaggacggattttctgatctcgaggttccaccagcagctgttcaaaacgatgacgggttggcatctgaagatagttctgatgaggatgctgctgacgaatttggcttgcctgatgtggatgctgatgcnaaaactgagaaggagcacactagaagattatctgattctattctcctcaagacattatctgattctattctcctcaagactgtgttggaagctccgaggcatcaagtcacttcaccacttgagaaatgggcaaaggatggcatgcatttggaaaggggtgaactcaataaggttcttcttaaacctccgaagccggatttggtactcaaaacctctggaccttgtttgagtgggttcaaaaatcacagctattcaagtttgagaagcgggattttcttgcccttcttgttttaccccctaaggcctttt

SEQ ID NO: 84520 - protein, 236 aa, Zea mays
  misc_feature: Ceres CLONE 1570599
MWALRRAGNPLRFRAQKVASAYVCASLEVLLAADAKNVEEHHEADCQKMCCCHKPRSPAFQLSFSSGQFACSRGFSSQPGANSGDKADELEDGFSDLEVPPAAVQNDDGLASEDSSDEDAADEFGLPDVDADAKTEKEHTRRLSDSILLKTLSDSILLKTVLEAPRHQVTSPLEKWAKDGMHLERGELNKVLLKPPKPDLVLKTSGPCLSGFKNHSYSSLRSGIFLPFLFYPLRPF

SEQ ID NO: 84521 - DNA, 952 bp, Zea mays
  misc_feature: Ceres CLONE 1570600
ccccgcggtggcggccgctctagaactagtggatcccccgggctgcaggaattcgtctcacccctagaaaaactcctcccgagtcccgaactctcgatccactcatccgctgagggcgtcggccttctggcccttctccccccggccgacctcgcccctccggcgctccgtccgcttcctgaactcgtctccctcacggacgttctcctccctccgctcgccgcgccgcaacccggagaggagaccgccgctcggtcgagcaccacctggggcccagcgtcctcgcgaccagctctagcgcggcgtccgccctctgcagccctggtgtccccgcgactggcttcggccggcacacaactccacagttaggtctccgtctgcacagcgcggcgatcttctctctccttcccgccctctgcagtccctctcagtccctctccgtctgcttgattctgctccaacctcagactaccctcgctctgaaaatgtcattacgcacccaatgcgcttgtagctgtatgctgcaaccctactctgcctcgtcttcttccatcaccctaagcatgcgcgcaacccccgctcactaacgacgggcccggccggccgccgccgtgctgcctctccacccgccaccttctgccggctgacaagccccagccaggaattaattagaggtcccaaacttcggttcctgcagtttctcctaataaagcagggatgattaaggattcctttattaatttgggcctctcctcatcccaaatacggtcgcagtgggtgaggttgctttgaatcgtggaaggggaaaggatttttgaaacctctttgaaccagaacacaaggattcgggaaataaaagataggattgtgccgagggaccctgtgtttagccccctcctatttgtgaggaagggaattagaacgggttcccgtctcagttgttggacgatcg

SEQ ID NO: 84522 - DNA, 764 bp, Zea mays
  misc_feature: Ceres CLONE 1570601
  misc_feature: SWISSPROT Homolog: EC 4.1.1.31 Phosphoenolpyruvate carboxylase
ctccccgcggtggcggccgctctagaactagtggatcccccgggctgcaggaattcgtctcacccctagaaaaaaaattcctgcacactagacataacgggtgatactttgcacatgtccagggactagctgtacaactgaagccaaaatgctcgccatctgctggcatctgtagttgccgaaacttcacagcaatcatcatttacgagaatgcaacatctgcttgaccctcttgatctgcgctacaaataactgtgtgactgcagcgacaaggccatctacgaaccgtagcttcctgcacctcatgcgccaagtgttcaagtctcaggctctccctagtgaaactggacatccagtaagactccgagcggctcaccgaagtgatcgacgccatcaccacgaagatgagggtccggtcgtactgccgagtggtccgacgacaacaggaaaaagtgactgactgtcgttatctgccaggcaagctggccgctgctgcccacggaccttcgccaggacgacgagatcgccaagaatttcacgcgctttacaagtactcgcggagctcccgcccgaatgcttcagcccatacatcgtctccatagatacagcccccatcgacatgctagcactatagatcctgcatcgcaacgcgacttgatccagactctgcacatggtgccgatgttcaagagctgagatgacatgcagtcgagcctcttgcagtggatcgccttttgcgttggactgatactgcaccggatcaa

SEQ ID NO: 84523 - DNA, 831 bp, Zea mays
  misc_feature: Ceres CLONE 1570602
  misc_feature: Encodes the peptide sequence at SEQ ID NO. 84524
  misc_feature (378)..(378): n is a, c, t, g, unknown, or other
  misc_feature (379)..(379): n is a, c, t, g, unknown, or other
  misc_feature (609)..(609): n is a, c, t, g, unknown, or other
  misc_feature (635)..(635): n is a, c, t, g, unknown, or other
ccccgcggtggcggccgctctagaactagtggatcccccgggctgcaggaattcgtctcacccctagaaaaaattccatcacccccagcttgcgcgctgcactccctccctgcccctgttctctctctcgtggcgacggcgacggcgacgactgggcggccgttgctgccgccctactcgccaggcgcccaggtattcttcggccccttcgccggcgacgagtgtcaccaggttcctcgtctccggaacgcagtgcaaagcagatcgatctcggcccagcaggggcctcacgacttgactcccaagactccagggctggatcgtgtttcttccagtgtgcaagcttggatctcgtaggtctggtttagaaaggaccgnncttgctctttgctgccgcaatcatgcaaagtgggggcgacatgaggcctgtgcacaacagtgtcgatacagttaacgctgctgctgttgccatcgtcaccgcggagagccgcacacagcctcctgctgaacagagaaggaaatgggctgaccggttgagcgtgtacttctgctttggatcacagaagaatggccggcgcatgcgtgtcaaccatgccgcacttgtcccanaacctgcacctcaaaggacagatgcncctgcagcagaaaatccaaaccacccacccgcctcctgtgttccccctttgtggcaccgccatcctctcctgctttctttccttcaatcaaaacccacatcaatcctaccatcacccaagggctgggagctccagccttttttcgcccctcttcaccaatttccaattccccgaacggggccacccatccattttg

SEQ ID NO: 84524 - protein, 143 aa, Zea mays
  misc_feature: Ceres CLONE 1570602
  misc_feature (70)..(70): Xaa is any aa, unknown, or other
MQSGGDMRPVHNSVDTVNAAAVAIVTAESRTQPPAEQRRKWADRLSVYFCFGSQKNGRRMRVNHAALVPXPAPQRTDAPAAENPNHPPASCVPPLWHRHPLLLSFLQSKPTSILPSPKGWELQPFFAPLHQFPIPRTGPPIHF

SEQ ID NO: 84525 - DNA, 1012 bp, Zea mays
  misc_feature: Ceres CLONE 1570604
  misc_feature: Encodes the peptide sequence at SEQ ID NO. 84526
  misc_feature (52)..(52): n is a, c, t, g, unknown, or other
  misc_feature (55)..(55): n is a, c, t, g, unknown, or other
  misc_feature (129)..(129): n is a, c, t, g, unknown, or other
  misc_feature (150)..(150): n is a, c, t, g, unknown, or other
ccgctctagaactagtggatcccccgaggctgcaggaaattcgtctcacccnctngaaaaaaaaaaaaaaaaaaaaaaaaattattcccccgttcgcattcccgcaacacctggctcctgcgccccctntctctcagaggcgacgcctcngggcgctcctaccctagccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacgggctcttggagaagaaagaaccaggaaggagctgattccttttcttagtgaaaacaacgatgatgaagacgaggtgcttcttgcaatggctgaggaattgggtgtgttcattccgtatgtggggggtgtagaacatgctcatgttttgctcccacctttggagacattgtggacagtggaaggaaacttggtgtccgtgataaaagcagtggattctctgtggccgaattgggtgcccaaattgaaggaaactgaaatttgtcggactggtttcatttccaggtagtaaagaaggcctatccatcttgggaagagtgggttttccagctccgcggtatcggcccctgggggtcttttttccccataagccttatcccaaggggcggtgcggaccattttggaaaacagaattggagggattttcttatgggtcaggctttggccaggattgacatggcctattgggcccagaagaaacagccgcctccatatcttggggaagattggccggttccgtgttgacacgaatctctttggaagacccaaaaaagggcaacttttagatgtatttaccccagtaggtctaaatttcgtgggctctttgtgccgtgtttaagacttggccccccctgggaaattgg

SEQ ID NO: 84526 - protein, 132 aa, Zea mays
  misc_feature: Ceres CLONE 1570604
MAMIDEPLYPIAVLIDELKNEDIQLRLNSIRRLSTIARALGEERTRKELIPFLSENNDDEDEVLLAMAEELGVFIPYVGGVEHAHVLLPPLETLWTVEGNLVSVIKAVDSLWPNWVPKLKETEICRTGFISR

SEQ ID NO: 84527 - DNA, 781 bp, Zea mays
  misc_feature: Ceres CLONE 1570605
  misc_feature: Encodes the peptide sequence at SEQ ID NO. 84528
ctcaccgcggtggcggccgctctagaactagtggatcccccgggctgcaggaattcgtctcacccctagaaaaaacctctccttccctccacccgtgccgtcacctcgcctatccgatctgccacctcctcccgtctcgcacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaagggcccaaagtaccaagaaattgtaaacatccgacttggagatggcaccaatcgccgtggtcaagtcctggaagttgatggcgaaaaagctgttgtgcaggtctttgaaggaacttctggaatagacaacaaatacacaaccgtgcagtttacaggcgaagttttgaaaactcctgtctcacttgatatgcttgggcgcatttttaatggttctggaaaacctattgacatggccccccgatattgcccgaaagctacttggatattctcctggaaagtctattaaaccccagtgagagaacctatcccagaagaggatgatcccaaactggggatatccacccattggatgtccatgaatttcccatggcctcgggggaccaaaaaaatcccacctggtttttccggctgggctggggctcccctccccaaaggaaaattggctggcctaaaaatttttggcc

SEQ ID NO: 84528 - protein, 132 aa, Zea mays
  misc_feature: Ceres CLONE 1570605
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGIDMEEGTLEIGMEYRTVSGVAGPLVILDKVKGPKYQEIVNIRLGDGTNRRGQVLEVDGEKAVVQVFEGTSGIDNKYTTVQFTGEVLKTPVSLDMLGRIFNGSGKPIDMAPRYCPKATWIFSWKVY

SEQ ID NO: 84529 - DNA, 821 bp, Zea mays
  misc_feature: Ceres CLONE 1570607
  misc_feature: Translation starting site: 121
  misc_feature: SWISSPROT Homolog: EC 6.2.1.12 4-coumarate--CoA ligase
ctccccgcggtggcggccgctctagaactagtggatcccccgggctgcaggaattcgtctcacccctagaaaaaatcttctctccccagattcactcaccgtccgtccgtccagggagccatggcagcagcctgcatctgtctgcagctctctctcccaagcaaccattcttcctctgcatgtcctccagcatacaggaagcgtgtcgcgctagccccagggagaggaaaccgtcttctctgcactgcatctggcgcctcttcttctgtggtggtgaccaaggagcaggaggaaggatctcctgagcccgaaatctttagctacaaagacgaccccaacttcagtggcgaatgcaggatcttgcactggtataatcaagcagccacccacaggatgatgtgcattattacgctgctgccgtcttcttgacgaactcgtccctgagctgcctccacaggatcttgccggacaccgacttggggatggcgtccacgaagcgcagcagccggagcttcttgtacgacgcaacgcgccccgccacgtacgccatcatgtccgcctcgctctccggcgcgccacgtcgccgcaccacacacgacgccgggacctcgccggcctcgtcgtccggcagcctgcgcccacatacatgcatgatgacgcgcaggtacacacgcagcacaatctccaactgcatgccgcggtacgctcggtcgcttacccgaagacggcggcgtcctcgacggacgggtgagacagcaagatggcctccagctcagcatgtgcgacctgggagcccttgtacttgatgagctccttgatgc

SEQ ID NO: 84530 - DNA, 811 bp, Zea mays
  misc_feature: Ceres CLONE 1570608
  misc_feature: Encodes the peptide sequence at SEQ ID NO. 84531
  misc_feature (421)..(421): n is a, c, t, g, unknown, or other
  misc_feature (422)..(422): n is a, c, t, g, unknown, or other
gcggtggcggccgctctagaactagtggatcccccgggctgcaggaattcgtctcacccctagaaaaagtgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaataccttctcgtactatgatcaggtccttgacaccactgccatgctcggcgctgtccccgaacgctactcatggactggaggagagattgggttttgacaccctacttnnctccatggccagggggcaaacgcccactgttccctgctatgggaaaaatgaacccaaatgggtttgaaacccaactacccacttttttggcccggaatttgggcaaaaaccaagtttccctttgctttcccaaggtgtttaacaaattaaggggggtaaaggcccccgggttaaacccggcccccaacttttggaacacatcccaacctgtgtgtcttaaaaccctccaaagggggtgggaaaaaggattccccctttttttccccccttaaagaggagcctctttcccttttaaaaaaaggggtattttttttattataaaaagagaagggggggggctctctcggagaaaaattttttggaaagcccccctcctttttgttttccac

SEQ ID NO: 84531 - protein, 91 aa, Zea mays
  misc_feature: Ceres CLONE 1570608
  misc_feature (2)..(91): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTFSYYDQVLDTTAMLGAVPERYSWTGGEIGF

SEQ ID NO: 84532 - DNA, 897 bp, Zea mays
  misc_feature: Ceres CLONE 1570609
  misc_feature: Encodes the peptide sequence at SEQ ID NO. 84533
acccgcggtggcggccgctctagaactagtggatcccccgggctgcaggaattcgtctcacccctagaaaaagcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacgtcgtgagcgtgcagagcaattaagcaaagcagggcttgggtaaatcattattgaaagcatctcccttttacatgtaaccttgcatacaatatctgttaagatgagttcactaaataaagttgtttcaaatagtggagatgcatgttcagtcttagctagtaaagtcacatcattaaatcccaatgcagcggagtttgtaccgtcatttgttaaaccatcttttggaaatggtacagttctagataagtcagatttcaggggttcttctggaaaaacattctagataggcctgagccatcaaagtctaataactcagatgatgaggcacaccagttttggcataagcagcttccggatgacattattccagacttcactccttttgagaaagttgacaagggcctgaactgtcccttgtctgaattatccttgatgcaccccccttttatgggacaacttcagtcgcttcctcagagaatacacgaattatcttctccagtacaaggggcctggaccgggactggaactactaattgctatttgaagataaaagcactggaagca

SEQ ID NO: 84533 - protein, 60 aa, Zea mays
  misc_feature: Ceres CLONE 1570609
  misc_feature (20)..(37): Pfam Name: PAM2 Pfam Description: Ataxin-2 C-terminal region
MSSLNKVVSNSGDACSVLASKVTSLNPNAAEFVPSFVKPSFGNGTVLDKSDFRGSSGKTF

SEQ ID NO: 84534 - DNA, 770 bp, Zea mays
  misc_feature: Ceres CLONE 1570611
  misc_feature: Encodes the peptide sequence at SEQ ID NO. 84535
  misc_feature (389)..(389): n is a, c, t, g, unknown, or other
  misc_feature (392)..(392): n is a, c, t, g, unknown, or other
ctccccgcggtggcggccgctctagaactagtggatcccccgggctgcaggaattcgtctcacccctagaaaaaattgctcaccccaaagcaaagcaatcacgagcaatgggcgagataggcacggaccaccgcggcctagccgaggccgaggccggcgtcggcggcaaggaggagggcatcgtcctcggcggccacgaggaggaggaggagacttcgccggtggagcaggtgcggctgacggtgccgtcgacggacgacccgtcgctgccggtgtggacgttccggatgtggagcatcgggctgctgtcgtggcgtcgctgccgctgggccacttcatggcccgcgcgctgccgcgcgccaggttccgggcgcccgcgctgctgggcngcnggggagtggagccctcaccccggggccctttcacgtcaaaggagcacgtggctcatctccatctttcgccaacgcccggctttcggcgttcgggcaccgggaggcgccctacccccgtcgccatttatttgaaatttattcccgggccctttttaccccccggcccccattttccttttcttttacccgcccttgggttccttccgttgggaacccaccccaaaggtggcctccgggttacccgggggggggcaaggggctttccttcccccaaaattacccttggggggccaacccgcgggccccccatagtgggggggggggccgggggcaacccccctctcccccaggggtttctccccctctttcctggggggg

SEQ ID NO: 84535 - protein, 138 aa, Zea mays
  misc_feature: Ceres CLONE 1570611
MGEIGTDHRGLAEAEAGVGGKEEGIVLGGHEEEEETSPVEQVRLTVPSTDDPSLPVWTFRMWSIGLLSWRRCRWATSWPARCRAPGSGRPRCWAAGEWSPHPGALSRQRSTWLISIFRQRPAFGVRAPGGALPPSPFI

SEQ ID NO: 84536 - DNA, 840 bp, Zea mays
  misc_feature: Ceres CLONE 1570617
  misc_feature: SWISSPROT Homolog: EC 6.2.1.12 4-coumarate--CoA ligase
ctccccgcggtggcggccgctctagaactagtggatcccccgggctgcaggaattcgtctcacccctagaaaaaattacgcgcctccgcggctccccagtccccacgcaggaccgctctgttctgacagcaattggcacaagcagctgtgggcgcaaaagaacaactgcaatcgagcaagggacaatggcccgcaccgcagatccggccgcgaggctacggagaggacggagtgtaccactccgccaccggccaatccctcaccttcaccgcctttctctccgccgtcctcaccacggccgtcgccctctcctcgcgcgcgggcatccggaacggcgacgtcgtcctcttcttcgcccccaactgcttcctctaccccgtcagcatcttgcgccgtcaccgacctctgcgccgtcgataccacgggcaaccccctcataacccctcgcgaggtcgctaaacaggccaccgactcgcggggcaagctcgcaatcaaggtctctgtactcattcccaacatagttgacctcggcatccccaccatcctgctcgacagcgggcgggactgcaaacacggaagtgcaacagacctccagcctcatggaaacaagcgtgacactttaatcaatactcgtttccgggggcgcgaggaaaaagaattacggccccccgcccaaccaaacaaaagcaacccctgcgggcgctgattggactccttcccggaaaaaacggggggcgtaacaaaaggcgtgatttcccagataaaccccaaaaactaattccctttcagggggggcgtgtaatgtgccccaaggaaccacccataccccctctcgtggat

SEQ ID NO: 84537 - DNA, 936 bp, Zea mays
  misc_feature: Ceres CLONE 1570620
  misc_feature: Encodes the peptide sequence at SEQ ID NO. 84538
  misc_feature (679)..(679): n is a, c, t, g, unknown, or other
  misc_feature (687)..(687): n is a, c, t, g, unknown, or other
  misc_feature (772)..(772): n is a, c, t, g, unknown, or other
  misc_feature (903)..(903): n is a, c, t, g, unknown, or other
gcggtggcggccgctctagaactagtggatcccccgggctgcaggaattcgtctcacccctagaaaaacccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaagggtgtggcagctggtgctaatcctgttcagattactcgtggtatcgagaaacagcgaaagcactagttgaagaaactacggaagtgtctaangaggtcgnagatagtgagcttgcagaatgtgctgctgttagtgcgggcaacactacgaaatggtaatatgatagcagaggcatgagcatgtcngtcgggagggtgtggtacctcgaaaaaggaggagtctgaaacttctctatgttgtggagggatgcaaattgacgtggttaatctcccctactttgtaccaaaatgagaaaagtctgcaagttgaaactgcnagctactttgttgacaaagatcccaacgagggt

SEQ ID NO: 84538 - protein, 160 aa, Zea mays
  misc_feature: Ceres CLONE 1570620
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKGVAAGANPVQITRGIEKQRKH

SEQ ID NO: 84539 - DNA, 820 bp, Zea mays
  misc_feature: Ceres CLONE 1570622
  misc_feature: Encodes the peptide sequence at SEQ ID NO. 84540
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
ccccgcggtggcggccgctctagaactagtggatcccccgggctgcaggaattcgtctcacccctagaaaagtccccgtctcaccgcactgcttaccccctcctctcgtctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgtcacgggcgcggcagcggggaccgcggcatcggccctggccgtggcttgctctgccgtcttctccatcctcgtcgccggtcgcctcgtgcagtaggcgctgccgtcgacgtggttcggggtccggcggagccctgttcgatcgttttcgccttagctagtagtagaagtagcagtcatgggctgtgttgattgtttccctgtctcccacctggtgggcgttgtgaccttgtgctattgcttattctttttgtaccatactgcattgttccacgtataccttgtgttgaggcgtgtgttgtatgaataaagatgatggatctcgttcgtcaaannnnnnnnnnnnnnnnnnnnnnnnnnnnnnnnnnnnnnnannnncccttcccccctatcgtccgggaaacacagaatccaccccatcgcaaaacacagtaagagtttaaatttaggctgaggtaaaagggggggcatcccgcagggcaacaatcaaaaacttgctggcaaacaagggtgcaacctgaattgcctggccgaaa

SEQ ID NO: 84540 - protein, 66 aa, Zea mays; identical to SEQ ID NO: 8261
  misc_feature: Ceres CLONE 1570622

SEQ ID NO: 84541 - DNA, 981 bp, Zea mays
  misc_feature: Ceres CLONE 1570624
  misc_feature: Encodes the peptide sequence at SEQ ID NO. 84542
ccgcggtggcggccgctctagaactagtggatcccccgggctgcaggaattcgtctcaccccctagaaaaacccgtgctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatgggcagggggcacgccactgttcctgctatggagatgacccagtggtttgacaccaactaccacttttattgtccctgaatttgggcccaaacaccaagttctcctatgcttcctcacaaggctgttaacgaattttagggagcctaaggcgctcggtgtttgatccgggcccataccttgtggaaccagccccgtaccggttgctttcaaaccctgccaaaggttggggaaaaagggattccccctttttttcccctttttaaggaaaccctcccaggttaaaagggaggccattcctaaatttaaagaccccgggggctccagggaatcctttgggagagcccccccttgtgcccccacctttttttcgaaaaatgggggggttttcctggggggaaacaaaaaatggaaacgggcccttcggagaaaaaaggccttgtaaaaaactttgtgggaagtccccgggggagcccaaaaacccaaaacccgcgggagggggggccttgtttggtttttttttcgcgagaaaaaacaattcgggtggtgg

SEQ ID NO: 84542 - protein, 122 aa, Zea mays
  misc_feature: Ceres CLONE 1570624
  misc_feature (2)..(123): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMGRGHATVPAMEMTQWFDTNYHFYCP

SEQ ID NO: 84543 - DNA, 848 bp, Zea mays
  misc_feature: Ceres CLONE 1570626
  misc_feature: Encodes the peptide sequence at SEQ ID NO. 84544
  misc_feature (700)..(700): n is a, c, t, g, unknown, or other
  misc_feature (702)..(702): n is a, c, t, g, unknown, or other
tccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacataggtattgtgtggtgtgtgagagagagagagaaacagagttcttcagtttgctatctctctctctgcatgtttggcgtcagtctttgtgctcatgtacgtgtgtctacatgcatgttggttgaatccattgcgtctgctgtaaccatatattaaattggtccacgatgatatgatttgatcctatttttattttttatttactaaaaccggaacttctttttttttaccnancccccgcgactcacaaaacaatatccaatggttaatattccatcattatgttaataccttacgtaatagagacagaaagaagaaaaaaaaccttgggggtcctccccttttaaaaaacccccacaaccaccactgggggggggaag

SEQ ID NO: 84544 - protein, 76 aa, Zea mays; identical to SEQ ID NO: 42649
  misc_feature: Ceres CLONE 1570626
  misc_feature (1)..(76): Pfam Name: Metallothio_2 Pfam Description: Metallothionein

SEQ ID NO: 84545 - DNA, 871 bp, Zea mays
  misc_feature: Ceres CLONE 1570630
  misc_feature: Encodes the peptide sequence at SEQ ID NO. 84546
tcaccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcgggttcgccgtgaagttctacacccgcgagggcaactgggacctgctgggcaacaactcccccgtcttcttcatccgcgacggcatcaagttccccgacgtgatccacgcgttcaaacccaacccgcggtcgcacctgccaggaatactggcggggggtttcgaacttcttgtcccaccttccccgaaagccttgcacaacctttcttctttcctctttcaaagacatgtgggcggtgcccttcccgacataccggccccattggaaagggggtccggggcgggtaaataccttaaaaacctttctttaaaacccgcggcggggggaaagagccccacttacccggaaaagattctcccccggggag

SEQ ID NO: 84546 - protein, 242 aa, Zea mays
  misc_feature: Ceres CLONE 1570630
  misc_feature (18)..(236): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNSPVFFIRDGIKFPDVIHAFKPNPRSHLPGILAGGFELLVPPSPKALHNLSSFLFQRHVGGALPDIPAPLERGSGAGKYLKNLSLKPAAGGKSPTYPEKILPRG

SEQ ID NO: 84547 - DNA, 827 bp, Zea mays
  misc_feature: Ceres CLONE 1570632
  misc_feature: Encodes the peptide sequence at SEQ ID NO. 84548
  misc_feature (692)..(692): n is a, c, t, g, unknown, or other
  misc_feature (747)..(747): n is a, c, t, g, unknown, or other
ccccgcggtggcggccgctctagaactagtggatcccccgggctgcaggaattcgtctcacccctagaaaaaaaccaaacgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgcatgcatcaagagcccatccggtttccttgttctgaggtgtcattcgctagtgctcagagccggcttggttttctcgaaagatcagcagccactcttgattcaggactttgtcacacctgatagcatctagttaatacatctttatccaagatggcactgcaaaacattggtgcttcaaacagggatgatgccttctacaggtacaagatgcccagaatgattaccaagatagaaggtcgtggtaatggtatcaagacaaatattgtgaacatggttgacatagcaaaagcacttgcccagggctgcttcctatacaaacaaatactttggatngtgagcttgggtgcacagtccaaattttgatgagaagacagggtatttctttgtntaatgggggctcatgatacttgcaaagctggctggtcctccctggaggtattcactcaaggaggtatgtccaagtgtttc

SEQ ID NO: 84548 - protein, 70 aa, Zea mays
  misc_feature: Ceres CLONE 1570632
  misc_feature (1)..(71): Pfam Name: eIF-5_eIF-2B Pfam Description: Domain found in IF2B/IF5
  misc_feature (61)..(61): Xaa is any aa, unknown, or other
MALQNIGASNRDDAFYRYKMPRMITKIEGRGNGIKTNIVNMVDIAKALAQGCFLYKQILWXVSLGAQSKF

SEQ ID NO: 84549 - DNA, 834 bp, Zea mays
  misc_feature: Ceres CLONE 1570633
tccccgcggtggcggccgctctagaactagtggatcccccgggctgcaggaattcgtctcacccctagaaaaaatccgctagcaggcgcgaggcgccccctccgaccgacactgaatcccgcctccaacctccgctcgaaacccataccttcggtctcctccgtctgtccgtcgcccatccggccgcctcttctcccaccagccgccgctgccgcacgttagctcctcctgcatcgtcgccggacctccgctacgcccccgtgcatccttgccttggcaggcaggatctggccacctttcgccggcaacagttgggcgccgcataggtaaccgcctacccccgaggcaaggcagtaccccgtcgcccagcgtataagcgcggaaggagggcgcggaatagcgccttttctaacactaatggcaaacgcggcggcggatggccccccctgtgaaccgcagtctctgaagaaactgagcctcccggtcgctcaagcggtccttggacctccttcgccccgggggcaacgccctcttctttaacgcccgaagccccaaaagcaagcgggattcgtacctggggtgcaaggggaaatgcggaaaaacgggggcggggtaaaggaacccccccccccgaaaaaggggcccccggtgggggaaggggaaaagggggccctgggccccccccttttttttaaaaaattttttgggatttttccccggggacccccgggaattccaaaaaaattttttctccggggaaaaaagggtctccctgaaaaaggcccctttgtgtccccgggacacccaattttatttgtggcccaaaaaaaacgt

SEQ ID NO: 84550 - DNA, 807 bp, Zea mays
  misc_feature: Ceres CLONE 1570634
  misc_feature: Encodes the peptide sequence at SEQ ID NO. 84551
gcggtggcggccgctctagaactagtggatcccccgggctgcaggaattcgtctcacccctagaaaaaaccgcatcgagcggacggtctctctctcttatgtacagaatcgcctccaaggtcggccccgccccggctcgctagcctcctcccactcccagtaccagcccccgcccctccagcaccaccagcagctcgccttctgaccatgagacgggtcggaggagacctgctgggcgactgcacgacgcctcggtccgcggcggcggggcaggccatgatggagcttcagagccaacgggtctgccgccgtcaggggcgccatggtggtggggctcagcccgctcagcgaggccctgtggcgggacagcaaggcgctcccgccgggggccggccccgccgcgctcatcggcgacgtgtcccgccaggctcacgtggaaggacctctgcgtcaccgtggctctgggcccccggctagacgcaaaccgtgctggactagctcaccgggtacgcggaagcccgggtcgctgaccgcgctcttgggggcccctcgggggtccgggaagtccaccttgctctaagccctctccggccggctcgccgccaaaagccttcctctccggaaacgtgctcccccaacgggccccaaggccaaacctctccttttgggcccgcggggttacttgaccccgggaagaaaaaccctattggagaacccttgaccggtgcgcccaaaaaaaattggggtactccgcccccctcctaaaagcttgccggggaaaaaattgccacggggaaggaaaaaggg

SEQ ID NO: 84551 - protein, 85 aa, Zea mays
  misc_feature: Ceres CLONE 1570634
MVVGLSPLSEALWRDSKALPPGAGPAALIGDVSRQAHVEGPLRHRGSGPPARRKPCWTSSPGTRKPGSLTALLGAPRGSGKSTLL

SEQ ID NO: 84552 - DNA, 541 bp, Zea mays
  misc_feature: Ceres CLONE 1570636
ctcccgcggtggcggccgctctgaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctcccggctagcttcggacgggacgacgttgccatgggctgctcaaactgcattcacgcacttaatacaaaacctggcttgccacgaaagccaaccagccaggcgccaacccaaagcggccttggcttttgctttccccgaaaaaccccccccctttttcccccccccggggggggggggttccctggggggccgggtttcccctgggggtttcccccccgcaaaaaacccccccccccggggggggggggttttttcggggggggggttttttttgggggggggggtttttttttggggggggggggttattttttttgggggggg

SEQ ID NO: 84553 - DNA, 828 bp, Zea mays
  misc_feature: Ceres CLONE 1570637
  misc_feature: Encodes the peptide sequence at SEQ ID NO. 84554
tccccgcggtggcggccgctctagaactagtggatcccccgggctgcaggaattcgtctcacccctagaaaaagtgccccaaggtgaagccggtcgaagtcgaactcatcgacccgacgcttggtgcaggcgtcgtccaggacgtcgtccccgccgagctctcggtccccgtggaggaccgcgacaataaggaagcggctgatcaactggtgtcggtgaaggagagcgatctgtcagatttcgacttcagcttccacgcggccaagaagcccgtccggtccgacagtggcgtggcactggacacctcggccgacgctgcggtggcggacacatcgccgaagctgaagcggtcttgctccaacatcgagactaagcgaccaggctcgcgttccgcgcccgagatgccggcccggtcgcggtcctacggcgatctgggcaacctggtcgccggcctcgccctggacgcgacggcgaccccgcacggcgcgccggaggccagtccggcgtccgtgaagacgtcgcgcaccgccgaccgcgtgatgctgaagaagcggtcgtccagccaggtgctgccctcgcgcagccggaagctctggtggcggctcttcctctggagccaccgcaacctgcacattgccgcggtcggcgcgcacgggcccaccgatcgttctcgcctggccgccacgacggggtacacctcggacacctttcggaggaaggcccgggccgcccgaacgcaagaaacaagaccggtcatggttcgaacaagtcgccgcccggcaacggtcttgtgcccaaaccagtggggtcgcccttctgccgccgaat

SEQ ID NO: 84554 - protein, 142 aa, Zea mays
  misc_feature: Ceres CLONE 1570637
MPARSRSYGDLGNLVAGLALDATATPHGAPEASPASVKTSRTADRVMLKKRSSSQVLPSRSRKLWWRLFLWSHRNLHIAAVGAHGPTDRSRLAATTGYTSDTFRRKARAARTQETRPVMVRTSRRPATVLCPNQWGRPSAAE

SEQ ID NO: 84555 - DNA, 879 bp, Zea mays
  misc_feature: Ceres CLONE 1570639
  misc_feature: Encodes the peptide sequence at SEQ ID NO. 84556
ctcaccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgttggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaatgtgtccaaggcggagttcatcgacctggcgcgcaagtccggcaagttcgacgaagacagcctggcgttccagtcgcgtctgctggccaagtccggcatcggcgacgaatcgtacatgcccgcgctgcgtgttcgagcccaacgcatgctgcgccaccatgtaggagggccgccgccgaggcgtccaccgccatgttcgcggcgcctggacgagctgttcaacaagtgccgcgtcccggccaaggacatgggcctgctggtgggtcacctgcagccc

SEQ ID NO: 84556 - protein, 114 aa, Zea mays
  misc_feature: Ceres CLONE 1570639
  misc_feature (1)..(114): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MSRPRPVYLIDFACYKPADELNVSKAEFIDLARKSGKFDEDSLAFQSRLLAKSGIGDESYMPALRVRAQRMLRHHVGGPPPRRPPPCSRRLDELFNKCRVPAKDMGLLVGHLQP

SEQ ID NO: 84557 - DNA, 842 bp, Zea mays
  misc_feature: Ceres CLONE 1570645
  misc_feature (842)..(842): n is a, c, t, g, unknown, or other
gcggtggcggccgctctagaactagtggatcccccgggctgcaggaattcgtctcacccccccctagaaaaaacacccggaccccggtctgcgtttgtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggccccttcgccggcgacgagccgcaccaggcgtacatgtgtacacccagcccaggcccttaactgcgcccgcccctgcgactggttttcctgctgggttctgtggatttggctgccggaagattggtgcagccttttaggatcacgggaagattcgcctgtgaaaatcgaaagggtgcctcaggtcatggttggggggaaccagcgccatggttactggggctttaaactcgggcaaaccctcatccaagcactggccccctggattttgacccccccggcctgaaaaaaggaatcccttcttgggtaaccagggaacctggccgggaatccgaaccggcccttgcagggtggggggtgggggccgcccaaaaaggggaggaacaagggggggaagggggcctggggggaaaattgttttcttcggcccggagggaatgaacaccggacccccgccaaggggggtcccgaagggaatccttggccaaccccaaaaaccctgggtcccctccccaaaaatggggagggggtcttctttaaataagggggggggaaaaaaattaaacacagggggcggaaccccccn

SEQ ID NO: 84558 - DNA, 858 bp, Zea mays
  misc_feature: Ceres CLONE 1570647
  misc_feature: Encodes the peptide sequence at SEQ ID NO. 84559
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
ctggagctccccgcggtggcggccgctctagaactagtggatcccccgggctgcaggaattcgtctcacccctagaaaaacgtacagaataaattcagatccacatgacataatggcagaggtctacaaaaatggtcctgtagaagttgctttcacagtttacgaggatttcgcacactacaaatctggagtgtacaagcacatcaccggtggcattatgggtggccatgccgtcaagttgattggatggggaaccagtgatgctggagaagattactggcttctggcaaatcagtggaatagaggctggggcgatgatggatacttcaagatcataaggggcaaaaatgaatgtggcatcgaggagggcgttgttgctggaatgccatccacaaagaatatggttccaaacttcggcggtgccgttggaagagctatagtttaatggttacgtttgcatggcctcaaatgctgttggaattagctaaagtaattttaaaatgcaattgttaaagggccacgatggtgtatgtattttgtacactagctcatttcaaaggtcgttatgttgctggtgccacatcactttggtcaagtggaataatattaataagaactagaatttcgattcgaaannnnnnnnnnnnnnnnnnnnnnnnnnnnnnnnnnnnnnnnnnnnnnnaannnccttcccgggttcacttattcaaatcaagacccttttttccttaaccaaaagtcccggcgggccccgggtccgcttcttgggcgcctcgttaattttggttccccggcggccgaaaaattcttctcccagcggaaccgaacccggaagcctaaccatggtagcgggcattt

SEQ ID NO: 84559 - protein, 110 aa, Zea mays
  misc_feature: Ceres CLONE 1570647
  misc_feature (1)..(91): Pfam Name: Peptidase_C1 Pfam Description: Papain family cysteine protease
  misc_feature: SWISSPROT Homolog: EC 3.4.22.1 Cathepsin B
MAEVYKNGPVEVAFTVYEDFAHYKSGVYKHITGGIMGGHAVKLIGWGTSDAGEDYWLLANQWNRGWGDDGYFKIIRGKNECGIEEGVVAGMPSTKNMVPNFGGAVGRAIV

SEQ ID NO: 84560 - DNA, 1238 bp, Zea mays
  misc_feature: Ceres CLONE 1570649
  misc_feature: SWISSPROT Homolog: EC 2.3.1.119 Icosanoyl-CoA synthase
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (1061)..(1061): n is a, c, t, g, unknown, or other
ttggggggtaannnnaaaaaccccccacccccnnnccccccccaacacccccccccaaaaaaacccaatacaaaaaaaannnnnnnnnnnaaaactggaactccccccggtggcggccgctctagaactagtggatcccccgggctgcaggaattcgtctcacccctagaaaaaactaccaccaccactgccccggatccataccagctgcagcagcagcgcgcgcgagctagcttcggtcggtcgatagatcgatcgatcgctcggccatcatcacgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcaaccacggcgtgtacctggccaccatccccgtcatccatgctggtgtgccggcgcccgaacctgggcagccctccaccccccaacaaagctgtgggcccaaaaggtttggggggggggaaggccccacctaaggaacctccccccccccccaggccttataacgggatctcccaggccggttcccccggcccctttttaccccaatttttcccgttttttaacatttaatagagttccaacaggcccccccaagaagcccccagtgttggatacccccccacaaaatctgaaaaacgttttccccccccatatgatgcctccaacacagaaaacaccctcgggtgagcacccacaaaaaaacagaaaaggcccctccccaatagagggggggggctttgtctcacacaaatggagggggggggggaagatattttttattattatctccgcaccactccttgacgtggtctcgcccacaaacaacatatctccccccgggctaaaaaagatttctctccaccccccctaaaagaggcgacagccactccccacggtgggggggatttctcaccacacgaaatcctcgaccatcttacctctgagggggggcacancaatatatcgccggtgaatacatttggagcccaacaaaaagatcgcgacaatattatttccccccctcccacatgattgggtgttttgtttagaaacgcccaatcaaaccgccgaagtgttggcgcccccccaccagatttaataaagaaaagggcccctccccccccacccaccgg

SEQ ID NO: 84561 - DNA, 989 bp, Zea mays
  misc_feature: Ceres CLONE 1570650
  misc_feature (813)..(813): n is a, c, t, g, unknown, or other
gcggtggcggccgctctagaactagtggatcccccgggctgcaggaattcgtctcacccctagaaaaaaggctgggcgcatgcatccgaggccgcctcaccccgcgcatctccctcgagctctccctctagggttttccgccggcaccctcagccgccgctgtcgagctctccctctcgtgtctccactcgccctcgagctctccctctccgtctccagtcgtcgtgaactagggtttggcgctctcagccgccgctgttgagctccccctctctccctctcccgtctccactcgccctcgagctctccctctccgtatccactcgttgtgagctagggtttgacgcccttactcgccgctgtcgagctccccccctctccgtcgagctcgcctcagtccccgttgtggagctctcgcactctccaggtttctccgctgccttaagccgccctcgctgtcgctgagccgacagattcattcgaccggtcatggctgacacgttgtgcaacggcgccatggggtccccgtgcggcccgggactttgcttggccggggcaaggggcgccccccagggccgcgcttcccggaattcccctgcaaggtcgcccggggcacccccaggcaaggaacctcctttctcccgcctggggaaggatgtccgggccaaggggaaaaacaagttccaaggggccccctggtccgccggtaacccccgagggcccgtcgcccccccaggacaaaatagaaacctgtgcgttcccccaagggcaatccggggggtgggaaaaaaagggttccacccccaaaaatgnccgaaggctaaatccccccaagaaactcgccaaatccgggttgacggcggagaaaaaatcgggggggtggagattcttctcccccgcggggtcgggttccaccagcaaaacccccaattttaaaaggtgctcttggaaccttggccttgcaggtaaagccccgcctacaccgtaaa

SEQ ID NO: 84562 - DNA, 843 bp, Zea mays
  misc_feature: Ceres CLONE 1570651
  misc_feature: Encodes the peptide sequence at SEQ ID NO. 84563
ctccccgcggtggcggccgctctagaactagtggatcccccgggctgcaggaattcgtctcacccctagaaaaagaagcggcctgcggctgcggcggcggcggcgggagcgggggcagcagcagcgcagacggtcacgctgtccgcgccggccgtgcgggacgcggtgcgcgccgccgtgagggatgccgaggccaccgccccggccgccagggtcccggcgacggcggcagccacggcggagatcgctagggacggggtgctgtgcctggaggaggtcgacgggaggcggtggagctacgtggtcgacgccgccggcgccgcggtcaaggctaagggaagggcgtccgtcggcgccgccttcaaggtcgtcccgctccagtccccgctgccgcccgtcgaggaaataatgtcctttataagatcatatgttgtgcccgaaggctttccagatagtgtcacaccttcatatgttccatacatgacatggagagcattgaagcatttctttggtggagcaatgggcgtgtttacaacaagaacgttgctcaactctgttggagtctcccaaagcagggctgcatctggtgctgtggctatcaactggatactcaaagatggggcctgggcgtgttggaaaagatgcttttttgcccgccaggggaagaaatttgattatggacctgaagcagcttcgccttttctggggatctccttgatgggagttaggaagctgggaataaaattagctactggcgcttttcccccagtttttttcctcccaatggcatggcttagcaatggggttggttaagaataggttgctgcctgtcactttccccca

SEQ ID NO: 84563 - protein, 134 aa, Zea mays
  misc_feature: Ceres CLONE 1570651
MSFIRSYVVPEGFPDSVTPSYVPYMTWRALKHFFGGAMGVFTTRTLLNSVGVSQSRAASGAVAINWILKDGAWACWKRCFFARQGKKFDYGPEAASPFLGISLMGVRKLGIKLATGAFPPVFFLPMAWLSNGVG

SEQ ID NO: 84564 - DNA, 861 bp, Zea mays
  misc_feature: Ceres CLONE 1570652
  misc_feature: Encodes the peptide sequence at SEQ ID NO. 84565
  misc_feature (791)..(791): n is a, c, t, g, unknown, or other
  misc_feature (792)..(792): n is a, c, t, g, unknown, or other
  misc_feature (823)..(823): n is a, c, t, g, unknown, or other
  misc_feature (861)..(861): n is a, c, t, g, unknown, or other
ccgctctagaactagtggatcccccgggctgcaggaattcgtctcacccctagaaaaagatatctagaaatagaaacgaactaatatatagataatcgaaatcgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaataatatcgattcatacagaggaaaaagttctctattgatgcaaacgctgtacctagaggatagggatagaggaagagggaaaaatcgaaatgaaataaataaagaataaagccaaaaaaataagtcgaagatagaagagcccagattcaaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttatcataaatggaaagtgttcaattagaacatgaaaacgtgactcaattggtcttagttagtcttcgggacggagtggaagaagggcggagactctcgaacgaggaaaagggatccctccgaagaatgaacganngagcgtatgaggtgaaaatctcatgtacggntctgtagagggacagtaaggatgacttatctgtcgacn

SEQ ID NO: 84565 - protein, 38 aa, Zea mays
  misc_feature: Ceres CLONE 1570652
MDKLTLTRQFWIQFGIFLGKFREEIGIISIHTEEKVLY

SEQ ID NO: 84566 - DNA, 766 bp, Zea mays
  misc_feature: Ceres CLONE 1570653
  misc_feature: Encodes the peptide sequence at SEQ ID NO. 84567
ctggagctcaccgcggtggcggccgctctagaactagtggatcccccgggctgcaggaattcgtctcacccctagtaaatgagctgagctcatggcgatggggaggccaagcaacagccacgggggcgggggcgacgaggagcggctgcccctccgcggcgtgctggagacgtccccgtcccatcacgccgcggtgcagcccaaggacaaggaggcgaggcgcgggggcagcaggctctggcgcgcgtccgtgcgcgcggggctgctgctctgcctgctgaccgtcccggccgtcctgctgctgctgtggtggcaggccgactcctcgccgcagtgggtcttcgacttcgagccacccgaggaagacgacgaccaagatatacaagacgacatgtccgacgatctatctccgtcggcacaaatagagtacgatcgtcttctgggcggccttctcgtcgagggttttgacgacaaatcatgcagaagcaagtaccgtttcgcacgctaccacagtttcacaagcataccttctccgtacctcatagagaggctaaagaaacaagaacctctccaaaagaaattgcggcccaagcaacaaaacatacagggaaagcttccaaaccacctgaaaatccggtcaaaacattgaccatttacggccccagaaaaaatggcaatttacctgttcccttatcattcaacgcccggctttagggaaaccggaattcctccaaaatccacttccgggggttccctctacaccgcc

SEQ ID NO: 84567 - protein, 185 aa, Zea mays
  misc_feature: Ceres CLONE 1570653
  misc_feature: SWISSPROT Homolog: EC 2.4.1.69 Galactoside 2-alpha-L-fucosyltransferase
MAMGRPSNSHGGGGDEERLPLRGVLETSPSHHAAVQPKDKEARRGGSRLWRASVRAGLLLCLLTVPAVLLLLWWQADSSPQWVFDFEPPEEDDDQDIQDDMSDDLSPSAQIEYDRLLGGLLVEGFDDKSCRSKYRFARYHSFTSIPSPYLIERLKKQEPLQKKLRPKQQNIQGKLPNHLKIRSKH

SEQ ID NO: 84568 - DNA, 910 bp, Zea mays
  misc_feature: Ceres CLONE 1570654
  misc_feature (689)..(689): n is a, c, t, g, unknown, or other
tggcggccgctctagaactagtggatcccccgggctgcaggaattcgtctcacccctagaaaaatcagacagacgcagactctctcacccgactcgtcagacgtcagccagcagttcgaaaccaaggatcgatccaggagcttccggaaggcgaggcgcgcgcgcaacgtctaggtgctggtgccggtgccgcccatggatcgggctcgcggatccgcgttcctgctcggcgtcctgctcgcatgatccttgttcgcgttttcacctgccaaagaggagaccaagaagctcgggaccgtgatcggtatcgatctcggtactcctactcctgtgtccgtgtgttctaaaacggtcatgtcgagatcatcgccaatgaccagggtaaccgtatcacaccctcatgggttgccttcaccgatagcgagaggctcttctggtgacgctgccaagaaccaggcagccgtcgtccctgagatgagcatactgtgacgtctagcgtctcatcggaagacagttcgagagacatgaagtccctagggacatgaaacttgctccctacaagattattgacaaggatggctagccctacattcaggtcaagatctacgatgggggagtaccaggtcttcagcccctgagagatcaatgccatgattcttggacagatgaaagaactgctgaggcatacntaggcaagaagatcaatgatgctgtcctcactgttactgcgtacataatgatgctcttaggacggaacaaggatgctggtgtcatgcccgcggaaaagtgaatagatggtcatgaccaactgctgctcctttagctatgataagacatatgctgggagaaaacatcatagtcttgacttgtggaggtactttgttggagtatctgacctaaccccagtgtt

SEQ ID NO: 84569 - DNA, 1072 bp, Zea mays
  misc_feature: Ceres CLONE 1570655
gggggcggggcccccaacgctaaatcaactatttctgcgcgttctccccagcctgaacgggaaaggagacccggggtgttgcttttttattttatactggactcaccgcggtggcggccgctctagaactagtggatcccccgggctgcaggaattcgtctcacccctagaaaaaatccagcgcggctccaatcctgtcgcggccattaaaagcttccctcccctgcctctctctgctccgctcgtctcttctggaaccgtccctcgctcgtcattctttccgccttcgctacgcaattccttgtcaacgccgcggggccaagttgttaacaacccgcgaaacttcgtccggaagaaatgaaaaaaaggcccggcaaggcgggggcgggccaatcggaaaaaggggcccccaaaaaaaagccccccggaaaggggaccttggaaggaacggagggaggcaaggaattttgattcctgggaaaggcaaggaaggggcctccttaagaaaaaaatccccgagggcccgaaaaatttttctcaagagaaacccgcagtggaaaatcccccccccgaggtgggggggggtctagttcacacccccctgggggagaaaaacaccccccaccccctgggaaaagagggaccattccttgtttttttaagagagagaatactacaccccaaatagtgaccccacacaaaaaaaatagagtggggccttcaaaaaaaaaaataacttcagagtggtggtgcaataaatataattcgtgtcgtagtactgtttgtaatactcatttattatggtgtctgtgcatctcttataccgataaatatagcttgatttggtggaggctatcgagagaggcgcggcccgccctcatatacatcttagatggtagaaaatagtaaatattagaaccatgcgacaatggtacagatcattttcttgttgctacggatcgaaaagtacctagatgtgtatttgtttctgttagacccatccaagagtttatcctctgggcttcaaccacgttatggtagaactaaataaagtttatttcttattgcataa

SEQ ID NO: 84570 - DNA, 827 bp, Zea mays
  misc_feature: Ceres CLONE 1570657
  misc_feature: Encodes the peptide sequence at SEQ ID NO. 84571
ctccccgtcggtggcggccgctctagaactagtggatcccccgaggctgcaggaattcagtctcacccctcggaaaaaaaaaaaaaaaaaaaaaaaaaaaaaaaaaaaaaaaaaaaaaaaccagcttctcaagccaccatcgaaccttcaagtctcgctacgtagcagtgcaataaaaaaagcagccgcaatggcgagcagcaccttggccctctcctccacggccttcgccggaaaggccgtgaacgtgccgtcgtcgtccgccttcggcgaggcccgcgtgacaatgcgcaagacggcggcaaaggccaagccagcggcggcgtccgggagccggtggtacggccccgaccgcgtgctgtacctgggcccactgtccggcgagccaccgagctacctgacgggcgagttccggggcgactacggttggaacaccgcggggctgtcggcggacccggaaactttccccaagaaccgggagctggaggtgatcccctcccggctggccatggctgggcggcgctcggttgggtctttccccgagcttgttcgcccccaaaggggttcaagttttgggaaaaggccgtggggtttaagggccggggccccataatcttcaccaagggggggggctgaaataaccccgggaaacccgaagccgtgattccggggcaaaaaatccctcgcccatttgggggccggccaggggcggggttctagggggcgcccattcgaggggggaacccggtttccccgggggggccccgccttgggaaaaagggttttgaaaaccccgttttttaccccgggggggggagtttttttat

SEQ ID NO: 84571 - protein, 140 aa, Zea mays
  misc_feature: Ceres CLONE 1570657
MASSTLALSSTAFAGKAVNVPSSSAFGEARVTMRKTAAKAKPAAASGSRWYGPDRVLYLGPLSGEPPSYLTGEFRGDYGWNTAGLSADPETFPKNRELEVIPSRLAMAGRRSVGSFPELVRPQRGSSFGKRPWGLRAGAP

SEQ ID NO: 84572 - DNA, 889 bp, Zea mays
  misc_feature: Ceres CLONE 1570658
  misc_feature: Encodes the peptide sequence at SEQ ID NO. 84573
gagctccccgcggtggcggccgctctagaactagtggatcccccgggctgcaggaattcgtctcacccctagaaaaaacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatgggtacgtgggtgctgtgccatcaccaacatctactgcacctgcagccaaccaagaacctacccactgctgctcctgccaagttccccccggcaacaggattgggggtgggttggttgcaaaagtctggggtacttacaggcggctgccttctaaaaagggagggggttggggtttgttttggatcctgccccccccctgggattaaaccccaatggcccccaccccctttgtctgaaaaaattccaaccctttgttggggggaaatgggtggaaatttcccccccctccgggccgaaatatttggagaaaaaaatcctcttaaaacctctttcccgcggtgtttttaataggggaaaaactcccccctcaaaagggcgccgggggctccccttttggggtctcccaaatcccccgggaaatatttgggcgccagagggccccccccacaaggagaac

SEQ ID NO: 84573 - protein, 200 aa, Zea mays
  misc_feature: Ceres CLONE 1570658
  misc_feature (22)..(90): Pfam Name: ubiquitin Pfam Description: Ubiquitin family
MGGGDADAGGEPADAQATLHIRCTNASKFTVRADLGATVGAFKAIVADSCDVPAPQQRLIYKGRILKDEQTLASYGVETDHTIHMGTWVLCHHQHLLHLQPTKNLPTAAPAKFPPATGLGVGWLQKSGVLTGGCLLKREGVGVCFGSCPPPGIKPQWPPPPLSEKIPTLCWGEMGGNFPPLRAEIFGEKNPLKTSFPRCF

SEQ ID NO: 84574 - DNA, 766 bp, Zea mays
  misc_feature: Ceres CLONE 1570659
  misc_feature: Encodes the peptide sequence at SEQ ID NO. 84575
tccccgcggtggcggccgctctagaactagtggatcccccgggctgcaggaattcgtctcacccctagaaaaaaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaagccgcacgttctcgtcggcgatctgttactacggtggcccgtggggacaagttcggctcctgtcgtcacgcgaccgcggtccactcgcaggggcagtgaccgtgctgctgccggcgacggcgacggcgaggatcctggggtcgcggcatgcccaacgagagatctcgacgaggccatc

SEQ ID NO: 84575 - protein, 197 aa, Zea mays
  misc_feature: Ceres CLONE 1570659
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSSRTFSSAICYYGGPWGQVRLLSSRDRGPLAGAVTVLLPATATARILGSRHAQREISTRP

SEQ ID NO: 84576 - DNA, 1176 bp, Zea mays
  misc_feature: Ceres CLONE 1570660
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (772)..(772): n is a, c, t, g, unknown, or other
  misc_feature (989)..(989): n is a, c, t, g, unknown, or other
tgtgggttttgtgttttttggggctttgcctacccacacccccacatgaaagaggtgtnnnncctaannnnnaaaatctagaactcaccgcggtggcggccgctctagaatagtggatcccccgggctgcaggaattcgtctcacccctagaaaaacgcatcaagctcctgcccccctttcctcttcatcctctcctccctcgcggcgcgcacgctctccgccctcccaagtcccaaggaaacctatccaccattccggcggtcgatacatccatccgtccagggagagcaaggaataatcaatcaatcggccagcgaatcagtcgaagggaggaggagagccggagtccgaccagcgcggcgcgggttggtggacccttgcgtctccggctctgccccgcggcgccgtctttttgtggttcttgcgtttccgcgagcaacaaaatccccactaggataagaggaaaagggttctcccgtttgcgctcctctgtcccaaggaaaaacccccccccccccaaaaatccagtgtgctggaaggaggacccccttccccccccccccccccgggccaaggttaaaaaaaatccaatcccgggcggggctctccccgtgaaaacgcggggaaaggtttccacacaccccctgttggtttttctggcgcatccccccaccaggaaaacacacaaaggggggatccccccacgaggatgggggcacccccaccgtatttcttaatccccacacgagcgcacgggcccaccgcgtattnttgctcatacgccgcgctgtagatccaacacctaagcactacagcgagataggcgctttttttcgctacacaaagacacacgattgatcgctcaatagcgcacacaacaaaacatccaccctccacgcctctacgcaaagagcggatccttttgttctaagaacgagtacccagattaacatatttggctacggggtgctactgccctctcctatanactcccccctttcgccatactctgatatccgcgagatattttagttagcggccctcttcttttctcacgccttctattttaaccaataatagaaggacacctcacaccagacgaggcgggttaccagagtccacctctcccgtgtctctgcaggcacaaatatccgaagcggaagcacgagtcccgg

SEQ ID NO: 84577 - DNA, 954 bp, Zea mays
  misc_feature: Ceres CLONE 1570661
  misc_feature: Translation starting site: 470
  misc_feature (361)..(361): n is a, c, t, g, unknown, or other
ctccccgcggtggcggccgctctagaactagtggatcccccgggctgcaggaattcgtctcacccctagaaaaaggaaatttcatgcgttccttatcttccgttccgctcggaagtctctctaccaccttctccccattccgctgttccgccctctcgcgtcgcgtgcctccaggtccctcctctgcgtaactgggtggccgccgatccgccgccaccgccctgcgtcaggtgttccggtgacaagcgtccacctgtgcccggcctcggcggctgcactgcgcgccgcgggagccagcagccgcttctccaccaaggcgaccgtgccgctttcaagatgttggaataccaaaacgcaattnggggggagactgaagctgaagggtaaagcgctggacgtaaaggaatggtggggtgaagaaaaagaagaagaaagtaccagcgtgaggagtcgtctcagattgcgcacgatgagctccacaaagggggggagatctgaaatcacaattgatcccaacaatgagcgggatgaatctgacaagaccggagatgaagggaaaaccacatcctgactatgggcatctcacaccagcagagcgacgctacatgggacagaaacagaggatcgacatgcagaagatgccaaagtcggcaacaagtcccatagagaccgcatccaagactttcatcagtaccctggcaaacctaacgagcactacgacatccccaaaagttggtcctggctaacatagcccaactggctgtgttacgcacaacaatggtgtgctggggcctatcattttatgttagcatggtatgtatcggtttaaaacattgggtggcacccgaaattgaaattaaattcaaaagatggtccactattctgatccccggtttaagtggttggttgtccttgccccttttagttgcatcatttttatccaaagtggacaat

SEQ ID NO: 84578 - DNA, 768 bp, Zea mays
  misc_feature: Ceres CLONE 1570662
  misc_feature: Encodes the peptide sequence at SEQ ID NO. 84579
ccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaggacaagctggagcgcgcgggcatggcggatcagatcaagcgggagatcgccgtcatgatgatggtgtcccaccccaacatcgtggagctgcacgaagtgatggccacccgctcctagatctacctcgcgctcgagctcggtcgcgggcggggagctctttctcccgcatcccgcgcgccggggcgggtcccaggaggacgtggcgcgcttgtttacttcgggaagctcgtcgcccgcgggtcgaacttctggcacgggccgccggggtgttcccacccaagaccttaaagctcc

SEQ ID NO: 84579 - protein, 88 aa, Zea mays
  misc_feature: Ceres CLONE 1570662
  misc_feature: SWISSPROT Homolog: EC 2.7.11.1 Non-specific serine/threonine protein kinase
MEDAMAADGKSVLQGRYELGRVLGHGNFGRVHAARDLRTGRSVAVKVVAKDKLERAGMADQIKREIAVMMMVSHPNIVELHEVMATRS

SEQ ID NO: 84580 - DNA, 896 bp, Zea mays
  misc_feature: Ceres CLONE 1570665
  misc_feature: Translation starting site: 180
  misc_feature: SWISSPROT Homolog: EC 6.2.1.12 4-coumarate--CoA ligase
  misc_feature (438)..(438): n is a, c, t, g, unknown, or other
agctccccgcggtggcggccgctctagaactagtggatcccccgggctgcaggaattcgtctcacccctagaaaaactcagctcaggcgagcagcggagccgagcagagcctcgagatcccgcccaccatttgccctccggccgacgcggagccgatcgcttcaccggcagcgaggacgatgggttccgtcgcggaggactccaccgcggcagcggcagcagcggcgtcggtagtgttccgctccaagctacccgacatcgagatcccgcggaacctctcgctgcaggcctactgcttcgagcggctccccgaggtgtcctcccgcccctgcctcatcgacgggcagacgggcgccgtgcacacctacgccgaggtggaccgcctgtcgcgctccgcggcggcggcgctgcgcgggctcggggtgggcaggggcgacntgttgatggcgctgctccgcaactgcccccgagtcggcttgggtcttcctcggcggcgcggcggctgggccgccgccacccaccacggccaaacccggttctacaacccgaacgaatatccacggccaggcggcccccggcgggggcccaggggggtccttccaccaaaggccggggccctccaacaaggggggccgggtttcccccccaaaaacccggttggcccggtggttcccctttaaagggggccctttaaaggggggcctggaaacccgggggccccgggggaaacccccccaaaccccctccccccccaaaaaagtgggtggggcccccaaaaaaatttttggggggtgtccctattttcctcggggcacccgggggtatcccccagggggttttttgtttcccatttttaaaccccttttccaaaagttttcccaaaaaggggggggggg

SEQ ID NO: 84581 - DNA, 2052 bp, Zea mays
  misc_feature: Ceres CLONE 1570668
  misc_feature: Encodes the peptide sequence at SEQ ID NO. 84582
aatcctggacgcccgtccggctctgctccattcccttcgtctccctccagcagcctccggccatcgccctctgcgatgacctccacgacgccggggaccttcggaacgctggctaactccggaccggtcgcgctctcgttcccgacgaccacctccttcgcaagcttcctaggcggcggttcgagtcctagccgaataatggacagcgggggaggagtcgggctgtccaagttcaaggccatgaccccgccttccctcccgctgtcgtcgtcgtacccgccgccggcgcagtcgtacctacacgcgttctccggcctcctcgactcgcccatcctcttgactcccagcttattcccgtcgccgacgacgggcgcgatcccgtcggagcccttcaactggatggggacgccggagaacgacctaagcggcagcggcggcgtagaggctgagcagcgccagcagtacaccgacttcgcgttccagacggcggcggcggagacgtcgacgattattaccggcgcggcgcacacggcgtccttcccgcagtcgtctgtgctgatgcccccatcgggacgagtaggagactcgtacagcggcgagatgctgcagcagcagccgccgtggacctaccaggaaccgacggcgcaattcgaggcgccggcggcgcaggctggcaacatgttcggcaccggcggcggctacggcgcggctcccggcttccgcgagcagaggcagagccaccgcccgtcgtcggacgacgggtacaactggcgcaagtacgggcagaagcagatgaaggggagcgagaacccgcgcagctactacaagtgcagcttcccgggctgccccaccaagaagaaggtggagcagtcgccggacggccaggtcacggagatcgtgtacaagggcacgcacaaccacccgaagccgcagagtacgcgccggggcgccagctcggcgccggcgtcgtacgtggtgcagagcgccagcgacgcggtgatgcccgagcattcctggggcgcgctgtccggaacacccgtggtgacgccggagaactcgtccgggtccttcggcggcgacggcgacgaggtcaacggcatgagctcgcggctgggcggtagcttcggcgccgacgatctcgacgacgatgaacccgactccaagagatggaggaaagacggtggcgacggcgacgcagcagggtgctcggtgtcggtggccagcaacaaccggacggtgcgggagccgagggttgtcgtgcagacgatgagcgacatcgacgtcctggacgacggctaccggtggcgcaagtacgggcagaaggtcgtcaagggcaacccgaacccgaggagctactacaagtgcacgggggcagggtgcctggtgcggaagcacgtggagcgggcgtgccacgacacgcgcgcggtggtcaccacgtacgagggcaagcacaaccacgacgtgcccccggcgcgcggcagcgcctcgctctaccgcgccgcgctggcggcgcagatgccgcatcagcaggccgcgagctaccagggcggcctcgtccggaccgatgggctcggcgtcggggccagcagccagggcgggccgatgccggccgcggagagaggcagcttcgccttgtccgggttcggcgacccggtgggcacggcgtactcttattacacgaaccaccaccaggagcaggagcagcagcagccgaaccaggcgatgcgctacgccaaggacgagccacaagactgcatgtcgtttttcgagcagcaactcctgttttgaccagatgaaacgctgccacatcgattgtggcaagacatgctcgcacttgtgaattgtgattctttttttttactcgacacactatgtacactatctgtagtgatttgtttggaggctccaactttgcaggcatctgcagagtgggattgccttctgtaagatgtaggacacatcatttccgtagcctcctagggagcaaaggtcagggcaaatgatttttcagcagtttgactgctttttttttgccaaaaaaaaaaaaaaaaa

SEQ ID NO: 84582 - protein, 570 aa, Zea mays
  misc_feature: Ceres CLONE 1570668
  misc_feature (226)..(284): Pfam Name: WRKY Pfam Description: WRKY DNA -binding domain
  misc_feature (404)..(463): Pfam Name: WRKY Pfam Description: WRKY DNA -binding domain
  misc_feature: The sequence is a functional homolog of SEQ ID NO 1326 in the 11/479,226 US patent application
  misc_feature: The sequence is a functional homolog of SEQ ID NO 618 in the 10/412,699 US patent application
  misc_feature: The sequence is a functional homolog of SEQ ID NO 223 in the 11/479,226 US patent application
  misc_feature: The sequence is a functional homolog of SEQ ID NO 84 in the 10/412,699 US patent application
  misc_feature: The sequence is a functional homolog of SEQ ID NO 86 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
MTSTTPGTFGTLANSGPVALSFPTTTSFASFLGGGSSPSRIMDSGGGVGLSKFKAMTPPSLPLSSSYPPPAQSYLHAFSGLLDSPILLTPSLFPSPTTGAIPSEPFNWMGTPENDLSGSGGVEAEQRQQYTDFAFQTAAAETSTIITGAAHTASFPQSSVLMPPSGRVGDSYSGEMLQQQPPWTYQEPTAQFEAPAAQAGNMFGTGGGYGAAPGFREQRQSHRPSSDDGYNWRKYGQKQMKGSENPRSYYKCSFPGCPTKKKVEQSPDGQVTEIVYKGTHNHPKPQSTRRGASSAPASYVVQSASDAVMPEHSWGALSGTPVVTPENSSGSFGGDGDEVNGMSSRLGGSFGADDLDDDEPDSKRWRKDGGDGDAAGCSVSVASNNRTVREPRVVVQTMSDIDVLDDGYRWRKYGQKVVKGNPNPRSYYKCTGAGCLVRKHVERACHDTRAVVTTYEGKHNHDVPPARGSASLYRAALAAQMPHQQAASYQGGLVRTDGLGVGASSQGGPMPAAERGSFALSGFGDPVGTAYSYYTNHHQEQEQQQPNQAMRYAKDEPQDCMSFFEQQLLF

SEQ ID NO: 84583 - DNA, 704 bp, Zea mays
  misc_feature: Ceres CLONE 1570670
  misc_feature: Encodes the peptide sequence at SEQ ID NO. 84584
  misc_feature (600)..(600): n is a, c, t, g, unknown, or other
ctggagctccccgcggtggcggccgctctagaactagtggatcccccgggctgcaggaattcgtctcacccctagaaaaagaagccgagatcgagcagctacctctccgatccgaggcctgagcgagcgagctgaggactgcagcctatataatatctagactatagtacaccacaacgacgaggcacatatatatacacgcggcggcggccagatccatcttggtatacacgtaatatatatacacgcacgatgggcagcgccggcggcggtggcgagagcaagctggagagcccgctgctgggcgcgtcgtcgacgggccacggcgaggcggtggtgagcgggcagctggagagcatcctgggcgacgcgtccgtgccgtgggggacgcggatggcgtcggcgtccgcggtggagatgcggctgctggtgcgcctggccgcgcccgccgtgctcgtgtacatgatcaactacctcatgtccatgtccacgcagatcttctcgggccacctcggcacgctcgagctcgccgccgcctcgctcggcaacaccggcatccaggtcttcgcctacggcctcatgctgggcatgggggagcgncggtggaataacctgtgcggggcaaggcggtacgggggcgcacaaagtaccgacatggctgggggcatcttaacctggcagcgcctccacccgtcccttgctga

SEQ ID NO: 84584 - protein, 150 aa, Zea mays
  misc_feature: Ceres CLONE 1570670
MGSAGGGGESKLESPLLGASSTGHGEAVVSGQLESILGDASVPWGTRMASASAVEMRLLVRLAAPAVLVYMINYLMSMSTQIFSGHLGTLELAAASLGNTGIQVFAYGLMLGMGERRWNNLCGARRYGGAQSTDMAGGILTWQRLHPSLA

SEQ ID NO: 84585 - DNA, 896 bp, Zea mays
  misc_feature: Ceres CLONE 1570672
  misc_feature: Encodes the peptide sequence at SEQ ID NO. 84586
  misc_feature (611)..(611): n is a, c, t, g, unknown, or other
acccgcggtggcggccgctctagaactagtggatcccccgggctgcaggaattcgtctcacccctagaaaaattgcattgtgcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcctggacgtcatctgcgcggccgtgaaccgcaccgagggacgtgtggtcgccacgtccagcaactgctcgtactacctgcaggaacagtccctgtcggcgcgggaccgcctgggcatcaacgactgcctggagctgctgtccaccacgagtgacgagctccggcgcaggaccgcggaacctgggtcccccnccggaaaggggtccgcctccggcgggcttgttccaaggggccccgggccccgaacaaagaacacacttaaaaacgggggtttttggggggccatcccaaacaaataaacttgccctaaaagggttttcctaaacaaaaaaggggggggcctttggggctttcttattggggccaacctttcccccctggtttcccacgggggggaaaaacacttgtgggcaagtggaaaaaaaacttcccgggggcccggggcctccaaaggggcccaacccccccccccggaaa

SEQ ID NO: 84586 - protein, 166 aa, Zea mays
  misc_feature: Ceres CLONE 1570672
  misc_feature: SWISSPROT Homolog: EC 3.1.1.11 Pectinesterase
  misc_feature (132)..(132): Xaa is any aa, unknown, or other
MPPIPKRGEHLLVLLIVACAATAATAAGTVPFYPSAESAAAAHCDGTLYPELCLSTLADIPDLHKKPLLDVICAAVNRTEGRVVATSSNCSYYLQEQSLSARDRLGINDCLELLSTTSDELRRRTAEPGSPXGKGSASGGLVPRGPGPRTKNTLKNGGFWGAIPNK

SEQ ID NO: 84587 - DNA, 848 bp, Zea mays
  misc_feature: Ceres CLONE 1570676
  misc_feature: Translation starting site: 190
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaaccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgccctacttcacgactcacagaagcaggccacaaaggaatgctgggggtgattgcttggcctcaatgtgctgccgatcaatcatgagccaccggctgctgctatttgctatggccttgacaggaaggcaacaaccgtccgggaaaaaaaatgctcatctttgaccctggaagggggaaccttcgaggtctccctcctaacaatggg

SEQ ID NO: 84588 - DNA, 824 bp, Zea mays
  misc_feature: Ceres CLONE 1570677
  misc_feature: Encodes the peptide sequence at SEQ ID NO. 84589
  misc_feature (639)..(639): n is a, c, t, g, unknown, or other
  misc_feature (701)..(701): n is a, c, t, g, unknown, or other
ggagctccccgcggtggcggccgctctagaactagtggatcccccgggctgcaggaattcgtctcacccctagaaaaaacgcaaccaccactgcctcacgcaaccacctcagcccggtccacctctaacaccggccacccactgcctccacccccgccctagatcaccaccgcactctcaggcgcaagaacgagctcaccaggcaaagtcacggcggcgacctccgccttccaggtctcgcccttgctggcgcgcgcctctgctcaccacccagcgccgcgtcttccttctccagtccggtcgctggccgaccgccagcgcggctccgggccctgctttccgcacgcccaagcctgcgcgctccggacgcacctctcctgctcttctgggcttgggaaagagaagaaaccagcataaaaactctagatctgtgaaggatttgaggaagaaaccaaaccgaaaccctagtgacgatgctagagttcggacctcgctctgagtcgaaacgaccagagaccgctgccttccctccccattttcctttcccatgaaccaagcagcgtatgagctttccatccctcctcatttacctatcccacctctcatatcccgttatccaaacggcacctcagggtactngcatccagaagcaggggccctggcctcagcgcacctggatggcagggctgggagaagtgaangagaaagctacacccttgctggtcgatgacctggacagagtgggcgccagtaccagggtgccctttacagaagatacttgcgattcctacgcaggtttctgatggtgggaactgtaaattaca

SEQ ID NO: 84589 - protein, 79 aa, Zea mays
  misc_feature: Ceres CLONE 1570677
  misc_feature (26)..(26): Xaa is any aa, unknown, or other
  misc_feature (46)..(46): Xaa is any aa, unknown, or other
MSFPSLLIYLSHLSYPVIQTAPQGTXIQKQGPWPQRTWMAGLGEVXEKATPLLVDDLDRVGASTRVPFTEDTCDSYAGF

SEQ ID NO: 84590 - DNA, 944 bp, Zea mays
  misc_feature: Ceres CLONE 1570678
  misc_feature: Encodes the peptide sequence at SEQ ID NO. 84591
cgcggtggcggccgctctagaactagtggatcccccgggctgcaggaattcgtctcacccctagaaaaaacccaacccaagttcacgatcgcgaggtcttcgtctccgcctgggtccagcactcggatttccgcgcgttccacttccacccacacacacacacacaccaaaggacgcaggccgcaatggcggagtccgaggtctcccccgcagcggccggcggcggcgggcggctccgcaacgccttcgggggcgtgctctgcgccttcacgcttctcctcatcggcgtcgttgccttctcgatccgtctcttctccgtaatcaagtacgagagcgtgatccacgagttcgacccctacttcaacttccgcgtcactcagtttctgtccaagaatggaatttatgagttctggaactggtttgatgataggacatggtacccccttggccgtgtgatcggtggcactgtgtatcctgggttgacattgactgctggaactatgtggtggttgctgaactctcttaacatcccattgtcggtggagacagtttgtgtgttcacagctccaattttctcagcaaatgcatcatgggctacctacctgctaacaaaggaagcgaaaggtactggagctggattaatggcagcagccattttagcaatggtcccctcatatatttcaagatctgttgcaggcagctatgataatgaagctgtagcaatatttgccttgatatttacattttatctatatgtaaagacgctgaacacgggatcactcttttatgcaacactcaatgctctctcatatttctacatggtctgctcttgggggaggctacacattcattatcaaatctatcccattgcatggtcctcctgtgcattggaaccggtccgtttatcttccccgtccctacatgcataatgctccctttgttgt

SEQ ID NO: 84591 - protein, 247 aa, Zea mays
  misc_feature: Ceres CLONE 1570678
  misc_feature: SWISSPROT Homolog: EC 2.4.1.119 Dolichyl-diphosphooligosaccharide--protein glycotransferase
MAESEVSPAAAGGGGRLRNAFGGVLCAFTLLLIGVVAFSIRLFSVIKYESVIHEFDPYFNFRVTQFLSKNGIYEFWNWFDDRTWYPLGRVIGGTVYPGLTLTAGTMWWLLNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGRLHIHYQIYPIAWSSCALEPVRLSSPSLHA

SEQ ID NO: 84592 - DNA, 824 bp, Zea mays
  misc_feature: Ceres CLONE 1570684
  misc_feature: Encodes the peptide sequence at SEQ ID NO. 84593
ctccccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggccagtacgggtactccgagaccgaggtggtcaccgccaccggcgagggcgagtacgagaaccaactcatgctcgccagaccacctcgtcggggcttcgcatttatcgtgccgtccatgtccatgcaagagccgacgagcgccgccacccagcttcacgccgcgatggaagcgtcattgtcgctctcgtcactgcaggtcgccttcacggcggtcgcggcgatcgcggcgctggccgtcgcggtggccgtcacgaggtacaaccggagatacatgggcctgaggctgcctccgggcccgcccgggtggcccgtcgtcggcaacctgttccaggtggcgttctccggcaagctcttcatccactacatccgcgagctccgcaaggagtacggccccatcctgacgctgcgcatgggggagcgcacgctcgtgatcatcagcagcgccgagctcgcgcacgaggcgctggtggaaaaagggcgggtagtcgcgagccggccccggtagaaaccacgcgcaacatcttctcgtccacaagctcaccgtgaactccgcggtgtacgggccccgagtggcggtcgct

SEQ ID NO: 84593 - protein, 189 aa, Zea mays
  misc_feature: Ceres CLONE 1570684
  misc_feature: SWISSPROT Homolog: EC 1.14.99.9 Steroid 17-alpha-monooxygenase
MSEEKHHHFFNHHKKDEEQPAGQYGYSETEVVTATGEGEYENQLMLARPPRRGFAFIVPSMSMQEPTSAATQLHAAMEASLSLSSLQVAFTAVAAIAALAVAVAVTRYNRRYMGLRLPPGPPGWPVVGNLFQVAFSGKLFIHYIRELRKEYGPILTLRMGERTLVIISSAELAHEALVEKGRVVASRPR

SEQ ID NO: 84594 - DNA, 941 bp, Zea mays
  misc_feature: Ceres CLONE 1570687
  misc_feature: Encodes the peptide sequence at SEQ ID NO. 84595
  misc_feature (771)..(771): n is a, c, t, g, unknown, or other
  misc_feature (794)..(794): n is a, c, t, g, unknown, or other
  misc_feature (873)..(873): n is a, c, t, g, unknown, or other
ctccccgcggtggcggccgctctagaactagtggatcccccgggctgcaggaattcgtctcacccctagaaaaaacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttccctctcgacgacgtgggcgtgccgtccgactaccgcacatggaagggtcggcgtgaacacgtacacgttcntgagcgcggcggggaaggcgcantacgtcaagttccactggaagccgacgtgcggcgtgcggtgcatccttgacgacaagaagcggggctggtcgggggacngaacccccagccaccgacgcaagaccggtacgactccatcgcgggcggagagctccccggattgtaca

SEQ ID NO: 84595 - protein, 235 aa, Zea mays
  misc_feature: Ceres CLONE 1570687
  misc_feature (18)..(236): Pfam Name: Catalase Pfam Description: Catalase
  misc_feature: SWISSPROT Homolog: EC 1.11.1.6 Catalase
  misc_feature (212)..(212): Xaa is any aa, unknown, or other
  misc_feature (220)..(220): Xaa is any aa, unknown, or other
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFPLDDVGVPSDYRTWKGRREHVHVXERGGEGAXRQVPLEADVRRAVHP

SEQ ID NO: 84596 - DNA, 1269 bp, Zea mays
  misc_feature: Ceres CLONE 1570688
  misc_feature: Encodes the peptide sequence at SEQ ID NO. 84597
  misc_feature (854)..(854): n is a, c, t, g, unknown, or other
  misc_feature (887)..(887): n is a, c, t, g, unknown, or other
  misc_feature (927)..(927): n is a, c, t, g, unknown, or other
gggtgtgttgtttttttttatttgacgttcccccctactttcctcattcctccgccctaaaaaaaaataaaaactggtactccccgcggtggcggccgctctagactagtggatcccccgggctgcaggaattcgtctcacccctagaaaaaaagagggtgccgcgggctggactgagagagcggaaggaaggaaggagccggcgatgggcgggtggaactggctcttctgcggccgatccaaagccggaggcggcgagctccggcctcccgagcccttccagctgccggcgcccttgcccgagtggccgcaaggaggggattttgctaagggcacaatatgcataggagaggttgatgttacaagtattaccaaattccggagtatatggacctgctcagatgctacattttatgagccagaaggaattcctgatggtttccactgccttgggcactacgcccaacagaatgacccgcccccttacagggattttcttctgggtggcaagggaaagtggctagccacccaagttattgataaccaagccccgccctttggagaaaccaatcagaaattactcccctttgttttggaccccgttgcctgaacgcaaaatggaaagattgaacaatttagcccaaaagggttggtttgccattcctggggcttggcccttggtcccaccccccaaaaatgggggtaaataaaaagcgcccctttgggggccttatagtggggggggttttacccttcaaaaggcgggactccctaaaagaaagaaggcccccatttctcactcttggggggaaaaagaccaaggttttcttcccggggagtgttgtgtggggggnacccccgaaaaaaatttttagaccctcttttanaacaggggggataacacctccgccacctcccggaaaaaangaaattattttctccccctatttctcccaatattttgtcgccaaaaaatatatttgggggaaacaacaaacagtgctactgtgtcgccccaaaaaatttttttggtgaaaaagagaaaacaaaagggggtctctttggtgtccacaccccccaaaaagaaaaatattgtggggaagagagggccccctttgtgtattatatataccccggggtgggggggggaaaaacattttctcctcctctgggcgggaaaaaacccgtgatttttctaacccacgatatatgtccctaatatgaaatttctcagagggcctctctcctcgtgtcttgttgaaaaaaaag

SEQ ID NO: 84597 - protein, 134 aa, Zea mays
  misc_feature: Ceres CLONE 1570688
MGGWNWLFCGRSKAGGGELRPPEPFQLPAPLPEWPQGGDFAKGTICIGEVDVTSITKFRSIWTCSDATFYEPEGIPDGFHCLGHYAQQNDPPPYRDFLLGGKGKWLATQVIDNQAPPFGETNQKLLPFVLDPVA

SEQ ID NO: 84598 - DNA, 838 bp, Zea mays
  misc_feature: Ceres CLONE 1570691
  misc_feature: Encodes the peptide sequence at SEQ ID NO. 84599
  misc_feature (838)..(838): n is a, c, t, g, unknown, or other
gagctccccgcggtggcggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggtcgacgagctcaaggtgtccaatgcggagttcatcgacctggcgcgcaagtccggctagttcgacgaagacagcctggcgttctagtcgcgtctgctggccaagtccggcatcggcgacgagtcgtacatgccgcgctgcgtgttcgagcctacggcagctgcgccaccatgaaggagggctgcgcgaggcgtcacggccatgtttcgcgcgctggacgagctgtttcgacagtgccgcgtcgggcccan

SEQ ID NO: 84599 - protein, 152 aa, Zea mays
  misc_feature: Ceres CLONE 1570691
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPVDELKVSNAEFIDLARKSG

SEQ ID NO: 84600 - DNA, 817 bp, Zea mays
  misc_feature: Ceres CLONE 1570693
  misc_feature: Encodes the peptide sequence at SEQ ID NO. 84601
ctggagctccccgcggtggcggccgctctagaactagtggatcccccgggctgcaggaattcgtctcacccctagaaaaaacaccgctttctacgattcgacatggagaaggtccacagagcacagcgtataaacagtgagcttgtattgtggtcgctgcttgctgccaatctcgcgtcgtacttgttggtactatacagctgctctcaaccttgcgttccgtggcccctctcgtttattcgcccctgccacgaccaggaccgcgtcgcgcactcgcgcccttcacgccctgcgctgtgcttgcctcgtcacggccacgtccacctacctatacctctctgtccgacaacctcatcccctttccaaagatccgagccgcggcgtctccaaatacctcactcgcacgagcaggttgcaaagagccagccactcctgctagtttctggcgatggtggccgttactgcgggaatgcgggccagcggcgttggtggccgacggcgctcgggctgctgcgcggggcatgcacagcagaagctactagcgatcgccgtcgccgcgcgcttcactgaggccgtagcgccgccgtctgctgaggcctcccgtgccggctccggcggatgttgcgtacagctcctcgagtgcctcctcggggctctgagcgtcaacgcggccccgacgcccgcgcagcacaggcgggccgtgcactcgatccgcctacgccgaccccgatgagggtggtccacggacgatcgccaagcagacgctccctcgagccgcatcacgggatacggcacatccgcatcagcagtcgcgtat

SEQ ID NO: 84601 - protein, 94 aa, Zea mays
  misc_feature: Ceres CLONE 1570693
MVAVTAGMRASGVGGRRRSGCCAGHAQQKLLAIAVAARFTEAVAPPSAEASRAGSGGCCVQLLECLLGALSVNAAPTPAQHRRAVHSIRLRRPR

SEQ ID NO: 84602 - DNA, 807 bp, Zea mays
  misc_feature: Ceres CLONE 1570695
  misc_feature: Encodes the peptide sequence at SEQ ID NO. 84603
ctccccgcggtggcggccgctctagaactagtggatcccccgggctgcaggaattcgtctcacccctagaaaaaatcgcgataggcccgttcgcacgaatcactgctctgctttcaccccccgcatcgaacctcacccccgatctgatcgaatcgaaggctgcggcggcgatgggcggtgaccatggcggtgggcacgccggcggcgacttccgccagaaggtatggagcatgacgggcggcccgtactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctccaactagcatgaagtgcgggcaccttgcttttgccttctttttgtggaaacctgtgcctagccataatgctgggttaagtgttaggagcatctctggaatgcttcgcgtagtatcttttgattcttctttccttcgtgttacatgtgaaatgcctgatgaactcaaataatgaccggtgatacaaaagcctgtgatgaatttactcgagggttttgatcatgtaattgtaaacatggcatgtcgtctgcacacttaatgttgaagcttgattcataacgcacgagccccctctcggcgggggcatcctcaagtccaacggcgaggcctggctgcaccagatgaaaatcatcgcccccggagttcttcctggacaaagtc

SEQ ID NO: 84603 - protein, 82 aa, Zea mays; identical to SEQ ID NO: 61780
  misc_feature: Ceres CLONE 1570695

SEQ ID NO: 84604 - DNA, 867 bp, Zea mays
  misc_feature: Ceres CLONE 1570696
  misc_feature: Encodes the peptide sequence at SEQ ID NO. 84605
  misc_feature (369)..(369): n is a, c, t, g, unknown, or other
  misc_feature (440)..(440): n is a, c, t, g, unknown, or other
  misc_feature (442)..(442): n is a, c, t, g, unknown, or other
  misc_feature (443)..(443): n is a, c, t, g, unknown, or other
ctccccgcggtggcggccgctctagaactagtggatcccccgggctgcaggaattcgtctcacccctagaaaaaagcttgggaagttgccaaggcctccgatttcgctaatgcgacggtgaaatcccgcacctacctccttcctctctctccgaggaccctcgcaccaagaactgagcgggaagagaggtagagaggcaagcgcacgagagtttctgctcctctctcgcctcgcctccgtctcctttcctctctggttctctctctgcgattctcgtcgcattggttccgttccctcacgagaggcggtagctttctgtcttccctgatctatctagataatggcgaccacgacgtcagcgaccaccgncgccgcagcagccgcccactacgtcaagccggcgggggtcgtcgtcgggccttctgcaaaaggggggctgncnngcgcaggcggcccttccgggggttggcggggccaccccccgggggtgaaggccaaggggcaggccctggggaaaaggtggccaaggttccccccccttaagaaaatttaaaaattcccccccacccggggccctggaggaaagggggtccccctaacggtggaaaggggccccccggggtcccccccccccccccggggggaagaggctggaaaaaattttttttttttaaaagaaaatatggggcccccctggtttatttaaaagaaatctctcttgccgcgggaaacattttgaaaaggggggggtgtttttttttaccccccggaaaaaaaggagggaaaaattttggggggtggggcccttttttggggaaccccggggttttttaaaaaaaaaaagggggcgggggtgtttatcaaaaa

SEQ ID NO: 84605 - protein, 70 aa, Zea mays
  misc_feature: Ceres CLONE 1570696
  misc_feature (10)..(10): Xaa is any aa, unknown, or other
  misc_feature (34)..(34): Xaa is any aa, unknown, or other
  misc_feature (35)..(35): Xaa is any aa, unknown, or other
MATTTSATTXAAAAAHYVKPAGVVVGPSAKGGLXXAGGPSGGWRGHPPGVKAKGQALGKRWPRFPPLKKI

SEQ ID NO: 84606 - DNA, 970 bp, Zea mays
  misc_feature: Ceres CLONE 1570698
  misc_feature: Encodes the peptide sequence at SEQ ID NO. 84607
  misc_feature (669)..(669): n is a, c, t, g, unknown, or other
  misc_feature (795)..(795): n is a, c, t, g, unknown, or other
  misc_feature (935)..(935): n is a, c, t, g, unknown, or other
ctccccgcggtggcggccgctctagaactagtggatcccccgggctgcaggaattcgtctcacccctagaaaaaaaaaaaggacccgagcctagggttcctcccacagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagtaacttcggcatcaaaactagctttcatttctgaggagctgtgcatcggttgtggtatctgtgtaaagaaatgtccatttgatgccattgaaatcatcaaccttccaaaagacttggaaaaggataccactcaccgatatgggcctaataccttcaagttgcacagattgcctgtcccaaggcctggtcaggttttgggccttgttggaacaaacgggattggaaagtcgacagctcttaaagtgttggctggcaagctgaaacctaacttggggcgcttcataaacccacctgattggcaggaaattcttacatactttcgtgggtctgaacttcagaactacttcacacgcatattggaagataccntgtaggcaatcatcatacctcagtatgttgaccacattccaaaagctgttcaagggaatgtaggacaagtacttgaacagaaggacgagagggatatgaaatctgaactgtgtggtgatcctgaantaaaccaagttattgaccgaaatgtaggagatctttctggtggggagcttcagagatttgccataacagttgttgctgtgcaaatgcgggaaatcttttgttcgatgagccatcagcctaccttgagtggaagcgaggcntaagccgccccaggcgtttagcccttgcttaagcc

SEQ ID NO: 84607 - protein, 163 aa, Zea mays
  misc_feature: Ceres CLONE 1570698
  misc_feature (6)..(37): Pfam Name: RLI Pfam Description: Possible metal-binding domain in RNase L inhibitor, RLI
  misc_feature (48)..(71): Pfam Name: Fer4 Pfam Description: 4Fe-4S binding domain
  misc_feature (10)..(77): SWISSPROT Homolog: EC 1.2.7.7 3-methyl-2-oxobutanoate dehydrogenase (ferredoxin)
  misc_feature (97)..(136): SWISSPROT Homolog: EC 3.6.3.17 Monosaccharide-transporting ATPase
  misc_feature (53)..(73): SWISSPROT Homolog: EC 1.2.7.1 Pyruvate synthase
MAERLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPRPGQVLGLVGTNGIGKSTALKVLAGKLKPNLGRFINPPDWQEILTYFRGSELQNYFTRILEDT

SEQ ID NO: 84608 - DNA, 1190 bp, Zea mays
  misc_feature: Ceres CLONE 1570705
  misc_feature (1)..(1): n is a, c, t, g, unknown, or other
  misc_feature (39)..(39): n is a, c, t, g, unknown, or other
  misc_feature (957)..(957): n is a, c, t, g, unknown, or other
ngggcaagaatgggtgagctactccaagactctaccganccggcccccccttcatatatgttcatatgagggtgtaaactggagctccccgcggtggcggccgctctagaactagtggatcccccgggctgcaggattcgtctcacccctagaaaaaaaacttgaacaggccgcctccggtcttctcactttcacaccagaaggaaacgaccacctcctttcctgtgtcccgaatcgggaatagtagtaggagtgcatgcaatggacacacgcactacacataaatgttagttagccatggcgcccccaacagaggactgcggctgcatgctggacatgtccgtggccaccaaatgcggcgaccctcgacgcgcgcaaggcttggccgaggtatacctacccgacctgctaagtcaacttcgctcctggaactgggaggggcggccgggcatttcgcgaaatgagaagctacgcaccatgtgcgcccattgattcgtcccaacaactcccttcatatctttatttatgaaacccggggggttttccccaaggaagacagaaatgagccgaatacagagggcctgccggggtctaaaagggtaaagcaatatatactatatacgagaccagcaccacctccaaaggggagcacaacgcacagcacccggataatgcccaggaagaaggagaagaggaatgaagaaccgcgggtagacagtacatgcttgtaactatttcgatccgtcgccccagtatatatcccacggccctcttacgacacctgaccaacagaccagtcggacgtagggaccagttcccatacacatccacctgagacacggagcctctcctcaacggcgcctggctacgaactttgagagaggtcgggttatgtaaagccgtgcatttggaccgcagcggaagaacggaagaagagaacaacaaacgaaatagacnacaatctttgctataatcagaatcgggacgagatgtcactatcgcggtgggttcgtgtccggggtggagaccccgcgatagtgtgacacgcgatactctctattgagtagaaaatgaaacgatgcacagaaaaaaataatataccgcataaaggtagacaggtatcgcaagtgagacggctggagggttgtggtcgagttaatcgtacaatagaattttagtggttgaagagg

SEQ ID NO: 84609 - DNA, 967 bp, Zea mays
  misc_feature: Ceres CLONE 1570708
  misc_feature: Encodes the peptide sequence at SEQ ID NO. 84610
  misc_feature (967)..(967): n is a, c, t, g, unknown, or other
gcggtggcggccgctctagaactagtggatcccccgggctgcaggaattcgtctcacccctagaaaaaccgctgctttggcttcgcctcgcggtcgcccagtcgcagcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtccccttcaaacaacggaaggggttcagattctgttcctgggaaaatcgtaacaggactaaccgcagggaaaaagaagaaaaggaaaaattccaaattacagacgaagcaactcggtttggaacgaagaacgagattatttttctaaatcaagataaaactgggagcaaaaatttgctagatgcttactctggagaatggatgggattgggcaaagccgagagaaaattaagccagagaaggaaactgcaccgggcaggaaaccaaatctaaaatgccaaattgctatacgggattacatccggccacctgaattgtatacttcctccggggaatgttgatgaccccttaaggcctcagaatggttccacgatcccgaaaatacagggggctcacagggaattctcaggatcaatttcccggaaaaaaatn

SEQ ID NO: 84610 - protein, 78 aa, Zea mays
  misc_feature: Ceres CLONE 1570708
MHSSENKLGWNETSMGLVPVPKRPARPDASHQCKSDSFMKRSPRKVRNATLAKSIKSKYHYSPLQTTEGVQILFLGKS

SEQ ID NO: 84611 - DNA, 843 bp, Zea mays
  misc_feature: Ceres CLONE 1570714
  misc_feature: Encodes the peptide sequence at SEQ ID NO. 84612
ctccccgcggtggcggccgctctagaactagtggatcccccgggctgcaggaattcgtctcacccctagaaaaagacctgcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatataaaaaaaaaatccactgcggtcgctcgtcctcctcccaaacctcctccaagttgcctcgtgctctgcttcttcggttttcaggagcgtcggccattgctgctggaaaagcagacattggggactccctcgtgcgttttcaaatcagtcaggtt

SEQ ID NO: 84612 - protein, 128 aa, Zea mays; identical to SEQ ID NO: 77829
  misc_feature: Ceres CLONE 1570714
  misc_feature (32)..(128): Pfam Name: PsbR Pfam Description: Photosystem II 10 kDa polypeptide PsbR

SEQ ID NO: 84613 - DNA, 1108 bp, Zea mays
  misc_feature: Ceres CLONE 1570717
  misc_feature: Encodes the peptide sequence at SEQ ID NO. 84614
  misc_feature (879)..(879): n is a, c, t, g, unknown, or other
caccgcggtggcggccgctctagaactagtggatcccccgggctgcaggaattcgtctcacccctagaaaaaaccgagtcgctcacacacgtcgggaaaggaagaaagaaaagactgtagctagctaggcaccgcgcgcgcgctctactagtctagctagaatacactcgcgttcaaaacaatcacacaacgtcgtggtgcgtgatctctgaccgcggctacaactaccggaccaccttgcagctgatggcggacaccgtatcttcctgcctgagccgctgccccaccgtgcaccaccgggccggcgggttccccagcagtgtggctctgacgaacacgcttcagcgccgtcgtcgttctccccgctatcttgtcgtcccgtcgtgcgactagagccaaacaaacgaccgcccgtgtgacgatggaggacgtggacctccaactcttattaggccgcggtgcgaccacgggggagctcacctcccccgtggtcgggagagcctcgcggcagctagcagctagggagggttctgtgtggacccccattggactgggctggctccgttccagggcgcctcatccggatatcggcgtaagttcctcccgaggccaagttaaaaaccgggtttggatttgatgacccgcctttccttccccccttaatggcggggaatgcctgctaagtttacccagcgaggaaaaatatcttttcttttccacgcagaagggcttgggccctcggggggggggcgaattggtgtttaacggggggtaggcccccgctgtaccatttttagggcccttcccgggccacgcaaacgggcgaagtgtctcccctaaccttttggggccctcaaatagggggtctcaccaatggcncccatgtatttggtagacccattttctggggtagagtgttcacacggggtccccttggcccggtggtttctcctaggatcgaggagaacaccgccgcagtatggtgtccggccgggaaatctccccccgttgtggtgggtcccggtcatatgatcacgcagcctgagggaggtggtaccataataagaggctcaatacaacatcgccctggtgggagaaggtgtctccc

SEQ ID NO: 84614 - protein, 48 aa, Zea mays
  misc_feature: Ceres CLONE 1570717
MADTVSSCLSRCPTVHHRAGGFPSSVALTNTLQRRRRSPRYLVVPSCD

SEQ ID NO: 84615 - DNA, 841 bp, Zea mays
  misc_feature: Ceres CLONE 1570719
  misc_feature: Encodes the peptide sequence at SEQ ID NO. 84616
  misc_feature (464)..(464): n is a, c, t, g, unknown, or other
  misc_feature (504)..(504): n is a, c, t, g, unknown, or other
ggagctccccgcggtggcggccgctctagaactagtggatcccccgggctgcaggaattcgtctcacccctagaaaaatcagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccnactgcgcgaagaagccatcctgatatcccttttggctccntcattctagtagtttaggatttcttttctgacactttgattctgacccatctcctgggctgctgctcctggataatcgacagttccccggtctggctcttggaatcctccctccccatttcaggattgggttccgaattaccgggcccaagggggtcttttcgggggggaaggttccccgggtcccctttcgggtttaaggctttaaaaaaccccttaaaaacattttttgggggccctgttttttgggccccccggggggggggggggggccccccccggggccaaattacctctttttgtattttcggggggaaaattgttttcgtctcctcaag

SEQ ID NO: 84616 - protein, 50 aa, Zea mays
  misc_feature: Ceres CLONE 1570719
  misc_feature (1)..(50): Pfam Name: AdoMetDC_leader Pfam Description: S-adenosyl-l-methionine decarboxylase leader peptide
  misc_feature (44)..(44): Xaa is any aa, unknown, or other
MESKGGKKSSSSRSMMYEAPLGYSIEDVRPAGGVKKFQSAAYSXCAKKPS

SEQ ID NO: 84617 - DNA, 822 bp, Zea mays
  misc_feature: Ceres CLONE 1570722
  misc_feature: Encodes the peptide sequence at SEQ ID NO. 84618
  misc_feature (569)..(569): n is a, c, t, g, unknown, or other
  misc_feature (678)..(678): n is a, c, t, g, unknown, or other
  misc_feature (679)..(679): n is a, c, t, g, unknown, or other
ctccccgcggtggcggccgctctagaactagtggatcccccgggctgcaggaattcgtctcacccctagaaaaaccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctccctcatggntctcattcagatgcgtgagatcgctgaagcttaccttggcagcacgatcaagaatgctgttgtcacggtccctgcctacttcaacgactcacagaggcaggcccacaanngatgctgggggtgaatgctggccctcatggtgctgcgtaatcatcaaggagccaaccgcctgcggctattggctaaagggccttgaccagaagggaaaccaacgttccggaaaaaaaaattgcccccacctttggaccttggg

SEQ ID NO: 84618 - protein, 167 aa, Zea mays
  misc_feature: Ceres CLONE 1570722
  misc_feature (9)..(168): Pfam Name: HSP70 Pfam Description: Hsp70 protein
  misc_feature (127)..(127): Xaa is any aa, unknown, or other
  misc_feature (163)..(163): Xaa is any aa, unknown, or other
  misc_feature (164)..(164): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISLMXLIQMREIAEAYLGSTIKNAVVTVPAYFNDSQRQAHXXCWG

SEQ ID NO: 84619 - DNA, 1009 bp, Zea mays
  misc_feature: Ceres CLONE 1570724
  misc_feature: Encodes the peptide sequence at SEQ ID NO. 84620
  misc_feature (20)..(20): n is a, c, t, g, unknown, or other
  misc_feature (21)..(21): n is a, c, t, g, unknown, or other
  misc_feature (72)..(72): n is a, c, t, g, unknown, or other
  misc_feature (73)..(73): n is a, c, t, g, unknown, or other
ggtggggggggggggtgggnntgggggggggggggggtgggtggtatggggtggatttctttttttgtggtnngttgaaaactggagctccccgcggtggcggccgctctagaactagtggatcccccgggctgcaggaattcgtctcacccctagaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctatgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatcccccgtgctggtcgacgtaagacgaccccgctcggcgctcgaaatcgttttctaaacatcacctctgggtgaacaaaggcaaggggcgctcccgtaaagcttgtaaagaatggaatggtatcccaggaagcctaactttcggtggggcttaaccttaagccaaggggcaagccgcctccgtggcccctccccttcaaagaaagaatccaagggggccggccaacgtttttcctccgttccggggggaaattttgtgttaacctacccagggggggcccccgttggggggagaaaaaaaggttccgggctcccccggtttggttcaacggcgggacccgcggggtcccactctctccaggggggaaatggtacccctggccttgttgtcccgggtaaaaggggaaagggggaaagaaaccccgggggggtcccggccattgccaaacccaataaaatttccacaaaaggccctttcgggggcgtgggtcccgggccccccatg

SEQ ID NO: 84620 - protein, 107 aa, Zea mays
  misc_feature: Ceres CLONE 1570724
MKGGTQAVSLMVHLAVPWLCLASWAALLPALASGNVGAAAPILRADYIKLNFSTASATPDKYKSFIASVRAGLVSKAGGNSSGIPRAGRRKTTPLGARNRFLNITSG

SEQ ID NO: 84621 - DNA, 801 bp, Zea mays
  misc_feature: Ceres CLONE 1570728
  misc_feature: Encodes the peptide sequence at SEQ ID NO. 84622
  misc_feature (701)..(701): n is a, c, t, g, unknown, or other
ctccccgcggtggcggccgctctagaactagtggatcccccgggctgcaggaattcgtctcacccccccctagaaaaactcttttcccctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaggtatccaacattcgttgatgctcttcgtgacttggatgactgccttacaatggtgcatctgtttgcggcattacctgctgttgacggtgaacgtgttgaggtcaaacgaatccataactgccgcaggttaagccatgaatggcaagcatacatatcccgaaaccattctctgaagaagacatttatttccggtgaagggcatatattatcanggctgaaagtcaaaggacaaaagatcaccctgggctacctccgcatgctccttcagcaagtatttaactgaagaaggttgatttcaatgtgaaggcttta

SEQ ID NO: 84622 - protein, 213 aa, Zea mays
  misc_feature: Ceres CLONE 1570728
  misc_feature (8)..(214): Pfam Name: Pescadillo_N Pfam Description: Pescadillo N-terminus
  misc_feature (191)..(191): Xaa is any aa, unknown, or other
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRNHSLKKTFISGEGHILSXLKVKGQKITLGYLRMLLQQVFN

SEQ ID NO: 84623 - DNA, 782 bp, Zea mays
  misc_feature: Ceres CLONE 1570734
  misc_feature: Encodes the peptide sequence at SEQ ID NO. 84624
ctccccgcggtggcggccgctctagaactagtggatcccccgggctgcaggaattcgtctcacccctagaaaaaagctcctgccagtcgcaactcgcgtcctctccaaaaacagcccacagctgaagcgagaacacgaatgctcagtgatatttctctcgaggtctgcacactcgtctcctaccgagaccgtcggcggccatcgtcgcacacgctgtgctcatgctaagtgtcgaggctcacacgtactactactacccgaccgcgaggccgagacggaagctatgcgcctgcagaaacgtcttgcaggaaaccgccccgcgtgacgcagaggcaaatccctgccgtcacggcgagaggaagagcaggagaaggggcgacggtgcttattacatcgacaaggacggcggcggcgtagccaggaccttcgaccggaagaaaatatccagaaagagggggggtgctatcaaagggcgcggatggaagtacggctccgggttcgtcgacggagtgttcccagtgctgagtccgatggcgcaggatgtgctagaactcgtgcagacgagggggaccgacgcggccagcgtctgggagtcactggacaagatccctcaagcgcacgatctttgggacgacatcgtcaacgtcgccgtccagctccgcctgaaccggcaatgggagccgatcatcacagtctgcgagtgggtcctgcgccggagctcgttccagcccgacatcatctgctacaactgctcatcgacgcgtacggccagaagcgtcagc

SEQ ID NO: 84624 - protein, 187 aa, Zea mays
  misc_feature: Ceres CLONE 1570734
MLSVEAHTYYYYPTARPRRKLCACRNVLQETAPRDAEANPCRHGERKSRRRGDGAYYIDKDGGGVARTFDRKKISRKRGGAIKGRGWKYGSGFVDGVFPVLSPMAQDVLELVQTRGTDAASVWESLDKIPQAHDLWDDIVNVAVQLRLNRQWEPIITVCEWVLRRSSFQPDIICYNCSSTRTARSVS

SEQ ID NO: 84625 - DNA, 871 bp, Zea mays
  misc_feature: Ceres CLONE 1570738
  misc_feature: Encodes the peptide sequence at SEQ ID NO. 84626
gcggtggcggccgctctagaactagtggatcccccgggctgcaggaattcgtctcacccctagaaaaagtcgccctctctctcctatcagtcctcccagctccagctaccacagcagccctctcgcttaaaggaggagggagaagagggcggggcgagcaatgtcggagcagcagcagccattgccgcagcctcggagcagcatgcgggaggctctggagaaggaggacaaggagaaggcggcggctgctgcggcggccaaggagaaggcggccgtccccaagaacggcaacggcaacggcggcaagaatggcggcggcgccggcagcggcaacggcggagcgcccccgcagtccggggaggagacggcccgcgagatccaggtggtcagggaggcgtaccgcccgcgagacggccggcgccggcctacgtcatacccggaggagcccgccggcccgtggttcgagcctcgtcggcttggtacatctaccggcttcttgctcctactttccttcccccaacctggcttgcctggccgggtcctctttccctgggccatccattcaccgcaagggtcggccctttccccccaacctccccaaattttcccgcccccaaaacccccaagttaacacccccttcaaggggccgttcacccctgtgtttccgtttccaaaaaaatatggtccccttggattcccacgaaagggcttttacacaaggcgaccctcccaattgtgggatccccaaagggaagcccccccgagaaggtccccccacttttgggacttagggaaaggggaaacatgttctcgggggggcaatatttggggcttccccttcactttgtgtgtgcgcccccccctctcccc

SEQ ID NO: 84626 - protein, 156 aa, Zea mays
  misc_feature: Ceres CLONE 1570738
MSEQQQPLPQPRSSMREALEKEDKEKAAAAAAAKEKAAVPKNGNGNGGKNGGGAGSGNGGAPPQSGEETAREIQVVREAYRPRDGRRRPTSYPEEPAGPWFEPRRLGTSTGFLLLLSFPQPGLPGRVLFPWAIHSPQGSALSPQPPQIFPPPKPPS

SEQ ID NO: 84627 - DNA, 823 bp, Zea mays
  misc_feature: Ceres CLONE 1570739
  misc_feature: Encodes the peptide sequence at SEQ ID NO. 84628
  misc_feature (674)..(674): n is a, c, t, g, unknown, or other
ctccccgcggtggcggccgctctagaactagtggatcccccgggctgcaggaattcgtctcacccctagaaaaactcgagcgacgccaagcggccaagacggagaggagaacaattggggacggggaaagtccagggggaagccacggccaccggcgcgatgaaaccgtcgctgtcgaagaagaagggcaagaagaagaagaagaagtcctcgctgccggccgccgcaccggcccctccgccggcggagggcgctgcggatacggaggcatgtcccccgctgcccggaaccataaccctaaccgctgccaccgctgctgcggcggtggtttcggagacggagtccagcagcagcggcgaggcctcgacgtgcccatccgcctgcttcaccgcaagctcgtctgggaccgcgtcctcgcactccttctctgccttgtcctcgtcggcgtccacagcttcgtcgtcggccgccggcgaggagcggcgggacctcacctggctgctcgacgcattcgccagcgccaccttcgaccagatcgactccgcctaccgcgaggccggaggggaccctttcgtggccgccggtatcctgtcctccacgcatgacacgcacccgccgcagcccccgcagccggcgccgcagcccccgccgccaccggatctctcgccgcgcantggagctggtggtaagaaagctggtccgagccccaagcggggttgcggtgggccgctaccggcattggtcgccgaacttgatttggcaaggagtacacgcgacccgcgggctaattctggtagtaaagcatgccaaatgccttggtaag

SEQ ID NO: 84628 - protein, 220 aa, Zea mays
  misc_feature: Ceres CLONE 1570739
  misc_feature (172)..(172): Xaa is any aa, unknown, or other
MKPSLSKKKGKKKKKKSSLPAAAPAPPPAEGAADTEACPPLPGTITLTAATAAAAVVSETESSSSGEASTCPSACFTASSSGTASSHSFSALSSSASTASSSAAGEERRDLTWLLDAFASATFDQIDSAYREAGGDPFVAAGILSSTHDTHPPQPPQPAPQPPPPPDLSPRXGAGGKKAGPSPKRGCGGPLPALVAELDLARSTRDPRANSGSKACQMPW

SEQ ID NO: 84629 - DNA, 820 bp, Zea mays
  misc_feature: Ceres CLONE 1570741
  misc_feature: Encodes the peptide sequence at SEQ ID NO. 84630
tggcggccgctctagaactagtggatcccccgggctgcaggaattcgtctcacccctagaaaaaaccacccgccgccgccgagacctcctcctcgccggctactcctgaccccataaaggcagcgctcggaggtggccctctgtcgggtggagtggtggacacatccgcgcccatggccaaccgcggcgctgcggccggcaagctcaccgtcgccgagacattctccaacctcagggagcaaggcaagagtgcattcatcccgttcatcactgctggtgatcctgacctggcaaccacatcaaaagcattgaagattctcaattcctgcggttcggatgttatagaggttggcgtaccatactcggatccactggctgatggaccagttattcaggcttctgcaacacgggcgcttaagaaaggcactacactcgattctgtcatagaaatgctgaagggggttacacctgagctttcttgccccattgttcttttcacatactataatccaattctgaaacgtggtgtgggaaacttcatgtcttttatcaaacaagctggcatacatggacttgtagtgcctgatcttcccttggaggagacagcgttgctgaagagcgaggccattatgcacaacatagagctggttcatacccactctcatctttgcatgcaccacttgcacaaagtttgttgcgtacttgtgttgctatctgggtgctaactaaattcttactcgagatgggacctatcaaatcttcagattgggctctgcccatttcagacctgcaaaaatacccgtttgccaaagatcttcta

SEQ ID NO: 84630 - protein, 183 aa, Zea mays
  misc_feature: Ceres CLONE 1570741
  misc_feature (17)..(182): Pfam Name: Trp_syntA Pfam Description: Tryptophan synthase alpha chain
  misc_feature: SWISSPROT Homolog: EC 4.2.1.20 Tryptophan synthase
MANRGAAAGKLTVAETFSNLREQGKSAFIPFITAGDPDLATTSKALKILNSCGSDVIEVGVPYSDPLADGPVIQASATRALKKGTTLDSVIEMLKGVTPELSCPIVLFTYYNPILKRGVGNFMSFIKQAGIHGLVVPDLPLEETALLKSEAIMHNIELVHTHSHLCMHHLHKVCCVLVLLSGC

SEQ ID NO: 84631 - DNA, 921 bp, Zea mays
  misc_feature: Ceres CLONE 1570744
  misc_feature: Encodes the peptide sequence at SEQ ID NO. 84632
  misc_feature (819)..(819): n is a, c, t, g, unknown, or other
tccccgcggtggcggccgctctagaataggtgctccccaggagctgcaggaattctgtctagtgcgtagaaaaagaagcagacacgtggctgcgctacttgcgctgtacctgcgagccatgaggcagctcacggtctgcggacgttgatatccccaccttgttgagaaggatcccctctaacgttgtccccgggtccagctttggacgggggctatgcgtcagccttcgtccacgttatccctcctcaactgccagtccagtgcggcagtgccgctgatccactcgtagccgccgaagcaggggccgcatctaactgtctcaccgcccacgccggcctttagggtttttagaggggctgtctctgcctcaaccgccggtttccaaaccatctggtctttcctttccacacctgcaggaaacacctgctggaataaccacccaccaccagaagcagtcccgggggcaaccaataaactggcacccgattccccgggtccccagccccctaattggggaaggaaatggaatttcaactaacttccggttccgttctctaaaacaaagtccgttgtccccggggcaccccccgaggaaaggccgaaaccccccatcacaagagaaccgaccaaccaaaaaacctttgtgggaaataaacaagggtctaacccttttaaaaatctttaccccccccaccccaacggggtccttttatatcaactttttcccggggtttgaccgcccagaaccccccggggggcccccctcctaaggagccctctttatttgtttatatacccccgatcaattacttttccccnggggggcctacactttgggggggggaggcgcctatctctctgggggcgcccttataaaaataagtggggcatcgaacccctcgggggaaaattgggggattt

SEQ ID NO: 84632 - protein, 48 aa, Zea mays
  misc_feature: Ceres CLONE 1570744
PRGGGRSRIGAPQELQEFCLVRRKRSRHVAALLALYLRAMRQLTVCGR

SEQ ID NO: 84633 - DNA, 873 bp, Zea mays
  misc_feature: Ceres CLONE 1570747
  misc_feature (104)..(104): n is a, c, t, g, unknown, or other
  misc_feature (115)..(115): n is a, c, t, g, unknown, or other
  misc_feature (132)..(132): n is a, c, t, g, unknown, or other
  misc_feature (133)..(133): n is a, c, t, g, unknown, or other
  misc_feature (429)..(429): n is a, c, t, g, unknown, or other
agctccccgcggtggcggccgctctagaactagtggatcccccgggctgcaggaattcgtctcacccctagaaaaatggcgccagaaggatcaacaatttactntctgcaaagtnaacttcagggaattcannatttcggtggtgtaacacatggaatcggtcaggagctcttaatgtttatcccctgacgccaaagcaaaatgagatctacgtgttcagttatttcaaccgaaagtagtcatatcgagatgttttacacaaaaatgccttttcatgcctgaaggaacgatattatgtatttccttcacaatcttcagatgtcttccctcgcacgtttttggatagttgaatttaaaaagagaatgccagaattatccacttgcggccctcttccctcgttgctcctcctccagtcctccctttcccanccatgatttccaacccacctttttccccagccctaaaagaaacggttcccccgttcccccggtttcaatttccaacctaaaaaattcccaccaaaaaacctttcccggtggaaaacttccggtttccccctttcccccggggggggaatttgggaaaatttttttttaaacccccccggccccccccccccctttggcaaaaaaaattttttttcggaaaaaaaatacaaaagccccggggggcccccccccccgggggtcccctgtgtgggggggggccccccttttggggggtgggggcccacaagtttggggggcccctttttcccccccccgccggggggtcccccggggggggattaaccaaaaattttccccccatatttttttctccaacaaaggttttttgtgcccccccccggcgttttggtccccccctccttt

SEQ ID NO: 84634 - DNA, 772 bp, Zea mays
  misc_feature: Ceres CLONE 1570748
  misc_feature: Encodes the peptide sequence at SEQ ID NO. 84635
  misc_feature (741)..(741): n is a, c, t, g, unknown, or other
ccccgcggtggcggccgctctagaactagtggatcccccgggctgcaggaattcgtctcacccctagaaaaaaagagtaggtttcctggcttgacttggcgcgagaccaatggagcatttcatttgttagtgtccctgtgagtgacgtggaaactgtgcatcgccatgtctgctagtagtaagcgttttctgccgatagtggtggttgcggcaatggttgccgccgccagtggcgccgtggagttcgcctacaacggcttcggcggcgcgggcttgtcgctcgacggtacggccaccgtcacgccggccggtctgctccagctcaccaacgacaccaacatgtccaagggccacgcgttccacccggatccagtcaagttccaccggccgatgctgtcgtccttctccacgacgttcttcgccatcgtgtcggagttcctcgacctgagcaccagcgggttcgcgttcctggtggcgccgaccacggacctgtccacggcgatgccgcagcagtacctgggcatgttcaacggcaccgacaacggcgacgcccgcaaccacgtcttcgccgtcgagttggacaccgtgcggaacccggagttcgccgacatcaacaacaaccacgtcggcgtcgacgtcaacagcctcaactccaccgtggccgccccggcggggtactttgacgacggcggcggcggcgcgttccataacctgagcctcataagcagggaacccatgcangtctgggtggactacgacgctgccacgacgg

SEQ ID NO: 84635 - protein, 202 aa, Zea mays
  misc_feature: Ceres CLONE 1570748
  misc_feature (23)..(202): Pfam Name: Lectin_legB Pfam Description: Legume lectin domain
  misc_feature (192)..(192): Xaa is any aa, unknown, or other
MSASSKRFLPIVVVAAMVAAASGAVEFAYNGFGGAGLSLDGTATVTPAGLLQLTNDTNMSKGHAFHPDPVKFHRPMLSSFSTTFFAIVSEFLDLSTSGFAFLVAPTTDLSTAMPQQYLGMFNGTDNGDARNHVFAVELDTVRNPEFADINNNHVGVDVNSLNSTVAAPAGYFDDGGGGAFHNLSLISREPMXVWVDYDAATT

SEQ ID NO: 84636 - DNA, 833 bp, Zea mays
  misc_feature: Ceres CLONE 1570751
  misc_feature: Encodes the peptide sequence at SEQ ID NO. 84637
  misc_feature (820)..(820): n is a, c, t, g, unknown, or other
  misc_feature (821)..(821): n is a, c, t, g, unknown, or other
ctccccgcggtggcggccgctctagaactagtggatcccccgggctgcaggaattcgtctcacccctagaaaaaaaattccgaacgcatcacgcaatcgagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacatactatccgtcagaggctctcaagcataatggctctttgtatgctcatgtttacttcgcccgttcgggttatcctgtggaccctacagatccagaatatgagcagaaatcttcgtttgggaggacccatcctgttgtggcattcttgccaaaatcaaaagctggtaaaaagaagagcttgcttggagattcagaagagcctgaaagagaagcacctgcgcataaggagaataaagaatctgaggataaagacgagggtccgactgaatatatatcttattgggaaaccaatgtaacnnataaatcttgtt

SEQ ID NO: 84637 - protein, 217 aa, Zea mays
  misc_feature: Ceres CLONE 1570751
  misc_feature (27)..(216): Pfam Name: CLPTM1 Pfam Description: Cleft lip and palate transmembrane protein 1 (CLPTM1)
  misc_feature (214)..(214): Xaa is any aa, unknown, or other
MSQPAATVAAAAQPQGRGPAGRQGGLGQSIAGIVRMAVFWYFASKFFGPKRPPADPGMLMSNLFQKGEPMDMWMYLSENEKFNDFANEDALIWHEANIPYAVWGPTSTRTRSLTYYPSEALKHNGSLYAHVYFARSGYPVDPTDPEYEQKSSFGRTHPVVAFLPKSKAGKKKSLLGDSEEPEREAPAHKENKESEDKDEGPTEYISYWETNVTXKSC

SEQ ID NO: 84638 - DNA, 814 bp, Zea mays
  misc_feature: Ceres CLONE 1570752
  misc_feature: Encodes the peptide sequence at SEQ ID NO. 84639
  misc_feature (393)..(393): n is a, c, t, g, unknown, or other
acccgcggtggcggccgctctagaactagtggatcccccgggctgcaggaattcgtctcacccctagaaaaagaccttgcccctgcggtctcccgagtcccgaagcatccccttccaaaaccctcgccgcgccgcagccacccttgcttccgcacgctatcgcccgggaccagccatctatggcggcgtccctgctcctccgcgccgtgcgccgaagggagcttgcgtcccctctcggatccctgggtgccagcatacagtcaacatgtgttgccaacatatgctcaaaatggggaaggtttgcaagacctttcagtgcaaaagctgctggaaatgaggttattggggattgattttggggacaacgaactcatgtgttttctgttatgggangggaagaaacccaaaagttatttgagaaatgctggaaggtgcgaagaacaacacccatctggttggtcgcattttacctcaaaaaagggtgaaaagaacttggtgggaaactcccaggccaagcggcccaggcaagtaaaccaaccccccccaaaaaaaactttccttggggaaaaaaaaaagggttaatttgggggggaaacccctttttgtttggttccccccgaaccccccaaaaaaaaatttgtaaaaaagtgggggccccataaacaaaaaaacggggaaaagggggcccccaaaaagggggggaaaaacccttgggggtttccaaaaaaaaacaaaaaaggggggaaaaacaaattttctccccccccaaaaattttcgggggggcgggggggggaaaattttttgggggggcgg

SEQ ID NO: 84639 - protein, 57 aa, Zea mays
  misc_feature: Ceres CLONE 1570752
MAASLLLRAVRRRELASPLGSLGASIQSTCVANICSKWGRFARPFSAKAAGNEVIGD

SEQ ID NO: 84640 - DNA, 814 bp, Zea mays
  misc_feature: Ceres CLONE 1570755
  misc_feature: Encodes the peptide sequence at SEQ ID NO. 84641
ctccccgcggtggcggccgctctagaactagtggatcccccgggctgcaggaattcgtctcacccctagaaaaagtcccacactcctatccttctcgccttcgactgcccagagcgcccagcgcccgcgacgcttctagaacacgcgacgcgggcgagcgcgctggcgggtgggcgaggcaaaactaaggaggcgggaggggcggcgatgcggggcaggtgacgctgcggcgcggcgtgggggatggtggcggcggagggtgggcccggcggggccgtcgaggagggcgtcggggagagctcgtccccgccgcgcgaggacgccgtcccagcgcccgccggctccggcgggagcgggggcagcggaggcgcccgcgaaatctgtgcccaggtgctcgaccgcctcgtcgccgacggctacgcggaggcgtccgaccccgagttccgcgacaggctcgccgcccatttcggccggctcccgcacagctatcagctggatatcaatggtgacaaagcatccgatgtctgggtcacccggaacgtcttagcaaaagcaaaggatcctgatagggcgccctgcattctatgttcggtttcttggaggattgaagaaattggattcggcttccgacttcccatgcatcttaaaaaaggggataaaaaaggggggaaaaaattctttcgtgaagggggggacccccccccttcttcccttttttggaaaaaggttttttcccccaatttgaaaaggcccagagcctccttataaacaggctattttgcgttttggtttttgggaacctttggaatggaaa

SEQ ID NO: 84641 - protein, 174 aa, Zea mays
  misc_feature: Ceres CLONE 1570755
MVAAEGGPGGAVEEGVGESSSPPREDAVPAPAGSGGSGGSGGAREICAQVLDRLVADGYAEASDPEFRDRLAAHFGRLPHSYQLDINGDKASDVWVTRNVLAKAKDPDRAPCILCSVSWRIEEIGFGFRLPMHLKKGDKKGGKKFFREGGDPPPSSLFWKKVFSPNLKRPRASL

SEQ ID NO: 84642 - DNA, 802 bp, Zea mays
  misc_feature: Ceres CLONE 1570758
  misc_feature: Translation starting site: 225
ggagctccccgcggtggcggccgctctagaactagtggatcccccgggctgcaggaattcgtctcacccctagaaaaaaatgccccaatcccgtaatcgcagcctcgccccgctcgcatcttcctctccctctcagcactggtgctcaatctacaggttgtcccgctccctacacacccgccctccggtgtgaacctccatgacgtccacaaccactctccggtatgaatcccgcgtgcgcttacacgaagattggtaatagtggcgacccagtcgcagccgtggaccttctcctcctcatcgcttgctcgttgtcgtcttttgcctacgtctgcacccgacgctgctacccttcgctcacctgttcatcatcctttcagatctgctgtcgtgacctcatccagccgtgctgtggcagtggatcgaagttcgctccagctctgattgggggaaaatgactagggtatcaagtggaaaaacataatggtccaggttctactgcggcacctctttcaggctaagcatctaaacaacaatatgtaaattatccttttccaataaaatacatgcttaaatcgtggctgctaggcgaatggtcctactttggtcatcaaatgcaggaattccactactatatgtgccacttgaagttgttatgtcaaaataatatggtgaaaacgagcgtctattgggatctattttttatcttgcaaatgatcttcctgaaggaggtaatatattcttagatgagattgatatgtcaagatacgcttgtttcatttgagctcaatgttatctgaac

SEQ ID NO: 84643 - DNA, 847 bp, Zea mays
  misc_feature: Ceres CLONE 1570760
  misc_feature: Encodes the peptide sequence at SEQ ID NO. 84644
acccgcggtggcggccgctctagaactagtggatcccccgggctgcaggaattcgtctcacccctagaaaaagccaatctcgcggcagccctgcaaagctgcgatcaggactcaggaggtgcagaacagcggtgaagggtggaaaccgagaacactaggcagaggcactagccgagccgagccgcgccgcgccaccacgaccacgagtcgaccggcgagtggttggcgcaagttgtcaggtgaggggggcaccgcaccttccgcgccgcatcttgtcacgcacttgttgtagctgctgtatcctgtatgtattgcctgccgcccctggcttgtgctcatgggcgctgctgctgcggccaatgaaggggcgttgccggagccgtgcggcggccggcggccgggagcggggccgatggggcgctacgagctcgtccgcagcgacgacgcgcctgccgtcgccgcggatctggaggccggcaccgccgcgccgtgcgacggctaccccaagcgccgcgtgcccacgccctctccgtcttcgggcgcgggcgctgaccggcagcgcctcgtctcgctcgacgtgttccgcgggatcaccgtcctgctgatgatcatcgtggatgacgccggggcattcgtccggcgatgaacactccccccgggatgggcgtacggtggccgactttgtcaggcctttcttctcttcatcgtcggagtcgccttgccgctcgccgtacagaaagtccctgacaattggacgcctcagaaggcattgctccgtgccctaaacctgtttggcttggtcttgttccacaggggaatcttttcggggggttccaagccaaaattt

SEQ ID NO: 84644 - protein, 102 aa, Zea mays
  misc_feature: Ceres CLONE 1570760
MGAAAAANEGALPEPCGGRRPGAGPMGRYELVRSDDAPAVAADLEAGTAAPCDGYPKRRVPTPSPSSGAGADRQRLVSLDVFRGITVLLMIIVDDAGAFVRR

SEQ ID NO: 84645 - DNA, 832 bp, Zea mays
  misc_feature: Ceres CLONE 1570762
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (331)..(331): n is a, c, t, g, unknown, or other
  misc_feature (332)..(332): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (363)..(363): n is a, c, t, g, unknown, or other
  misc_feature (364)..(364): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (373)..(373): n is a, c, t, g, unknown, or other
  misc_feature (387)..(387): n is a, c, t, g, unknown, or other
  misc_feature (388)..(388): n is a, c, t, g, unknown, or other
  misc_feature (403)..(403): n is a, c, t, g, unknown, or other
  misc_feature (409)..(409): n is a, c, t, g, unknown, or other
  misc_feature (424)..(424): n is a, c, t, g, unknown, or other
  misc_feature (467)..(467): n is a, c, t, g, unknown, or other
  misc_feature (493)..(493): n is a, c, t, g, unknown, or other
  misc_feature (503)..(503): n is a, c, t, g, unknown, or other
  misc_feature (514)..(514): n is a, c, t, g, unknown, or other
  misc_feature (552)..(552): n is a, c, t, g, unknown, or other
  misc_feature (662)..(662): n is a, c, t, g, unknown, or other
  misc_feature (677)..(677): n is a, c, t, g, unknown, or other
  misc_feature (688)..(688): n is a, c, t, g, unknown, or other
  misc_feature (734)..(734): n is a, c, t, g, unknown, or other
  misc_feature (832)..(832): n is a, c, t, g, unknown, or other
acccgcggtggcggccgctctagaactagtggatcccccgggctgcaggaattcgtctcacccctagaaaaagtgtgacgccaccaccgctctctgactcttcatccacgaaccacatcaaaactgatcaactctctccctctgcttcccgctagagcaaacgccacgagagtcgcgattcttccaccacttccacgggaccggtcggatccaatccgctgccgcccagccaccgccaccgccgccgccgccggctcctctataggggtcttccccccccccccaaannnnnnnnnnnnnnnnnnnnannnnnnannnnnnannnannnannannnnnnnnnnnnnnnnnnnnnnnnannnannaannnaaanaaaaaaaaaaaaannaaaaaaaacccacanaaaaanaaaaaaaaaaaaaanaaaaaaaaaaaaaaaaaaaaaaaaaaaaaaaaaaaaaaaaaanaaaaaaaaaaaaaacaaaaaaaaaanaaaaaaaaanaaaccaaaaanaaaaaacaccaaaacccaaacaaacaaaacacccccancccccaaaacaaaacaacaccacccccccaaacaaaacaaaaaaaaaaacacaaaaccccaaacacaacaacaaaaaaacaccaccaaccaccccaacacacacaaaaancaacccaccaaccanacacaaacaanccacaaccacaccaccccaacaaaccaaacaaaaacaccccacccnaaccacaaaaccccaaccaaacaaccacccaccaaacaccacacccaacaaaaaccaaacccacaacaacccacaaaaccaaaaacaaacaacaaccn

SEQ ID NO: 84646 - DNA, 957 bp, Zea mays
  misc_feature: Ceres CLONE 1570766
  misc_feature: Encodes the peptide sequence at SEQ ID NO. 84647
  misc_feature (482)..(482): n is a, c, t, g, unknown, or other
ctccccgcggtggcggccgctctagaactagtggatcccccgggctgcaggaattcgtctcacccctagaaaaaatccctgtcctcgatttcaaaacggagccgagaggcccgacgagagccgaagccacagcagctgcaagctttgcttcgtccgtccgtccgcccgcccgtccccgcatcatcctgaagtcccagcatggagttggaggggccgtgggcgcgggtgctgcacctgcagcacgatgcgtgcgagtggggccgggcggtgcgggcgcgcgcggtggcgccggcgctggaggccgcggcgtgtgcgtgcctcgccatgtcggtcatgctcgtgctcgaggtgtgctacatgagcgtctccagcttcgtcgccgtcaacctgctgcgccggaacccacagcggcggtacagctgggaagccatgccctccgggacggggacgggaaccgcgcgggggggaccactagtaggcancggtgggccaatgaagccgccaagcgtacccgaatggactcgggcaaatccccatgtacaacgagaggaaggctacaagatctctttcgggagcgggcaggggcctcccatgggccgcccaacccgatttaaaaccaaaggcctggaagaattccccccggacccttttattaaggaacctgtggggttttaaagcaaaggatttgggccccccgaaaaaaccccctaaaaattggaattcggggaaaatgggggagggtaacaaaagggggcccccgaaaaagggggggaaaaaattttccccccaaaagtggttttttgtgccctcctttgaggaaatttcacccggacccggaccccttttaaaaaaaacccgtttttgggggtaacccaaaaaatgtcttaaaaaaacacgggggagttgggtttcccaacccgcctcttccgggatttttgggaaacaaattttggccaa

SEQ ID NO: 84647 - protein, 158 aa, Zea mays
  misc_feature: Ceres CLONE 1570766
  misc_feature (95)..(95): Xaa is any aa, unknown, or other
MELEGPWARVLHLQHDACEWGRAVRARAVAPALEAAACACLAMSVMLVLEVCYMSVSSFVAVNLLRRNPQRRYSWEAMPSGTGTGTARGGPLVGXGGPMKPPSVPEWTRANPHVQREEGYKISFGSGQGPPMGRPTRFKTKGLEEFPPDPFIKEPVGF

SEQ ID NO: 84648 - DNA, 848 bp, Zea mays
  misc_feature: Ceres CLONE 1570767
  misc_feature: Encodes the peptide sequence at SEQ ID NO. 84649
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (696)..(696): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
tggcggccgctctagaactagtggatcccccgggctgcaggaattcgtctcacccctagaaaaaaccaccaccaccggtcaccgaaacgcagcaactgacaggcacctgacggagagctagccgctctgcagccgagtcgagtcgaactagcgcgcgagcgagcgaggaagaagaagagctagctatactgctgcttcctcgcgcgcagcagcagcagcaaacgaagaaagctccatctgcttgcgcacacacacacatacacacacacaccagctagctccatgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctcatcgccggcatcaccatcgccagcctcgccatcccgcagggcatcagctacgccaagctcgccaacctgccgcccgtgctcggactctactcgagcttcgtgccgccgctggtgtacgcgctgatggggagctccaggactgccgtggggaacaaaaagggnnnnnnntnnngntnnntgtgtaataagatttcagggttgggaaggggagggtggttgccgaaagggaaaaccccgggggcgtcttcctggagcattagccttttacgggcccgcgtttttttcgccgggggctcttataagggtctcgtgattgggctttcttg

SEQ ID NO: 84649 - protein, 188 aa, Zea mays
  misc_feature: Ceres CLONE 1570767
  misc_feature (135)..(135): Xaa is any aa, unknown, or other
  misc_feature (136)..(136): Xaa is any aa, unknown, or other
  misc_feature (137)..(137): Xaa is any aa, unknown, or other
  misc_feature (138)..(138): Xaa is any aa, unknown, or other
  misc_feature (139)..(139): Xaa is any aa, unknown, or other
  misc_feature (140)..(140): Xaa is any aa, unknown, or other
MGGSADANGAGSVRVPVPPARPFLDTFRGNLKETFFPDDPFRGVVRERGAGRRTVAALRYFFPFLEWAPAYALSTFKSDLIAGITIASLAIPQGISYAKLANLPPVLGLYSSFVPPLVYALMGSSRTAVGNKKGXXXXXXCNKISGLGRGGWLPKGKTPGASSWSISLLRARVFFAGGSYKGLVIGLS

SEQ ID NO: 84650 - DNA, 889 bp, Zea mays
  misc_feature: Ceres CLONE 1570768
  misc_feature: Encodes the peptide sequence at SEQ ID NO. 84651
  misc_feature (383)..(383): n is a, c, t, g, unknown, or other
ctcaccgcggtggcggccgctctagaactagtggatcccccgggctgcaggaattcgtctcacccctagaaaaagttttggctcgagaaccaaaatcgccattctcttctctccttttcttatcctctctcctgagctcgctcgtatctcctctctggacgaacagaaaggttaccagcagcaccacggcgagatctccccttggcgggccaaaaccgacggcgagcttcaccggcgttggtcggctcccatctcttcgccgttttattttcctcccaggttaaggttgcaggcttttagcttgggattctgaaagatggggacctcttctggcgcgaatttccatcagcaacctcctccgacccaggggatgttgccctcanggcatggtccacgcccctcagggttgcagacctcgctctcgctggccctctcggagcaggttggctcgcctgacatgcaggaagctggttcaaactcgggagccgggcatgattccgccactgagagcgccagtccaaagaaccatgggcagcttgacccgaacaaagcaatgttgggggtgctgccattgatgttttgaagtaggcgggggaaaaggaagtggcaaatggtgttcccaacccgcggtttatcaggggcccccccccccgggggagggggaaccttttccgggaggttccccgggaaaggggtattctgggcccctaaaaaaaaaaaaaaatttccgagaaacccccccaagggggggcaaaaaagagccccgggctattcgggggggggcgggggggttccccccccccacgggagattttttttttttttaaaaattttttcaaaaaggggttttttttccccctccctttttttgtggggcacaccttggtgt

SEQ ID NO: 84651 - protein, 88 aa, Zea mays
  misc_feature: Ceres CLONE 1570768
  misc_feature (23)..(23): Xaa is any aa, unknown, or other
MGTSSGANFHQQPPPTQGMLPSXHGPRPSGLQTSLSLALSEQVGSPDMQEAGSNSGAGHDSATESASPKNHGQLDPNKAMLGVLPLMF

SEQ ID NO: 84652 - DNA, 826 bp, Zea mays
  misc_feature: Ceres CLONE 1570778
  misc_feature: Encodes the peptide sequence at SEQ ID NO. 84653
ctccccgcggtggcggccgctctagaactagtggatcccccgggctgcaggaattcgtctcacccctagaaaaaggtcacaacccgcgtgtaggtgtggcactctccatcctcattgctaactgtgcgattctcctccatacccttgtgcacgcacagccgagactgcatggaggaagttgaacacaggaagaagcacagctgagcgctctctcgtcaagctagctgcgctgcggcgatgaagatgcatcgcttcgcgctgcgtggcctggggtttctcgtcctgtggatgcggcattgccgaatcgagttcgtcgagggggtgcctccagatggctggtacgattactgcggctacaccgactgcaaaggccagccggagccggcgctgtacaacggaggcattctcaagttcggctgcagcagcagcggcggcggcgatcctgacgggtaccacacgactgataccggcgtcttctccaccggcgttcgtggtgtacaaactcaacaagaccaccatgtacaccttctcatgctgaggtgaagctggaacgcgcgtactcggctctgatacacgcgaggctggcgccggacaacaatgacgccaggtgaatagccgcggaggttgccagaagcgactgatgtgccttctctcagggcggattcatcgtggactggcctacacacacctcagacatcttctatcggatgctgaccagacgcccattacgattacgtggcgagcatgtaacacagccctcactacggacagtggggcgagcacagctgatagcatcatgaagaggagaacgcgtgccgacatcccg

SEQ ID NO: 84653 - protein, 101 aa, Zea mays
  misc_feature: Ceres CLONE 1570778
MKMHRFALRGLGFLVLWMRHCRIEFVEGVPPDGWYDYCGYTDCKGQPEPALYNGGILKFGCSSSGGGDPDGYHTTDTGVFSTGVRGVQTQQDHHVHLLMLR

SEQ ID NO: 84654 - DNA, 936 bp, Zea mays
  misc_feature: Ceres CLONE 1570779
  misc_feature: Encodes the peptide sequence at SEQ ID NO. 84655
  misc_feature (706)..(706): n is a, c, t, g, unknown, or other
ctccccgcggtggcggccgctctagaactagtggatcccccgggctgcaggaattcgtctcacccctagaaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacggtactgtcgtgctcacgccgcatcagggccaagaagcctcctccaccttgctgcccatcaacttcgatggactcngcaaggctttgacaccaggtgcaacgatatttgtgggccaatacttgttcactggtagcgagactacttcagttttgggtggaagtttctgaagtaaaggagatgatgtggtttgtatcatcaagaaccagctaccttggctgggtcgctcctcacgctgcattggttccagattcatattgacttgcccaccctgtctgattgaggataaggatgttatccaaaaatgg

SEQ ID NO: 84655 - protein, 168 aa, Zea mays
  misc_feature: Ceres CLONE 1570779
  misc_feature (30)..(168): Pfam Name: PK Pfam Description: Pyruvate kinase, barrel domain
  misc_feature: SWISSPROT Homolog: EC 2.7.1.40 Pyruvate kinase
  misc_feature (139)..(139): Xaa is any aa, unknown, or other
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLXKALTPGATIFVGQYLFTGSETTSVLGGSF

SEQ ID NO: 84656 - DNA, 796 bp, Zea mays
  misc_feature: Ceres CLONE 1570780
  misc_feature: Encodes the peptide sequence at SEQ ID NO. 84657
  misc_feature (397)..(397): n is a, c, t, g, unknown, or other
ctccccgcggtggcggccgctctagaactagtggatcccccgggctgcaggaattcgtctcacccctagaaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcntgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtcccgcaagttcgacgaagacagcctgggcgttcagtcgcgtctgctggccaagtcggcatcggcgacgagtcgtacatgccgcgctgcgtggccgaagccaacgccagctggcgcaccatgaaggaggcccgcggccgaggcgtcccacggccatgttc

SEQ ID NO: 84657 - protein, 190 aa, Zea mays
  misc_feature: Ceres CLONE 1570780
  misc_feature: SWISSPROT Homolog: EC 2.3.1.119 Icosanoyl-CoA synthase
  misc_feature (71)..(71): Xaa is any aa, unknown, or other
MAREEQALLSTEIVNRGVEPSGPDAGSPAFSVRVRRRLPDFLQSVNLKYVRLGYHYLISHGVYLATIPVIXLVCGAELGSLSRDELWRKVWGEATYDLATVLAFLAVLAFTISVYIMSRPRPVYLIDFACYKPADELKVSKAEFIDLARKSRKFDEDSLGVQSRLLAKSASATSRTCRAAWPKPTPAGAP

SEQ ID NO: 84658 - DNA, 774 bp, Zea mays
  misc_feature: Ceres CLONE 1570785
  misc_feature: Encodes the peptide sequence at SEQ ID NO. 84659
ccccgcggtggcggccgctctagaactagtggatcccccgggctgcaggaattcgtctcacccctagaaaaacacagaaaaacgaccacgtgacacctctcacagtctcacctcgtcgtcctcgtcccttccgcggccagccaggcagtcaggccggctggccgaggcagccgtgcccacgtgcacgaagcagcgggccgtgacgtggtttggggcgagcaggtgaccggcgagtagaagtagaagtaggctagcaacctgcacgcctacccgtcccacgcacctcccgacttctccggttctcccttcttcatagcagccacccacgcatctcagcgccgaggcgagcgaggacctcgtggttcgtgccctgctcacctcgtgaggatgtggatcgcgaggcggctcttcctcgcggcggcggcgctgctgatggctgtgcttctgctcgtcgcggggccggtggcggcgcaggacgcggcggtggagggcgtggccccgcctgcggaggagatcgcggcgaacgcgagggccaaggaggcggcggttctggccgccgagctagtgcagctcagggcgaagatctccgcgttagagtctcgcattgcagagcagaacctggagttcaagaccaagaatgatgcaatcgaaacactgaatatgattgtcaaggaaaagtcacagaagattgctactatgcagaatgaagtaacttccctcgaggccaaagggtctttagctgcagaggagcaggcaagcaaaggcaatgcactg

SEQ ID NO: 84659 - protein, 129 aa, Zea mays
  misc_feature: Ceres CLONE 1570785
MWIARRLFLAAAALLMAVLLLVAGPVAAQDAAVEGVAPPAEEIAANARAKEAAVLAAELVQLRAKISALESRIAEQNLEFKTKNDAIETLNMIVKEKSQKIATMQNEVTSLEAKGSLAAEEQASKGNAL

SEQ ID NO: 84660 - DNA, 889 bp, Zea mays
  misc_feature: Ceres CLONE 1570786
ccccgcggtggcggccgctctagaactagtggatcccccgggctgcaggaattcgtctcacccctagaaaaaaccgccgcagtgccgcacggcgactccgactctgtctcctgcgcggctccagctcaccctctcctcacatcgaggcggaccggcccacgtcgccggcaaccgaaacgtcggccgtagcctcgcacctccggcatcggcgagcgcgcgcgcccgtccggcggcggagatggcgctgcggcacctggtcacgggccagaacaactgcgcgccggacggcgcctcgtcgtccaccccctcaacgccctcgccaacggcttcccttggccagtcctccaaagcgcagtcaataaaagaaacttcctggtcctgttagtggtcccatcttacatctgggtttcaacgcggcctgcctcccttgtcaaacaattccctggttcaaaaaaaatgaattcaaaaccagaaccgccgaaccttttgttgcaagggctctgaactttatttccagggggggccctgccaaatgaattggaattaaagccttttctcggcccccccggggggttccccgaaaccttggggggaattaaaaaacaccccctttttcccgaattttttagacaaaattttttaaaaaatggggggaaacaaaccttttttacccgccccttttggatgggcccccccccaaaaaaagggtgttgcccggggggtctttggaattccctttttccacaaaaaggggccccacacgggggggggcccttttttaaaaccccctttccagaataaccagcggggccctttggggtttttctcccgaaaagggggacaaaaaaaggggccaaaaacgggaaatctcgaacccgcccaaaaaagg

SEQ ID NO: 84661 - DNA, 1137 bp, Zea mays
  misc_feature: Ceres CLONE 1570787
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
nnnnnnnnnnnntgggggatatttaatattgtataaatataataacagagaactagaagattggtgaggggtgttagggtaagctggaactcaccgcggtggcggccgctctagaactagtggatcccccgggctgcaggaattcgtctcacccctagaaaaacggcagccgcaacttaggccgccattggcacagactggaatgcagttaggtggtcctgttaggactcctatcgagaggggcgtttgttctcgcaggatactgcagtatctatttcaacagcgtcatcgcccaaagaataactctataacatactggaggaagattgttgaaaagtactttgcacctcgagcaagagaaaggaggtggtgtcctcttcttatgaaaacagaggggaattcttcagctgctggctccacagaaaactcctggatacatggcgatggtggcattgcaatacaccttcatgggaaaggatatgaagctaaccccataaaaaaacttcccaaggggggcctgccaaagttcaaattttggacccataggcgggaattggatggaaatacccgtactactttttgagctccaccccaaacaaaaatttggggggggtgggccctgaatggaggaccaaaattggctggtctgggagacccatcagccaaaaaaagatgggtcaacaaaaaagaaaagtggtatttttcttacgaaaaacgactctagataccaggggggtgtttgtcaactaaccgcgacagaggggcatacaacactccatggataagaaaatactctatgttgtgttcccatccacgcggaaggtgagaaactggggagaaggcgaaaaaaataatataacgggagcgagagaaaaatgttctgcgggccaccacaaaaaagaacgtgcctgccaggggaaggtcaaagtattttaaaacgcaatctttacaaaggataaaaaacatctctaagtgggcacgccaccacctcagcgcgcggagaagaaaggatcctcatttcacttaacacaagaagtatagtaccctatcaaaaaaaggataactcgcgccaaacaaggactctgtacaaacacttagcaaaagctagagagaggacaatacacctcgccgtcgaat

SEQ ID NO: 84662 - DNA, 905 bp, Zea mays
  misc_feature: Ceres CLONE 1570788
  misc_feature: Encodes the peptide sequence at SEQ ID NO. 84663
  misc_feature (459)..(459): n is a, c, t, g, unknown, or other
  misc_feature (517)..(517): n is a, c, t, g, unknown, or other
ctccccgcggtggcggccgctctagaactagtggatcccccgggctgcaggaattcgtctcacccctagaaaaaattccaggctgcttcttcctgcgcgattcgacacggactcagcccctcacacgcctcctcaccggctcacgacgtcgccacctcagatccggcgaccgatcccctcctcctcggcgaggcgtagcccgcagagccgagccggacaacacagccacgaccacgaggcgtcgtcgcggagtagtcggagccgtttctgctgcccccctccttcccgccaagtttgtcaagttacgtccgatgctccagacatagtagaaaaccatgggagaagttagtgatgacaattccaacctgtcctttctaaaaagaatcgcaacaagtgacgtaccgctgttgaaagagtatggtgtgaatggagtcgtcgtcgctctgcttctggctgtangtactcccgtcttgctctccatgggtgttgggcaggaaacaaagcagagggcggtgcnagctaatgtgggtggaaaagaaggatttgccatgccgaaccagtaggtttcctccttaagttgaagcccatggggaaggcccaacccgaatgtccgctctgttcagaaggggcagcaaaaaaacctctcacgggggggttcttggccccggggaacctattcagagggggatttggggaaccttttgaggggggggaatttttgaaaaacgccccttggggaacacaaagggggaccccccccccaagatttttacccgcgcgtaaatttttttttcggggcttttaaagggggcccccaccccaaaagacggggggggtggtttttcaaaaaaaaaagggaggggagaatttgggccccgggggggtccccccaaaaaatttggggg

SEQ ID NO: 84663 - protein, 75 aa, Zea mays
  misc_feature: Ceres CLONE 1570788
  misc_feature (42)..(42): Xaa is any aa, unknown, or other
  misc_feature (61)..(61): Xaa is any aa, unknown, or other
MGEVSDDNSNLSFLKRIATSDVPLLKEYGVNGVVVALLLAVXTPVLLSMGVGQETKQRAVXANVGGKEGFAMPNQ

SEQ ID NO: 84664 - DNA, 928 bp, Zea mays
  misc_feature: Ceres CLONE 1570789
  misc_feature: Encodes the peptide sequence at SEQ ID NO. 84665
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (902)..(902): n is a, c, t, g, unknown, or other
  misc_feature (903)..(903): n is a, c, t, g, unknown, or other
  misc_feature (910)..(910): n is a, c, t, g, unknown, or other
  misc_feature (921)..(921): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
ggcggccgctctagaactagtggatcccccgggctgcaggaattcgtctcacccctagaaaaaacaccgcgcgtccggatttggctgagtagctgactagctgagcgagcaatccatcccttcgcccgccgcaccatggaagccctcgcctcggcgcctcgggcgctcttcccgcgcgcgtgcccagtcgcgacgccggccggcccggcccggcgccgcaccgccgctcctcacatctgcagggcctccgcggcggctggggaggagacgccgccgccgccggccgctcccaagaagatcctcaagaagaagcccgtctactcgatgaagaaagggcagattgtgcgcgtggacaaggagaagtacctgaacagcatcaattatctgtcagttggacacccgcccttctacaaggggctggactacatataccaagaccgcggcgaggtcttggatatcaggaacttcgaaacaggagaatacgccctgatcgcttgggtggggatcccgacgccaccggcatggctaccaacctacatgctcatcaagtcggacaagctcgactacgagaggatatgatggccggccggccggccggccggcggccttgcagggcaccgtagcgccgccgccgaattcatgcttcatttcgcatcaggagtcggccaatcaggacgcaccttgttgttgacttgttgtaggtatatacgtacatgccagtattgccagaacagtcgacagaggcaatctgagacctcagctgctggaatataaggaagtagatcgagagcgacgtacgatgacgagattcatattgctgctgcacaccacctctttatgtatttaacccaccgtttcgtacttataataataatataccacatcccttctccnnnnnaaannaaaaaanaaaaaaaaaanannnaat

SEQ ID NO: 84665 - protein, 147 aa, Zea mays; identical to SEQ ID NO: 65916
  misc_feature: Ceres CLONE 1570789

SEQ ID NO: 84666 - DNA, 799 bp, Zea mays
  misc_feature: Ceres CLONE 1570793
  misc_feature: Encodes the peptide sequence at SEQ ID NO. 84667
gcggtggcggccgctctagaactagtggatcccccgggctgcaggaattcgtctcacccctagaaaaagtcactccccgacacgcgcacgagctccactccccactccgcacccaacccaaggcgccactgccatggacgcgggcggtccgccgccgctgttcctcctgggcgccgtgctggccgcggcgctggggtggctgctcgtggtctggcgggcggcggcggggcggcggcggtccgcgtcggcgcggctgccgccggggagcacggggctgccgctcatcggggagacgctgcggctcatcgcggcgtacaagtcgccgaacccggagccgttcatcgacgagcgcgtggcgcggcacggcagcggggtgttcacgacgcacgtgttcggcgagcgcaccgtgttctccgccgacccggccttcaacgcctgctgctggccgcggaaggccgcgccatgagctgcagctacccgtcgtccatcgccacgctgctgggcccgcggtcgctgctgctcacctcgggccccgcgcacagcggctccactcgctcacgctgacccgcctcgggccgcccgggctcgccgccgctgctggcgcacatcgaacggcctcgtcctcgcccacatgaaggggcttggaacagccccgggggccggggccatgggccctccttcaacgagggccaagatgaacccccttccaacctccccggggggggaaggctcgttaacattcaagaccttgggcccgggaacccaaaaccctcccggccccgatttactggtaaaccct

SEQ ID NO: 84667 - protein, 110 aa, Zea mays
  misc_feature: Ceres CLONE 1570793
  misc_feature: SWISSPROT Homolog: EC 1.14.13.77 Taxane 13-alpha-hydroxylase
MDAGGPPPLFLLGAVLAAALGWLLVVWRAAAGRRRSASARLPPGSTGLPLIGETLRLIAAYKSPNPEPFIDERVARHGSGVFTTHVFGERTVFSADPAFNACCWPRKAAP

SEQ ID NO: 84668 - DNA, 913 bp, Zea mays
  misc_feature: Ceres CLONE 1570799
  misc_feature: Encodes the peptide sequence at SEQ ID NO. 84669
ccgcggtggcggccgctctagaactagtggatcccccgggctgcaggaattcgtctcacccctagaaaaaggactgaccactgatcactgcactcgcaacgtaggcatgttatgggaagagctgtttccttctgctgtgccgcgcactacgacacggtgcgctggtttggttgggataccccccgacgaaatggacatctgccgcgatgtggccgagctggtgggaagcagccctacgggggctacatgccgagcggctacgtgttctccggggaggcgaacctcatgaacatcgagctggggtaccagtacctggtgaaccacttcctgacgcatgctgctggtgccggtgatggccgccgcggcgctggagatggcgcgcatcagcacctgcgagctgctctcgctgaggcgctcgctggagctggacctggtgaaattcctcagatccgcgttcctggtcttcttcgtccgcaccttgtacgtgatgtcgcgccccaggacggtgtacctggtggactacgcctgctacgagccccccgccggctgcagcgtgcccttgatcaccttgatggagcagacgatcctcatgatcgacaacaacaagagcgtgtgcttcctgaccaggatcatggagcgctcgaggctcagctaggacacatgtctaccgcccgggaatcactacattccgtctaatccatgaatggaggcctcagagcgcctagcgcagctcgacatcttatgcgacatcgaagaggttctacgacaaactgggctcaagcgcgaagaagtcacatgctcgtactagactgaagcatcctctcccgaaatcactaagtcgtccctggcatcctcaaacaataaagctgcggtagcaaatatcgaatttctactggtcggggatggaagaagc

SEQ ID NO: 84669 - protein, 106 aa, Zea mays
  misc_feature: Ceres CLONE 1570799
  misc_feature: SWISSPROT Homolog: EC 2.3.1.119 Icosanoyl-CoA synthase
MLLVPVMAAAALEMARISTCELLSLRRSLELDLVKFLRSAFLVFFVRTLYVMSRPRTVYLVDYACYEPPAGCSVPLITLMEQTILMIDNNKSVCFLTRIMERSRLS

SEQ ID NO: 84670 - DNA, 811 bp, Zea mays
  misc_feature: Ceres CLONE 1570800
ccccgcggtggcggccgctctagaactagtggatcccccgggctgcaggaattcgtctcacccctagaaaaagtgggggctgggattcttccccccctctgttgggtcctagagccgtttcctttttccctttcttctctggcggttctgtgcgcgctacctagtgtttgattggcctttggtgttcttgtgattcctcttcattctctctggtcatgaaaggagagagaaaaaaaaagatttgtggatcttcggtgaagtggcttctacagcttgctgacttttcttcctactgatgatttatccttgctcctgcaggttctgatccacagctctcgattccggaaggagttggtcaagaactggggatcctgagttgaatatgatatcaaatccggtggactggtatagtttcggacccggatagaattggtagggatgccagattggagggtgcgtgagtttgaaggtaaattcactgatgagtttgcccacagtaacaacaacaaacatgaaagtggagttgaggctcctggtgtcactagtagtaagaagttgaagcatacagttgccggtgagaaaattcaaggtgtcatccctgggataaatagctcagatccacaaaaatgtaattcagagaacatccaacatgagaacaagatagtatcccagaatataaacagtgctggtgactgccattgaagactgcaaagaaagcttcaaacgccttctctttcaggggaagaaaatacaatcggctgaaaccagaatttccaacggatgaactggaactccctgtcaattttgcact

SEQ ID NO: 84671 - DNA, 904 bp, Zea mays
  misc_feature: Ceres CLONE 1570802
  misc_feature: Translation starting site: 279
  misc_feature: SWISSPROT Homolog: EC 2.7.11.1 Non-specific serine/threonine protein kinase
  misc_feature (871)..(871): n is a, c, t, g, unknown, or other
  misc_feature (904)..(904): n is a, c, t, g, unknown, or other
ggagctccccgcggtggcggccgctctagaactagtggatcccccgggctgcaggaattcgtctcacccctagaaaaaattccctctcttcctcccgaaatttcccacctcagactccgagagaagcaaacacaagaagaagaagaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggtccgctctgctggcgttcctcaccgcgaccccgcacgagcgccgcctcgggtggaacgcctccaccccggcgtgcggctgggtcggggtcacgtgcgacaacgccaactccaccgtcgtcgaggtgcgcctcccgggcgtgggcctcgtcggcgccatcccgccgggcacgctcggccggctcaccaacctccgcgtgctctcgctccgctccaaccgcgtcctcgggaccgtccccgacgacgtgctccagcttgccagcctcaaggcgctgtttctgcaacagaacctgctctccggccccatcccgacgggaatccagaagctcggcggcctcgagcgcctcgtgctctcccacacaacctctcgggctccatccccttcgcgctcacaagctcaccgcgctgcgagtgctcaagctcgacagcaaccacctctccgggagcattcccagcatcagcatcgcggggctcggcgcctttgacgtctccgacnacaacctcaacgggctcatccccaaatcgcttn

SEQ ID NO: 84672 - DNA, 948 bp, Zea mays
  misc_feature: Ceres CLONE 1570803
  misc_feature: Encodes the peptide sequence at SEQ ID NO. 84673
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
cgccagaacagcggggagagaagacgaagcaaacaggacgaacccgagagaagattagtgtggggttnnnnnnttttttttttttcaaagctggaactccccgcggtggcggccgctctagaactagtggatcccccgggctgcaggaattcgtctcacccctagaaaaaacaagctcgaccaccaacccagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcagggcggcgcgcacgacgagatcgacttcgagttcctgggcaacgtgtccggcgagccctacacgctgcacaccaacgtgttcacgcgggggcaggggcagcgggagcagcagttccgcctctggttcgaccccaccgccgacttccacacctactccatcctctggaaccccaagcacgtcatcttcatggtggacgacatgccccatcagggacttccgcaacctgggagagcaaagggggtgggccgtcccccaagaagccagcccgatgtcggctcttactccaagcccggtggaaacgccgggacctacttgggggcgaacacaagggggcggggcggcgttccataaaagggaaca

SEQ ID NO: 84673 - protein, 212 aa, Zea mays
  misc_feature: Ceres CLONE 1570803
  misc_feature (28)..(207): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MATSSRRVPLLLLCLGVLVSCSFAAGSLDQELDITWGDGRGKVLDNGRLLTLSLDRTSGSGFQSRHEYLFGKIDMQLRLVPGNSAGTVTAYYLSSQGGAHDEIDFEFLGNVSGEPYTLHTNVFTRGQGQREQQFRLWFDPTADFHTYSILWNPKHVIFMVDDMPHQGLPQPGRAKGVGRPPRSQPDVGSYSKPGGNAGTYLGANTRGRGGVP

SEQ ID NO: 84674 - DNA, 799 bp, Zea mays
  misc_feature: Ceres CLONE 1570805
  misc_feature: Encodes the peptide sequence at SEQ ID NO. 84675
atagctggagctccccgcggtggcggccgctctagaactagtggatcccccgggctgcaggaattcgtctcacccctagaaaaagccactccaattcctctgcaaaattttctcatggcagccgacgtttccatccgcactcgatccgcctcaaccacccgctaattcctcctagttctagacttctagtctcctctctctctctctctctctctctctcctgcgccgactcatcttcatcctcgtctcacctccctgctgctgctgacgctgctgccggcaagatcaaatcgttcaaaaggtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgccgtccattgaaatcaaaagcgatagggaggctctgtctcaccatttgcgtttggttataagaaggcggttgccatttcggatgacaaaatttaaaaatgctccaaaaggcgggatccaaggctggctggtgtatgaatcctgaaaaacaacgggggtccttggtttcaaatgggcgggaaagcccctccggggaagcccacattatatgg

SEQ ID NO: 84675 - protein, 88 aa, Zea mays
  misc_feature: Ceres CLONE 1570805
MASPRGRMSFPLRSFLMICLMAQLGASNVVLMANNTTLSFDDVEAIFTPAVKGSGVNGVLYAVEPMDACRPLKSKAIGRLCLTICVWL

SEQ ID NO: 84676 - DNA, 959 bp, Zea mays
  misc_feature: Ceres CLONE 1570807
  misc_feature: Translation starting site: 143
  misc_feature: SWISSPROT Homolog: EC 3.6.3.14 H(+)-transporting two-sector ATPase
ctccccgcggtggcggccgctctagaactagtggatcccccgggctgcaggaattcgtctcacccctagaaaaagtcctctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttctatgagggcctcccgcccatcctcacgggggctcgaggtgctcgacaacaacatccgcctcgtgctcgaggtggcgcagcaccttggcgagaacatggtgcgcaccatcgctatggacggcacggatgggctcctccgcggccagcgcggcctcaaatctggctcccccatcaccgtgcctgttggcagggctacccttggacgcaccataaaggttattgggtggacccgattgatgaaaaggggggacataaaaaccaaaccacttccccccctattcatcgggaagcccccgcctttttttgtagtggcccctgaaccaccaaattctttgttatgggaaacaagggcgggggaatctttttgcccccctccaaagggggtggaaaaaaatggcctcctccggtggggcaggaatgggggtaaaacggtggcccatcctcgggagggtgacaaaaatggttgctaaaggccactggggggttccccccggtttccccggaggtggaaaaaaatcccctcgaag

SEQ ID NO: 84677 - DNA, 732 bp, Zea mays
  misc_feature: Ceres CLONE 1570809
  misc_feature (71)..(71): n is a, c, t, g, unknown, or other
  misc_feature (308)..(308): n is a, c, t, g, unknown, or other
  misc_feature (311)..(311): n is a, c, t, g, unknown, or other
  misc_feature (314)..(314): n is a, c, t, g, unknown, or other
  misc_feature (325)..(325): n is a, c, t, g, unknown, or other
  misc_feature (349)..(349): n is a, c, t, g, unknown, or other
  misc_feature (384)..(384): n is a, c, t, g, unknown, or other
  misc_feature (385)..(385): n is a, c, t, g, unknown, or other
  misc_feature (394)..(394): n is a, c, t, g, unknown, or other
  misc_feature (415)..(415): n is a, c, t, g, unknown, or other
ggagctcccgcggtggcggccgctctagaatagtggatcccccgggctgcaggaattcgtctcacccctangaaaaaactttacctccttgtcagctgctcgcacttgcagcgtcccgttcccgcacttctcttccttctcgtttcgtcctgcacagcgcacgcaactgccaccggccaccgcgcaaactccattgcgcgcagatcaagaccgccacacccaccaccagcgcttcagcgggagacgtgacgactgacgagacgaaaagctctcccacggcgcctccccctccacatggcctgggctcngcnttngctccgctccngtctgcgccccgcggcctccgccngcgggcgatcccgacacggctcaacccggggttcnngcttcgctncggtccccacctaacaaaggnagggtacctgggggcaccttccgggcaaccggttcgggggttttcttctggttcccggggaaccgggtgtctgaaccccgcccctcaaaaattaaccgggtggtttctccggggccccccttgggccccaggggccccggagggagggggctttttaaaaaggcccccctaacccggggcaaaggaaaaaccccgggggagagggcgccccaaaaaccgggggggaaaatgcccccccggggggaaaaaaagggggggggaaaggagcccccccacaaagaggggaagacatcttccgcccccggcggtttttccca

SEQ ID NO: 84678 - DNA, 978 bp, Zea mays
  misc_feature: Ceres CLONE 1570813
  misc_feature: Encodes the peptide sequence at SEQ ID NO. 84679
tccccgcggtggcggccgctctagaactagtggatcccccgggctgcaggaattcgtctcacccctagaaaaagcacaccactgtactcgcctgtagctcgccggagatccatgcctttgtgagctcgagtggagagaaaaaaaaaaggagcagcgaagagcgaacgaccgagatgctggagaagctgtgggacgacgtggtggccgggcctctcccggagacgggcctcgagaagctccgcaaggccaccaccgcccgcccgctcgtcgtcgtcgacaaagaaataactacatgcatcttctcatctgctggattgagtacatagaacacttgtgcaacacattcggcgagaacacgggtcatctttatattctactttctttaagtataccagcgtgagtaccagtgttggtcccgtagttatttcattattaccccccacggggatgttgttacccatttgacactttaaataaaggggtatttttcttgcttgggggccataatccaaggttctccaaaaaaaaaaaaaaaacttcccaccagtttccttctccaatttcccggggcttagcctgaagggtcgggttacaaggctggccccataggggtgggcggaacgtttccgtaaagtaacgtaacgtacggccgggggcggccacaccaccatggtgggtattcccatgtttttttccgggcccctcctgttgcaccccgggttttccaacgggggtctctccggggggtcttacccccggcggtccccagtgttccccctgtggtgggaaatgagccttgaccttctccccagttaagagaggtgggccaagaaaaaaaaaggtggcgcgcccccccgctgtggggaaattccgcggtgggtgaaatatcacaaatgggtgttcctcgccccaccaatacttattttttttggtgggaaacacagaaaacaacaacactgtatgtgtctgttgctccgg

SEQ ID NO: 84679 - protein, 50 aa, Zea mays
  misc_feature: Ceres CLONE 1570813
MLEKLWDDVVAGPLPETGLEKLRKATTARPLVVVDKEITTCIFSSAGLST

SEQ ID NO: 84680 - DNA, 770 bp, Zea mays
  misc_feature: Ceres CLONE 1570814
  misc_feature: Encodes the peptide sequence at SEQ ID NO. 84681
  misc_feature (551)..(551): n is a, c, t, g, unknown, or other
ctcaccgcggtggcggccgctctagaactagtggatcccccgggctgcaggaattcgtctcacccctagaaaaatccccgcggcgctacctgcctacccagatcccgctcgccggtggtgccctcctcagtcctcactctcccgccgctggcgccgccagagcgagggggagtgcccataccctactaggacgagcagtaggaggcggaggggcgagatccggcggaggccgccccgatgggggacttcaacgtggcactggtgatcgtggcggcggtggtcagcgtgctggtgctgctcgtcagcgtctaccttctcgtcaactaccagcaccccgacgacgtcaaccaggcctacttccccaagctcgtcgccaaccgccaggcatgccgcaaggccgtctacaacggcgcctgcagcctcacgctccccatgaggacgctctggctcgtcgtttacatcgttgacgccgtcctcgtcttcctcgtcatccccttcgcaatgttctactacgagggcgaccaggacaagtccgtcgggaagaagctcangaccgcgctcatctgggtcgtcgcgtccgcggtagtgtgcggcctcgtcctcggcatcctatacggacttgttggtaaagtggacttcactgtcaggcacctatcttcctcgggtcagacatttcaaacacattttctggatttctcagtggccagccgtgcattagtccattgactcgtcagtgtgcgggctcttctgcaccggcttacttgccaaca

SEQ ID NO: 84681 - protein, 162 aa, Zea mays
  misc_feature: Ceres CLONE 1570814
  misc_feature (105)..(105): Xaa is any aa, unknown, or other
MGDFNVALVIVAAVVSVLVLLVSVYLLVNYQHPDDVNQAYFPKLVANRQACRKAVYNGACSLTLPMRTLWLVVYIVDAVLVFLVIPFAMFYYEGDQDKSVGKKLXTALIWVVASAVVCGLVLGILYGLVGKVDFTVRHLSSSGQTFQTHFLDFSVASRALVH

SEQ ID NO: 84682 - DNA, 799 bp, Zea mays
  misc_feature: Ceres CLONE 1570816
  misc_feature: Encodes the peptide sequence at SEQ ID NO. 84683
  misc_feature (340)..(340): n is a, c, t, g, unknown, or other
aaagctggagctccccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatnggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccctcgccggccgcctcggcgccaacgccttcctctccggcaacgtgctcctcaacggccgcaaggccaagctctccttcggcgccgcggggtacgtgacgcaggacaacaacttgatcgggaccctgacggtgcgcgagacgatcggctactcgggcctgctgcgggtgccgaaaagatgccgcggggaggaaaacgcccgctggga

SEQ ID NO: 84683 - protein, 82 aa, Zea mays
  misc_feature: Ceres CLONE 1570816
  misc_feature: SWISSPROT Homolog: EC 3.6.3.28 Phosphonate-transporting ATPase
MGPSGSGKSTLLDALAGRLGANAFLSGNVLLNGRKAKLSFGAAGYVTQDNNLIGTLTVRETIGYSGLLRVPKRCRGEENARW

SEQ ID NO: 84684 - DNA, 741 bp, Zea mays
  misc_feature: Ceres CLONE 1570817
  misc_feature (326)..(326): n is a, c, t, g, unknown, or other
ccccgcggtggcggccgctctagaactagtggatcccccgggctgcaggaattcgtctcacccctagaaaaactccctccctgcgcctgtactcagcccgctgcttctcagtccacttcatccacagctcctcttctctcggtctagagatccgtccgggcacggtagtctcgccttcgttttgggcacaacgaacaattactctagaagagttgtactctttggtgtgccgtactctctgtaacaatcttaccaattaccattcttgagaagagggttacaattcttggtcccgtcagcgatgtccatagaaagagaggaggatnagttattgataagcaaagaggcacttgcactaaaattccaaaatgcagaaggaaatttgttcctctcgttcccttaagaaacttttcaggggatttctccccaagaaaaatcggaaggccaacttttgaatttggcttccgggggtcatcttaaaagaaaaattttgggccaacaaaaaaaagccccaaaaaatccctttttttttcccaaaaaataaaccctctgttttgtggaaaaaaaggcccccttttctttttttttgggggggggggaaaaaaaaagtttccccttgtggggaaaaaaaaaaaaataccccccccctggggttttttttttaaaaaaaacctctcctggggggggggggcaccaaacccccacaaaaaaaggtctcttttttggggggaaccacacaaa

SEQ ID NO: 84685 - DNA, 815 bp, Zea mays
  misc_feature: Ceres CLONE 1570820
  misc_feature: Encodes the peptide sequence at SEQ ID NO. 84686
  misc_feature (815)..(815): n is a, c, t, g, unknown, or other
ctccccgcggtggcggccgctctagaactagtggatcccccgggctgcaggaattcgtctcacccctagaaaaatagggatggggaccagcaagaccaccagattaagccgctgatatcaccgcagcagcagcagcagctggcagcggcactgcccggcgtggcgtccggccaaggcgcgccgaccgcggcggcgcagccaccgccgcccaagaagaagaggactatgcccgacccagacgctgaggtgatcgccctgtcgcccaagacgctgatggcgaccaacaggttcgtgtgcgaggtgtgcagcaaggggttccagcgcgagcagaacctgcagctgcaccggcgcgggcacaacctgccgtggaagctgaagcagaaggacccgctgcaggcgcagcggcggcgcgtgtacctgtgcccggagccgacgtgcgcgcaccacgacccagcgcgcgccctcggcgacctgacggggatcaagaagcacttcagccgcaagcacggcgagaagaagtggaagtgcgacaagtgctccaagcgctacgccgtgcagtcggactggaaggcgcactccaagatctgcggcacccgcgagtaccgctgcgactgcggcacgctcttctcccggagggacagcttcatcacgcaccgggcgttctgcgacgcgctcgcgcaggagagcgcgcggctgccgccgaccagcagcctcagcaacctcaccagccacctctacggcgccgccaccaacgcgggcaacatggcgctcagtctctcgcaggtgggctcccacctcacctcccactctcagan

SEQ ID NO: 84686 - protein, 196 aa, Zea mays
  misc_feature: Ceres CLONE 1570820
  misc_feature (22)..(44): Pfam Name: zf-C2H2 Pfam Description: Zinc finger, C2H2 type
MPDPDAEVIALSPKTLMATNRFVCEVCSKGFQREQNLQLHRRGHNLPWKLKQKDPLQAQRRRVYLCPEPTCAHHDPARALGDLTGIKKHFSRKHGEKKWKCDKCSKRYAVQSDWKAHSKICGTREYRCDCGTLFSRRDSFITHRAFCDALAQESARLPPTSSLSNLTSHLYGAATNAGNMALSLSQVGSHLTSHSQ

SEQ ID NO: 84687 - DNA, 836 bp, Zea mays
  misc_feature: Ceres CLONE 1570822
  misc_feature: Encodes the peptide sequence at SEQ ID NO. 84688
tggagctccccgcggtggcggccgctctagaactagtggatcccccgggctgcaggaattcgtctcacccctagaaaaagtaagtcctccccctacctctaccagctgcccgtcgcacacaaaaccccaggctgcccgccgccgccgcgacccgccacgccgccatgtccgctgccgcggcgctccggccgatcgagccacttcccctcccgatcgggctctccctctcgccgcgcctcaagcttctgctcaccttctttcgcgccgacctcaccgtccggcccctggacgagtggcagctcaagtccgccctcctcgcgtttctccgcgacccacctctccccctcccgctcctccccgactcagacttctccgtgagccgcctccctgacctccagaagcgccgtcgcgaggagcccgtagcctctggggtcctccacgtccgcgacctctccttcctccgcccccgcaagggagacggtgaggccgaggagatgaccggggagcaggagaagtacttcgagtggcggagcaccctggttcagaagctcgaaggcatcgagctcaacctcgagggagtgaagttccggatgaccgtcgagatcccatcgtctgacgacttcagaacgatgaagaagtcatgggaggatttctactcctccgagctactcaatagcaggaaatctgtgagaaagatagctaaaaggccagacacaattgttggtccgtggcgtgcctttccaggtgggtttgccagagacaagagtattcatccaaacctttcaacgctggttcacccaacactggtttttctcaaccgcttgggtaaaaataaa

SEQ ID NO: 84688 - protein, 224 aa, Zea mays
  misc_feature: Ceres CLONE 1570822
MSAAAALRPIEPLPLPIGLSLSPRLKLLLTFFRADLTVRPLDEWQLKSALLAFLRDPPLPLPLLPDSDFSVSRLPDLQKRRREEPVASGVLHVRDLSFLRPRKGDGEAEEMTGEQEKYFEWRSTLVQKLEGIELNLEGVKFRMTVEIPSSDDFRTMKKSWEDFYSSELLNSRKSVRKIAKRPDTIVGPWRAFPGGFARDKSIHPNLSTLVHPTLVFLNRLGKNK

SEQ ID NO: 84689 - DNA, 833 bp, Zea mays
  misc_feature: Ceres CLONE 1570828
  misc_feature: Encodes the peptide sequence at SEQ ID NO. 84690
tccccgcggtggcggccgctctagaactagtggatcccccgggctgcaggaattcgtctcacccctagaaaaaacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaagttgctatctatagagaggagccctcccattgaagaagttatcaaatcaggtgtagttccaagatttgtgcagttgctcacaagagaggatttgccccagctgcagttcgaagcagcatgggctctcacaaatattgcttctggcacttcagaaaatacaaaggttgttattgatcatggggctggtcctatatttgtgaagcttcttgggtctggtagtgatgatgttcgtgagcaggctgtgtgggctttgggccatgttgctggcgattttccgaatgtcgtgacctttttcttggccatggtgcattgatgcctctgcctagccccgttgaatgagcatgcgaaagctcctcaatgttggaggaaatgccacccgggaactcctttcccaactc

SEQ ID NO: 84690 - protein, 198 aa, Zea mays
  misc_feature: Ceres CLONE 1570828
  misc_feature (4)..(92): Pfam Name: IBB Pfam Description: Importin beta binding domain
  misc_feature (101)..(142): Pfam Name: Arm Pfam Description: Armadillo/beta-catenin-like repeat
  misc_feature (144)..(184): Pfam Name: Arm Pfam Description: Armadillo/beta-catenin-like repeat
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKSGVVPRFVQLLTREDLPQLQFEAAWALTNIASGTSENTKVVIDHGAGPIFVKLLGSGSDDVREQAVWALGHVAGDFPNVVTFFLAMVH

SEQ ID NO: 84691 - DNA, 1103 bp, Zea mays
  misc_feature: Ceres CLONE 1570830
  misc_feature: Encodes the peptide sequence at SEQ ID NO. 84692
  misc_feature (60)..(60): n is a, c, t, g, unknown, or other
  misc_feature (1103)..(1103): n is a, c, t, g, unknown, or other
attggggtgttttatatgtttcgctgttattcctttttttttttgttggtgtggcggaanaaaaagaattttttttactggagctcaccgcggtggcggccgctctccatggctgcctacatctcggttacgggatttctgacgtccctataaagacctcctgctggtactggtcgtcgggaaggaaactcctcaccacgcacatgctctgcaccaagaaggtgcagtccttccgccatggccgacaggtaagatgtgcggctcctcatggacaagatccgagcgtgtgccaccgccgcgccgccggcagctgtggacctgatcgatctcctgtccgggtacaccaacgacgtggtgtgccgcgtggtgctgggcgcgtcgcaccgaaaccaacgtcggaacacgctggtcaacgagctgacagagatcgacgtgtctgtcctcggcgggttcaaccttgagggactagttccccccccccctggccatggatggacattcctcctacccggctggcgtctcgtcaaggcaccggccagcttcaaccaataagtgggaaactgacttagttcccaccagtctttattccaaaaaaaacatcgtattagaaaaaaagggcccttttccgctgtaagattccgaaagcagtatcctaacgccgcgaaaatttccattaaccccggtaatccatgtggttcgtaccaattaagaagtggaattgaagttcagccgtggccttctctagccttaccttgcttactaaatgtcttacacaaggtcgccctgttaattatgggcagaggcaaattacggttgtcccatagggctcaggtgttattatcgcaaggatccttactttatacactctttgaagtgtgttttacaaacagtaccttggccattttcgtcttgcgatacccccacagtgaccgacacaccctttgggtcaccagcgccaatctgtgtcaagacaatcttttcatcaaaccagtgagaaattatatagctcacactaaccaaatcccctccatcatccccgggagataatggctaaatataatcttagtgaaacattcgctacgttctggatagacatgtatccn

SEQ ID NO: 84692 - protein, 94 aa, Zea mays
  misc_feature: Ceres CLONE 1570830
MDKIRACATAAPPAAVDLIDLLSGYTNDVVCRVVLGASHRNQRRNTLVNELTEIDVSVLGGFNLEGLVPPPPGHGWTFLLPGWRLVKAPASFNQ

SEQ ID NO: 84693 - DNA, 808 bp, Zea mays
  misc_feature: Ceres CLONE 1570831
  misc_feature (338)..(338): n is a, c, t, g, unknown, or other
  misc_feature (709)..(709): n is a, c, t, g, unknown, or other
  misc_feature (784)..(784): n is a, c, t, g, unknown, or other
ctccccgcggtggcggccgctctagaactagtggatcccccgggctgcaggaattcgtctcacccctagaaaaaacgaagtggggcgcctagcttcttactagttttttttttccttgcgcaaagcttgcacttgctgagagagagggagagagaaatccagagataaaggcgcttcattcattccctctcctgctttctctctccaacccatccgtcctctctctccacacataaaaaccaacgaagcgggcgagtgatcaggcagaggcagcaggcaggaaataaatttgaagaaagctagacctctgatcagcaggagctcatggggcgccatgnatgggcctcccataaaccaggggaaggtcccccttcttttcttcccttcaatccgggtggggcccctcctccccttttgtaaaccccccccccccctccccaaaagggcccccggggggacccccacccccggggggcccccccaaaaaaaaaaaaagggggccaaaatttttttccccccggggggggcccccccccgaaaaagaggccccctttttggggggaaaaaaaaatttgggggggccccccccggccccccccccccggggggggaactttttttggggggggggggttttttttttttgggggggggggggtttttttttccccccccggggggggggggaaaaaaaaaaaaataatttttnccccccccctcttcttcttctttttttggaaaaaaaaaaaaaaacagaaagagttgtgtggttgtttttcactcnccaccccccgcggggttggtattt

SEQ ID NO: 84694 - DNA, 1241 bp, Zea mays
  misc_feature: Ceres CLONE 1570836
  misc_feature: Encodes the peptide sequence at SEQ ID NO. 84695
  misc_feature (70)..(70): n is a, c, t, g, unknown, or other
  misc_feature (1042)..(1042): n is a, c, t, g, unknown, or other
atttattataaggggggtattttcctcctttttctttgtgagggcttatatcgagtggcccttccccccncccactggagctccccccggtggcggccgctctagaactagtggatcccccgggctgcaggaattcgtctcacccctagaaaaaggccggcccgttcaccatttctcatcgttcaattcagaatctgatacatcagagaagggccacagcacagagagagactgtctgccagtggacgcgagggagcgcctccgcctcagatccaacccccaccgatgcgagctccggcgatgctccgctgggccgcggcggcgctcgcggcgctcctcgccgcctcaccggccgccgcgttttacctacccggcgtggcgcccaacgacttccataagaaagatccacttttggtgaaggtgaataagctgacatccacgaagacgcaacttccctactcatattagtctcgtcccccccctaaaccaaacacgatacttgacagtgctagagaatcttggagaaagttctggcgtggtgaatcgcaattgaggaacctctccattatggtgttttgaagatgggggggaacccccagaatggtgacccagatttattctgtcctaagcaaaaaaaattggattgaatagaaaccatggccaaaagggaaacctttttagtggaaaaaaaaatatacagagggaattggaagcttaatctaggggtgtgaaacaacttagaaatttccagtttggagaacaagaattcctcaccaccaagagtaagaggatgtggtttagcccccataaacattgtggacaaaaagaggaatatatgaataattacaggcggggggcgctgctctgagatcttggttgtgttatcctcgagacgggtacttgcgaaatatagtctcacctctgcgtgttgagggtagtcgacagaaaggggggcgcccatgccaaaactcctactatgggcatttaacaccacattacggacttgtcacagtacaacgtctcctgtttgctataatccctnctacaacacgcaccccgtgggggggaagatttcttttctatagcttgccacattctcccccccctcttgatagggggaaggacaacacactccaccgggagatagctctctcccacttaaaaatataatggcttgaggagaatatttgttgtatggcgccaaccgcccctcctttgtctgtgtgacgcagataacgttg

SEQ ID NO: 84695 - protein, 60 aa, Zea mays
  misc_feature: Ceres CLONE 1570836
MRAPAMLRWAAAALAALLAASPAAAFYLPGVAPNDFHKKDPLLVKVNKLTSTKTQLPYSY

SEQ ID NO: 84696 - DNA, 813 bp, Zea mays
  misc_feature: Ceres CLONE 1570842
ctccccgcggtggcggccgctctagaactagtggatcccccgggctgcaggaattcgtctcacccctagaaaaagctgctgctccgcccttccgaccgattgaggcggcgcaaagcaaaggaaaaccccaggccgcaaccctcgcaaacactcgagtcctcgtctcttccgcaccctcctcctcttcaactccagccgccgtccgctcgggctcggaccgagcctctccgccgactccgcgcctccgctgctcattgctcaggcgctccgcccgccgtccgccgtccgctcgggcttggagcctcggaccgagccgctccgcgactccggcgcgccgtccgccgttcgcccgacagcccgagaaggcgagcaggagcagctccgcacctcagcccgccgtccgctcggccggagcacgcgccgttgcccctgtgcctccgttcgccggtcgagccgctgtccgcgtccctgtccctccgtccgccgagctgctgtgccttccggcttcgccgtccgccgagcagatccgtccgcgagcgcgacacgccgaccgccgagccatacctaatttttttttccgtcctccgccactgatcaggaccaccaatgggccatgacacttggaaatcctatgcttgggccatgaccaccaatgggccttcgccgagcatcgagaagcctccgcgcccgccgcacgccggaggaaaggaagtcaccccatccccaaattccaaagccaacaccgccgagaaggacagagactggaagcgcaagagcaggcgccgcgcgtgctggcgatggagagggacgtcg

SEQ ID NO: 84697 - DNA, 755 bp, Zea mays
  misc_feature: Ceres CLONE 1570843
  misc_feature: Encodes the peptide sequence at SEQ ID NO. 84698
ccgcggtggcggccgctctagaactagtggatcccccgggctgcaggaattcgtctcacccctagaaaaagatgagatcggcgcgtatatcttttccggtgtccgatgattcatgcattagcaatttgactcgtacgtgcgtgactacagttgcatgctatggccatggccaccacttcgccggcaactgtgcagccatcatcatacaagcacacgagccgcggcgcggcgcggtgctgccctcctcctctgctgtcctggaagacacgaagctttgggcagcaggtgacgacaagggccacggcggcgagctcccgtgggcagcccgccggcgtggcactggcagggggagaagagggcgacagtatcaggcggctgcagaacgggtcggacgtgcggggcgtcgcgctggagggcgagaaaagccgggccgtggacctcacgccgctggcggtcgaggccatcgccgagagcttcggggagtggctgcgagaggaggagctccggctccggggccaggagcccgagcagctgcgtgtgtccgtcggccgcgaccccaggctgtcggggccgcggctcagcgcggcgctctttgcggggctcgccagggcgggctgctccgtcttcgacatggggctcgccaccacgccggcctgcttcatgagcaccatactgccacgcttcaactatgacggctcaattatggtagtgaagtaatgatacgtattctacgtttgcgtcgtgtttggtgtgca

SEQ ID NO: 84698 - protein, 183 aa, Zea mays
  misc_feature: Ceres CLONE 1570843
  misc_feature (69)..(183): Pfam Name: PGM_PMM_I Pfam Description: Phosphoglucomutase/phosphomannomutase, alpha/beta/alpha domain I
  misc_feature: SWISSPROT Homolog: EC 5.4.2.10 Phosphoglucosamine mutase
MATTSPATVQPSSYKHTSRGAARCCPPPLLSWKTRSFGQQVTTRATAASSRGQPAGVALAGGEEGDSIRRLQNGSDVRGVALEGEKSRAVDLTPLAVEAIAESFGEWLREEELRLRGQEPEQLRVSVGRDPRLSGPRLSAALFAGLARAGCSVFDMGLATTPACFMSTILPRFNYDGSIMVVK

SEQ ID NO: 84699 - DNA, 785 bp, Zea mays
  misc_feature: Ceres CLONE 1570844
  misc_feature: Encodes the peptide sequence at SEQ ID NO. 84700
acccgcggtggcggccgctctagaactagtggatcccccgggctgcaggaattcgtctcacccctagaaaaaaccgaacggctacgcatacggcatgctcgtcgccctcctctgcctcctcgcctgctgcgccggcgccggcgcagcaagcgccaccgcgccaaacgcacgcccgtgcgcgtcgccctactcggccagcgcctacccgttctgcgacgcgtcgctctccatcccggaccgcgcgcgcgcgctcgtctcgctgctcaccctggacgaaaagatagcgcagctgtccaacacggcgggcggcgtcccgcgcctgggcataccgcccataccagtggtggtccgagtcgctccacagcctcgccgacaacaggtccggggtcaacttctcctcgggccccgtccgcgccggcaccgacttcccgcaagtcatcatgtccacgcgccgccttcaaccgcacgctgtggcgcgcaggcgccgaaggcatctccacggaagccctcggcatgcacaaggacggtcaagccggcctcacgtattgggcgcctaacatcaacatcttccgagaccccaggtggggccgcggacaggagacgtccggggaggaccccgctgtcgctgccgcgtactggctcaagtatgtcaaggggttcctgagatgcgaacgataggaacgctgaatgcagctctctgcgtgcagctgacactataccgcgtatgacatgcagaaatgggaatgcttctcgcggtacaccttcgatgtacaggtaaatggaaa

SEQ ID NO: 84700 - protein, 54 aa, Zea mays
  misc_feature: Ceres CLONE 1570844
  misc_feature: SWISSPROT Homolog: EC 3.2.1.21 Beta-glucosidase
MHKDGQAGLTYWAPNINIFRDPRWGRGQETSGEDPAVAAAYWLKYVKGFLRCER

SEQ ID NO: 84701 - DNA, 844 bp, Zea mays
  misc_feature: Ceres CLONE 1570854
  misc_feature: Encodes the peptide sequence at SEQ ID NO. 84702
ctggagctccccgcggtggcggccgctctagaactagtggatcccccgggctgcaggaattcgtctcacccctagaaaaaaacccagcctagcgtcgcgtggcctccttccgttactctcctcccacctctctcagatctccccacgcctcccggcctcgtgtcgccaccgcccccaaaccctacccccgcctcgttggatcgggtcagacctcggcctcacgccacgaggagcagcggtggcgcccgctgcgtcgatgcggagctctatcgcgacctaccgggagagcctgtctcggctcgccggcgaggtcgacgacgccgctgccgacgaggtccctgggccgccgctcgccccggcagctaggggcgtggacatatccgccacaccaccgtcgtcgggaaggcgccgacggtactcccgccctggccccggctccgatgccaccgagcccgacgagatttctaaactgagggatgacattcaaaagcttcaagcttctgaggttgaaataaaggcactatctttcaattatgctgcaatgttgaaggaaaaagaggagcaactgggaaaacttcgtgaagaaaatgggtctcttaaaagaagcttggagagctgtaaggcagtttcagccaattctaatggcactttggaaagatcacctagagcgcaaaggaatgcagttcaggagaattcattggatctcaccaagcagaatggatatgggtggggggtcctttctcacagtacccagggcaaaatggtctgcatccaatgggcagggtatccagaaagggaagtatattggggaggaaagaaagatcattcctttactaacaaagga

SEQ ID NO: 84702 - protein, 196 aa, Zea mays
  misc_feature: Ceres CLONE 1570854
MRSSIATYRESLSRLAGEVDDAAADEVPGPPLAPAARGVDISATPPSSGRRRRYSRPGPGSDATEPDEISKLRDDIQKLQASEVEIKALSFNYAAMLKEKEEQLGKLREENGSLKRSLESCKAVSANSNGTLERSPRAQRNAVQENSLDLTKQNGYGWGVLSHSTQGKMVCIQWAGYPEREVYWGGKKDHSFTNKG

SEQ ID NO: 84703 - DNA, 788 bp, Zea mays
  misc_feature: Ceres CLONE 1570855
  misc_feature: Encodes the peptide sequence at SEQ ID NO. 84704
ctcaccgcggtggcggccgctctagaactagtggatcccccgggctgcaggaattcgtctcacccctagaaaaagttccgtctcgcagtggcagcaccgcagcagagagaagagagatcttctagcctagtagtagcatctacttactagtgagtgagtaggagtacttggctaggacgggggggggcgtgacgacggtagcagcatgagctgcaacgggtgccgggtgctgcgcaaaggctgcagcgaggcctgcgtgctgcgcccctgcctccagtggatcgacgccgccgaggcgcagggccacgccaccgtgttcgtcgccaagttcttcggccgcgcgggcctgctctccttcatctccgctgtcccggacgcgcagcggcccggtacgcttccgtcccgtcccgtcccgtccccatgcatgaactatcacacaccgaccatgatccctagtagctagcttattgcttaccaggcttactgtccatgtccatggcacctcctcgcagccctgttccagtcgctgctgtacgaggcggcggggcggaccatcaacccggtgcacggcgcggtggggctgctcggcacgggggaactggcacctctggcaggccgccgtcgacaccgtgctgcgggggcggcgccatcgggccgctggcgggagctccggcacccgggacccgccacctggtcgggggcccccggccgccaccgaaaaagcggggcccgcgggcttggtccaaccttttcccaccgggaaaacggggccccggaaaggccccggt

SEQ ID NO: 84704 - protein, 85 aa, Zea mays
  misc_feature: Ceres CLONE 1570855
  misc_feature (2)..(82): Pfam Name: DUF260 Pfam Description: Protein of unknown function DUF260
MSCNGCRVLRKGCSEACVLRPCLQWIDAAEAQGHATVFVAKFFGRAGLLSFISAVPDAQRPGTLPSRPVPSPCMNYHTPTMIPSS

SEQ ID NO: 84705 - DNA, 833 bp, Zea mays
  misc_feature: Ceres CLONE 1570858
  misc_feature: Encodes the peptide sequence at SEQ ID NO. 84706
ctggagctccccgcggtggcggccgctctagaactagtggatcccccgggctgcaggaattcgtctcacccctagaaaaattattggagcatgcaggaagccagtggtttggtgcattgtgacggagtatgccaagggtggatcagttagacagtttctagcgaagaggcagaataggtcggttccactaaaactggcggttaagcaagcattggatgttgcaagggggatggcctatgttcatggtcttgggttcatccatacggatcttaagtcagataacctcttgatatctggtgataaatctatcaagatagctgactttggagtaactcgcattgaagtaaaaactgaggggatgacacctgaaacgggaacctaccgttggatggcaccagagatgattcagcataggccatatgaccagaaagttgatgtctacagctttggcattgtgctgtgggagctcataactggcatgctcccttttgctaacatgacagcaatgcaagctgcttttgctgtggagaacaagggtgtccgcccagctataccccaggactgcctgcccaccctcggtgagatcatgaccaggtgctgggatacaaatcctgatgtccgtcccgcgttcactgaatatgtgcagatgctggagcatgctgacgtggagatcctgagcactggtcggcaggcccgatttcggtggtgcatctcccaaccgatgaccacccactgaatcaaaccgaaagatatcggaaaagactccatgcaggcataaattgagtaaatttatcttgttgtccagacctcccctaacctgaagtagaaaaccc

SEQ ID NO: 84706 - protein, 168 aa, Zea mays
  misc_feature: Ceres CLONE 1570858
  misc_feature (1)..(141): Pfam Name: Pkinase_Tyr Pfam Description: Protein tyrosine kinase
  misc_feature: SWISSPROT Homolog: EC 2.7.11.1 Non-specific serine/threonine protein kinase
MAYVHGLGFIHTDLKSDNLLISGDKSIKIADFGVTRIEVKTEGMTPETGTYRWMAPEMIQHRPYDQKVDVYSFGIVLWELITGMLPFANMTAMQAAFAVENKGVRPAIPQDCLPTLGEIMTRCWDTNPDVRPAFTEYVQMLEHADVEILSTGRQARFRWCISQPMTTH

SEQ ID NO: 84707 - DNA, 794 bp, Zea mays
  misc_feature: Ceres CLONE 1570862
  misc_feature: Encodes the peptide sequence at SEQ ID NO. 84708
  misc_feature (97)..(97): n is a, c, t, g, unknown, or other
tggagctccccgcggtggcggccgctctagaactagtggatcccccgggctgcaggaattcgtctcacccctagaaaaaattaaactcacaacacgngtagcaggggggtggtagtagaaggcataagctctgttctctgaccctcaagtgtttgagcctatttgcgcaacgaaaaaatgagcatcaaaagcattaatggaaagagccccatagtggttggaccttggggagggacaggagggtacccttgggatgacggcgtgtactcaacaatacgccagatcgtgattggccatggtgcagctattgactcaataaggattgaatatgatctgaaaggaaggtcggtttggtcagaaacgcatggaggtactgatggtggctccgaaacagataaggtgaaactagattttccagatgaagtcctcgtgtctgtaagtggacactacggatctgtctgcgggacaccggtcatcataagatcgttgacgtttcagagcacagctcgacgtacggacccttttcgcacgaggatgcacacccttctcactcccagttagcagtgggcagatcattgggattcacggggcggtcttgggtccgatcccaactcaatcgggttctaacctgaagcaaggggcattttcccacctccaggggaatcctttttccagggtttacccttttgaaacctcccccaaaggcccccaaaaggtaaaaaaaaaagcggccccctttggggccccccacccccggggggggggaaaccccttaagaccccagaaaaagggtt

SEQ ID NO: 84708 - protein, 127 aa, Zea mays
  misc_feature: Ceres CLONE 1570862
  misc_feature (22)..(126): Pfam Name: Jacalin Pfam Description: Jacalin-like lectin domain
MSIKSINGKSPIVVGPWGGTGGYPWDDGVYSTIRQIVIGHGAAIDSIRIEYDLKGRSVWSETHGGTDGGSETDKVKLDFPDEVLVSVSGHYGSVCGTPVIIRSLTFQSTARRTDPFRTRMHTLLTPS

SEQ ID NO: 84709 - DNA, 809 bp, Zea mays
  misc_feature: Ceres CLONE 1570864
  misc_feature: Encodes the peptide sequence at SEQ ID NO. 84710
  misc_feature (597)..(597): n is a, c, t, g, unknown, or other
  misc_feature (599)..(599): n is a, c, t, g, unknown, or other
  misc_feature (600)..(600): n is a, c, t, g, unknown, or other
  misc_feature (606)..(606): n is a, c, t, g, unknown, or other
acccgcggtggcggccgctctagaactagtggatcccccgggctgcaggaattcgtctcacccctagaaaaacgatggagctgtgagctgagctgagcttaccaccaccacacacgggagatagctatagctagcatagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgccgccttcaccgcgctcttcgacccggacctcgtggacaagcgcgacatcctcatcgggccctacaacccgggcgccggcttcaccggcgggacgcgcgtcggcgtgtacctcgacacgcaggaagaagagcacgcgcgcgtcaagacctttcgcatgtacctncnntcacgntccgcccgcacctggtccgccgacttccgcgcgagcgtcggcgccatgctggacgccgtggacgcggaggtcggcaaggacgacggcagcgacaagaagccctccgccagctacctcggcccccctgcaagagtgcatccttcgggttcctctgccagggggttcgtggggcgccgacccgttcccgcgaacttggctggtgg

SEQ ID NO: 84710 - protein, 212 aa, Zea mays
  misc_feature: Ceres CLONE 1570864
  misc_feature: SWISSPROT Homolog: EC 4.2.1.92 Hydroperoxide dehydratase
  misc_feature (143)..(143): Xaa is any aa, unknown, or other
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFRMYLXSRSARTWSADFRASVGAMLDAVDAEVGKDDGSDKKPSASYLGPPARVHPSGSSARGFVGRRPVPANLAG

SEQ ID NO: 84711 - DNA, 874 bp, Zea mays
  misc_feature: Ceres CLONE 1570866
  misc_feature: Encodes the peptide sequence at SEQ ID NO. 84712
  misc_feature (818)..(818): n is a, c, t, g, unknown, or other
ctccccgcggtggcggccgctctagaactagtggatcccccgggctgcaggaattcgtctcacccctagaaaaaaaaagaagagcagcaccatccagtgcatcacgagctcttctgcaccagattagcaggccatcgcctacttttggcttccaaatcatttatttacggcgtacgtgccttctgttcaaaccccagccccgctgcaatggagtgcgacaacggccgcgtcgctgctaccaacggcgactccctgtgcatggcgctgccccgcgccgccgacccgcttaactgggggaaggcggcggaagagatgatgggcaagccaccctcgactgaggtgaaagcggaaatgggtggcccgagttacccgcccagccccctggtggaaaaatccgaggggggcgcccagcccccccccccattcccggaaaggggggggcccgccaaattccccccccccccggggccccccggggggacaaaaaggccccccggggggtcacaaaaactcttttcaaaaaaaaaaaatctccccccccccccccccggggagccggcgggggttctcaaaaggggggggaataaacaaaaaaaagcggaaaacactggggggggggcctcaggagggggagaaaaacacccccctttgttggtttgaagaaaaaaaggggggcgctccccccccaaaccaaaacagtcgttttctcagggcggggagggctgcttccctccaccagagagggtggtgtttttgttgggggtggggagaacaaaacaaaatactgttgctaaaacagcgcgggtgttcggctgtcnttattattaaataaaaaataaagaaagtggggactcgcccggtggtggatctcctt

SEQ ID NO: 84712 - protein, 150 aa, Zea mays
  misc_feature: Ceres CLONE 1570866
  misc_feature: SWISSPROT Homolog: EC 4.3.1.5 Phenylalanine ammonia-lyase
MECDNGRVAATNGDSLCMALPRAADPLNWGKAAEEMMGKPPSTEVKAEMGGPSYPPSPLVEKSEGGAQPPPPFPERGGPAKFPPPPGPPGGTKRPPGGSQKLFSKKKNLPPPPPGEPAGVLKRGGNKQKKAENTGGGASGGGEKHPPLLV

SEQ ID NO: 84713 - DNA, 838 bp, Zea mays
  misc_feature: Ceres CLONE 1570867
  misc_feature: Encodes the peptide sequence at SEQ ID NO. 84714
  misc_feature (617)..(617): n is a, c, t, g, unknown, or other
gcggtggcggccgctctagaactagtggatcccccgggctgcaggaattcgtctcacccctagaaaaaaagagcctcaaccacactattcaggtggcctaggactctacgagggacgttcgtcgtgcctcggatgagatgggcggcggaggaggaggaggaggcgggaagtccgagaaggcgcggcgttcgtcggcgcgggtgaggctgtgggtcgcgcgcgccagcaccgtgctgctctggacgtgcctcgtccagctcgcggcctaccgggagctctgggcgcccagcgtgctctccaggtggcctggctgcctcaaccagccgcacgtcgcgcggaggccatcggagcgtgtggcggacgccggccagacgcaggcagcgcgcgcccccccggtgctcccacccaaaagaatctacaggaacaacggctatctaatggtctcctgcaacggcgggcttaaccagatgcgagcagcaatttgtgatatggtaaccatcgcaaggtatcttaacgttactctcatagtaccagagttggataaggcttcattttgggctgatcccagcgatttccaagacatatttgacgtggactacttcctaagcgtccctganagacgaaggccggatcctgagggagctgccgccgagggtctagaaaagagtggagcgggggtcccctcccggtccctgccaccaattcagcttggttccgaaattgggctaactacccgccgtccaggtttcgggtccgcgtcctccctttaacactcggcgggccctggaaaccgaaatcccgaaaacccaggtggaaaagaccggttttggtttccact

SEQ ID NO: 84714 - protein, 210 aa, Zea mays
  misc_feature: Ceres CLONE 1570867
  misc_feature (160)..(160): Xaa is any aa, unknown, or other
MGGGGGGGGGKSEKARRSSARVRLWVARASTVLLWTCLVQLAAYRELWAPSVLSRWPGCLNQPHVARRPSERVADAGQTQAARAPPVLPPKRIYRNNGYLMVSCNGGLNQMRAAICDMVTIARYLNVTLIVPELDKASFWADPSDFQDIFDVDYFLSVPXRRRPDPEGAAAEGLEKSGAGVPSRSLPPIQLGSEIGLTTRRPGFGSASSL

SEQ ID NO: 84715 - DNA, 911 bp, Zea mays
  misc_feature: Ceres CLONE 1570868
  misc_feature: Encodes the peptide sequence at SEQ ID NO. 84716
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
tatgatgggtttttttttttgttgtcctttttctgcccggcgtgtgttcgggggccagtattatgagnnnnnnnnttaaactgggactccccgcggtggcggccgctctagactagtggatcccccgggctgcaggaattcgtctcacccctagaaaaactagaacaaacctgaatttcatccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtccgttgcagcccacgtgccgtcgtcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcagagaaactttgaggcaactctggcatcagaagcacttctaaatgaagaggcggtagtagcagcggcagccgcagaggcagttgctcttgccagagcagctgccgaagctgcccaagaagttgttcagatagtacaaagaaacagccatcagccggtaattagaccaaaaaagtgtgtggacaactacttggcaaatgaaatccttcgcacagagatgcgatcgagcagtcctgacatgtatgctaataatcctttgatggagtatctggactcttatgggatcatggatgcctgaagatgaaattagatgccttatggcgccagtatactgaagaaacatagcctggtgaaaatcctgcctcgttcaaatcctgaagaggaaaaaggctagggaggaaacttaggaagccggcccaataaaaaaggctaaggcaacaac

SEQ ID NO: 84716 - protein, 161 aa, Zea mays
  misc_feature: Ceres CLONE 1570868
MACLAPQFKWAPSVAAHVPSSSSSYSRCSALRVHCAVTSAAVVEDRTNGSAAQLRLAYAAPAIQRNFEATLASEALLNEEAVVAAAAAEAVALARAAAEAAQEVVQIVQRNSHQPVIRPKKCVDNYLANEILRTEMRSSSPDMYANNPLMEYLDSYGIMDA

SEQ ID NO: 84717 - DNA, 782 bp, Zea mays
  misc_feature: Ceres CLONE 1570869
  misc_feature: Encodes the peptide sequence at SEQ ID NO. 84718
gcggtggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgcttctttgcactcctccctcctccatctccaagattgtggttctgattccactgcctcaatggctgttcttttctgctgctgatgcctccccgggctcaagctatcgggtttgaggggctttgagaaagcgccttgaaatccacattctcttaaggcacttgtcttttgtggacccttcaggagcgtgggttc

SEQ ID NO: 84718 - protein, 50 aa, Zea mays; identical to SEQ ID NO: 64299
  misc_feature: Ceres CLONE 1570869
  misc_feature (1)..(50): Pfam Name: AdoMetDC_leader Pfam Description: S-adenosyl-l-methionine decarboxylase leader peptide

SEQ ID NO: 84719 - DNA, 907 bp, Zea mays
  misc_feature: Ceres CLONE 1570871
ccccgcggtggcggccgctctagaactagtggatcccccgggctgcaggaattcgtctcacccctagaaaaaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctggggttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagcaaccggcgcctctgctcgccgcccgccccgacccacgtttagggcgttcgcgccccatgggcccgtgccattggctcagcccgcccggccgacgcgccgcgggcggccgcctcgaagctcccttcccaacgggcggcgtgctgaatcttttgcagacgactaaaacgcgacggggcattgtaagtggcagagtgccttgctgccacgatcactgagatccagcccgcgtcgcacggatccggagggtctcggtagcttcctcccatttccattgggcattttcaccgtccaccaacaacggggggggaccaaggaagcgaaaggatacacgcgatgtcgcaacccgggggcgtggccttctggggggggccgg

SEQ ID NO: 84720 - DNA, 839 bp, Zea mays
  misc_feature: Ceres CLONE 1570873
  misc_feature: Encodes the peptide sequence at SEQ ID NO. 84721
ggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaagtacccggcgaagaccttctttcacgacgtcggcctcggcggcatcggctacgaggtcacccgctacctttacgccacctgcaacgacctcaagttccccaaacttcggcatcaagaccgccgccaaacgccaagaaggtggagcgaagtccgggcacgttcatcggggaacctgggccttgttccacgaaccagt

SEQ ID NO: 84721 - protein, 196 aa, Zea mays
  misc_feature: Ceres CLONE 1570873
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSCKYPAKTFFHDVGLGGIGYEVTRYLYATCNDLKFPKLRHQDRRQTPRRWSEVRARSSGNLGLVPRTS

SEQ ID NO: 84722 - DNA, 816 bp, Zea mays
  misc_feature: Ceres CLONE 1570876
  misc_feature: Encodes the peptide sequence at SEQ ID NO. 84723
  misc_feature (646)..(646): n is a, c, t, g, unknown, or other
  misc_feature (647)..(647): n is a, c, t, g, unknown, or other
ctccccgcggtggcggccgctctagaactagtggatcccccgggctgcaggaattcgtctcacccctagaaaaaacgccacgcgtccacgtccgggtccgtccattctgctctcaccctcgggtctcggtcatcggggaagagcacgaggctcaacgcgtcagcgactcagcgtcatatttctgagttctcgcttctcacttgtgcccagatgccggccctttccttttcgggatctcctcggtgacctagatcggatggacccgccgccggcgacgcgcgcggcgtccaggcggcgggaccgccgacggcgcctgcggcagcggcagcgcgcagctgcagccacgaaaacgagggtcggtgcggccgtgctggccgtggagccgcagagcgcagcagtcacaaccccggtggcttcgaccggccctgctgccacgccggcgtcgaggggcaggaaacggcggaggcctcgtagacggcgtgaccggaacgcgggcgccgctggggtggcggacgaaccaccggctgcgtcccccgttcccgttccagatgccccgcaagcaagttgcaatttggaagcaatggcatcacgtctgagcgataatgtgctgcaaactatgaccgagaagataatgaggtcagataannacagcagagaaatttcagcacggaaatgaggcgctaaaagatctgtggctgaaggtgctgcctgctcttctcttggccgtcgtgaacattctaccagaggaaatggaggctccagggagtagatacttagagatcccatgtaaactcccccaggtgatagtgccctgaa

SEQ ID NO: 84723 - protein, 139 aa, Zea mays
  misc_feature: Ceres CLONE 1570876
  misc_feature (130)..(130): Xaa is any aa, unknown, or other
  misc_feature (131)..(131): Xaa is any aa, unknown, or other
MDPPPATRAASRRRDRRRRLRQRQRAAAATKTRVGAAVLAVEPQSAAVTTPVASTGPAATPASRGRKRRRPRRRRDRNAGAAGVADEPPAASPVPVPDAPQASCNLEAMASRLSDNVLQTMTEKIMRSDXXSREISARK

SEQ ID NO: 84724 - DNA, 774 bp, Zea mays
  misc_feature: Ceres CLONE 1570877
  misc_feature: Encodes the peptide sequence at SEQ ID NO. 84725
  misc_feature (42)..(42): n is a, c, t, g, unknown, or other
  misc_feature (135)..(135): n is a, c, t, g, unknown, or other
  misc_feature (175)..(175): n is a, c, t, g, unknown, or other
ctccccgcggtggcggccgctctagaactagtggatcccccngggctgcaggaattcgtctcacccctagaaaaaaaaaaaaaaaaaaaaaaaaaatttttgggtgggatccctttaccctagacagtgtcgtanggcactggactcccacacaactatgaatagatggtcttgngagttgctgggtaggggagttggtggcatagaggcggaagctgcaatgcttggccagccaatgagcatggtcttgccaggggttgttggcttcaagttatcaggcaagctgaggaatggagttacagccactgacttggttctaacagtaacccaaatgcttcggaaacacggtgttgtcgggaaatttgttgagttctatgggcaaggcatgagtgaattgtcacttgctgatcgggccaccatcgcaaatatgtctcccgaatatggcgcaactatgggtttcttcccagttgatggaaagacgctggactatttgaagcttactggccgaagtgatgatacagtggccatggttgagtcctacctgcgtgcgaataagatgttcgttgatcacagccaggctgaagctgaaagagtatattcttcttatctagaactgaacctggaagaggtagaaccatgtctatcgggaccaaaacggcctcacgatcgagtgacattgaaagaatatgaagtctgattggcttttctgcttggatagcgatgtaggattcaagggttttgctgtccccaaagagtcacaaggcaaagttgcac

SEQ ID NO: 84725 - protein, 179 aa, Zea mays
  misc_feature: Ceres CLONE 1570877
  misc_feature (1)..(180): Pfam Name: Aconitase Pfam Description: Aconitase family (aconitate hydratase)
  misc_feature: SWISSPROT Homolog: EC 4.2.1.3 Aconitate hydratase
  misc_feature (6)..(6): Xaa is any aa, unknown, or other
MNRWSXELLGRGVGGIEAEAAMLGQPMSMVLPGVVGFKLSGKLRNGVTATDLVLTVTQMLRKHGVVGKFVEFYGQGMSELSLADRATIANMSPEYGATMGFFPVDGKTLDYLKLTGRSDDTVAMVESYLRANKMFVDHSQAEAERVYSSYLELNLEEVEPCLSGPKRPHDRVTLKEYEV

SEQ ID NO: 84726 - DNA, 815 bp, Zea mays
  misc_feature: Ceres CLONE 1570878
  misc_feature: Encodes the peptide sequence at SEQ ID NO. 84727
ccgcggtggcggccgctctagaactagtggatcccccgggctgcaggaattcgtctcacccctagaaaaaacaatcactcaaccactgcctccagctccagcagcagctagctcagctcgatcgtcctcccgacccgatccatccaccccactccccgtgctccaccatctcggcatctcgctcgctcacttagctcgagctgcggcaaacagccggccggcagtccggcacacgggagatgatgaccgggaggctgaacgtggccacgtcgtcctcgccaggaggagacgacttcctgttcatgcccatgcagcagcatcagccgccgccgcctcctcctccgccctacgtcgggttcgagcacggccacggcgtggcgggaggcggcagccagcgcgttgccggaggggtgcagcaccacctctacgacggcctcgacttcgccgccgcggcgctgcagttccagcagcaggcggaggcgccgcacctgcaccagcagcagctgctcacgttgccgtccagtctcgggccccatggcgccgccgcctcccgcgccgccgccgctgcccatgcctatgcccgtgcccgggatgcccggcgaccacgtgtacccggcgctcgggatggtgaaacccgagggcggcggctcggacgggaagatcgggctcaaacctcggcggccgcaactactttctcccaggggaaaatgaagggccggggaacgcctccggaagcggtcccggcttcggcggaaggcggggggcccctttggggctcgggttttcggttttggttttggggcggcgcgccacca

SEQ ID NO: 84727 - protein, 192 aa, Zea mays
  misc_feature: Ceres CLONE 1570878
MMTGRLNVATSSSPGGDDFLFMPMQQHQPPPPPPPPYVGFEHGHGVAGGGSQRVAGGVQHHLYDGLDFAAAALQFQQQAEAPHLHQQQLLTLPSSLGPHGAAASRAAAAAHAYARARDARRPRVPGARDGETRGRRLGREDRAQTSAAATTFSQGKMKGRGTPPEAVPASAEGGGPLWGSGFRFWFWGGAPP

SEQ ID NO: 84728 - DNA, 1221 bp, Zea mays
  misc_feature: Ceres CLONE 1570879
ttttttaccggccttcatcatctacttcaaaatgttatttgcgtcctttttgtgagtattatttatatatgtgactccccgcggtggcggccgctctagactagtggatcccccgggctgcatgaattcgtctcacccctagaaaaaaccaagcaggcgccacccgttcggtccgtacaggaggggtccaccatgccgtgctcctcctcttcgtcgtccaaccccttccactccctcgcctccgccttccccttcctctcctccacatccacatccccacccccatttcccttccgcctcttcctcgcccgccgctccccacctcaccgttcccttcctccttcccctctcctcaggcttccaagtctcgccccctgggggcgctatctcttcccgggatctcatattgtcaggcaccggcccctaacctgcctgggtttattttgcaatcagttggtgggtgtccctttcccccccccccccaaagttctctcttgtttcgacacttttcggggaacgggttcttgtttcgtccccccatccgtgatatacttcctgttctgctgatcaccaactaggaccccccttctgtggttctattaacgaacttcttctctccgttcaatttaatccttcacatattttcccgataatttcggttttttttttggctatttcaatccacacacactttccctccacttcctacaacggttatcatccgtctctcacatcgtacctttgatcggtcttccctattgtttctcctctgttttgatccgctcctccttatcttttccatgttgatcttttccccctgttattgtcctgtggagtttgttttccactttcacatctgcgcttcattgatcccacgcacccgcttaccatgagcgtgtttgttatcggcaccttttgatatcctatgggtggttataccgcgttgttgacctgttatttagcggctcctgtccgctctgttcttctcactggccatttttgatacttttgccgttgatcccagctgactttaactcttcgcttagagcccattattgccctattatttacttttctataagttcttcgcgctcgaaattgtaccattccggttctataaccaactgatgaccgcgttctatttcattggagcaattaatctacttactactcgtatatctccgcgtgctccattctaccccggataagctatactctgca

SEQ ID NO: 84729 - DNA, 877 bp, Zea mays
  misc_feature: Ceres CLONE 1570881
  misc_feature: Encodes the peptide sequence at SEQ ID NO. 84730
cccgcggtggcggccgctctagaactagtggatcccccgggctgcaggaattcgtctcacccctagaaaaactctctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggttgggaagggatctgttcccgctgttaccggaggccttcaagggaatcaaacagatcggggtaatcgggctggggctcgcaaggtcctgcacaagctccgaacttgagagactcacttgttgaggcaaagtcagaaattgttggttaagattgggccccggaaaaggtcaaaatctttttgaaaagccccgagcggcaggattccccgaaaaagagtgggacgctgggggtaaatatggggaaaacggtatcaaacaaggggatcctggtttagcaactggatatcctgaattctgcccaaaggctaataacctaccaaaaaaaatttcctcgccacatggaaaaccaaacaaggtaatcccttgggtttggtcacaaggggaattttcctccttgggaaaaatttgccatatacccctgggggttttttgaattttcccctaaaaaacaaatcacttgggtgggtttgcctagtatataa

SEQ ID NO: 84730 - protein, 48 aa, Zea mays
  misc_feature: Ceres CLONE 1570881
  misc_feature: SWISSPROT Homolog: EC 1.1.1.86 Ketol-acid reductoisomerase
MPSLDFETSVFKKEKVSLAGHEEYIVRGWEGICSRCYRRPSRESNRSG

SEQ ID NO: 84731 - DNA, 828 bp, Zea mays
  misc_feature: Ceres CLONE 1570882
  misc_feature: Encodes the peptide sequence at SEQ ID NO. 84732
  misc_feature (828)..(828): n is a, c, t, g, unknown, or other
caccgcggtggcggccgctctagaactagtggatcccccgggctgcaggaattcgtctcacccctagaaaaattccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatgggagatgggttcaactacatcaaagaatccttttgaaaatggtactcttcacccttatggggttgttgagtggaaggtgggggtcccactcccgcccttggaccaacttccgggtaccttctgaaaaaggggcccgtttgagaaaaggaaccataaaaaaaattcgtggtggccccttccttttcccgaaaggggcggttgaaccttttttgaatagggaaacaagggggtttggtttttccctggggaaaaaccccctaaaaaaaaaaagggactccttttgggggaaagcctctcccaagggcaaaagggggtttttatgtttgtgcaccaaaaaattgtgggcn

SEQ ID NO: 84732 - protein, 225 aa, Zea mays
  misc_feature: Ceres CLONE 1570882
  misc_feature (15)..(191): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGRWVQLHQRILLKMVLFTLMGLLSGRWGSHSRPWTNFRVPSEKGARLRKGTIKKIRGGPFLFPKGAVEPFLNRETRGFGFSLGKNPLKKKRDSFWGKASPKGKRGFLCLCTKKLWA

SEQ ID NO: 84733 - DNA, 990 bp, Zea mays
  misc_feature: Ceres CLONE 1570885
  misc_feature: Encodes the peptide sequence at SEQ ID NO. 84734
  misc_feature (921)..(921): n is a, c, t, g, unknown, or other
  misc_feature (990)..(990): n is a, c, t, g, unknown, or other
ctccccgcggtggcggccgctctagaactagtggatcccccgggctgcaggaattcgtctcacccctagaaaaaactccaaaaaccctcgctctcctctcatggccgccgccgcagctgacgacgcagccgaggtggagcggctttacgagctcggcgagcgcctctcctccgccaatgacaagtccgagcatgcggcggactacgaggcgattattgcagcggtgaagggacagagtgccaaggcgaagcagctcgcagcgcagcttatccccaggttcttccggagcttccctgcactcggcacgcgcgccatgtcagccatgttcgatctcgtcgatatggaggagctcgcgatcagaatacaagctattcgtggctttccacttcttggcaaagatactgaatttgtgtcaaaaattgcagatgttttgggtcagctcccttcaagccaggaaaatggtgagcgtgatgctggtcataaagcgcccatgtcccttatacgggaagatgttaaaaattcattacaacctttatttaaccttggggagcaaggatccgaaattccgtgggaaaaattatttggtttccttccaaacaagggcctttcccccttaagggaaaacgggcggaaaacccccgggcgaaatggggggagagtttttaacgggttttttaataaaaaaaaaggtgggcaaaaggtacacgggttcaaaaattcaaaatttcttggggggggttttgcgaaaactggaaatattttggggagttcgcccccaagaagagccctttcaaaaaaattgtaaattttttccccccgggggagtgtaaattccaattaacagttttgtaaattggccccttgggggagggggttctcggcggtattgggcgccctccccctcccggggagggacccccnaggaagtccctctttattttgtaaaaattttccccctttggaaaatcccaaaaaaaaacagggtttcan

SEQ ID NO: 84734 - protein, 234 aa, Zea mays
  misc_feature: Ceres CLONE 1570885
MAAAAADDAAEVERLYELGERLSSANDKSEHAADYEAIIAAVKGQSAKAKQLAAQLIPRFFRSFPALGTRAMSAMFDLVDMEELAIRIQAIRGFPLLGKDTEFVSKIADVLGQLPSSQENGERDAGHKAPMSLIREDVKNSLQPLFNLGEQGSEIPWEKLFGFLPNKGLSPLRENGRKTPGRNGGRVFNGFFNKKKGGQKVHGFKNSKFLGGGFAKTGNILGSSPPRRALSKKL

SEQ ID NO: 84735 - DNA, 864 bp, Zea mays
  misc_feature: Ceres CLONE 1570886
  misc_feature: Encodes the peptide sequence at SEQ ID NO. 84736
ctccccgcggtggcggccgctctagaactagtggatcccccgggctgcaggaattcgtctcacccctagaaaaactagaaaaaggcagcgaggtttcctcccatcgatctgtacgccctccccaccggtgggtcgcgcacctccaccaacctaccttcccgccccgcccgtcgccgtcgacgactcgccgtccgtttccgccctccaaaaccctactacctcttaccttccagccccgcgtcctccatggccaccaacggcagctctccgagggttcgggacacggagagcagtctggagaaggtgaagcggcagctgtcatcggggtctgggaggtacctgctgcaagggcccctgctcaagcgatctgagacgttacggaaatggaatgagcgttgggtcatattggacccgacatcaggaaagatggaatacaaactccggagaaatgaaactgccattaaggggaccattctgtttgacgcctcgagcaccattactttatctcctgtgaactttcaagggatgccaaaaataatggctgctggctctgtatcctatttttccaaattttggttaaaaagattgtttcaaaaagaagtttctaaatagttatatttagaaggaaaccctggtttaagggtgggctggtccctttactggaattaaaaattggaacttcttcaaagaaagggatacctttttttggggggtaaaaccctgggggttgcaaaaacctggggttttcaaatttaaagggaaacccggtttgtttttccccacctcctaaaaaggggggagaaaattctttggggtggggaaaagggcctccccccctcctataggaacaaaatttttctctct

SEQ ID NO: 84736 - protein, 121 aa, Zea mays
  misc_feature: Ceres CLONE 1570886
  misc_feature: SWISSPROT Homolog: EC 3.6.5.5 Dynamin GTPase
MATNGSSPRVRDTESSLEKVKRQLSSGSGRYLLQGPLLKRSETLRKWNERWVILDPTSGKMEYKLRRNETAIKGTILFDASSTITLSPVNFQGMPKIMAAGSVSYFSKFWLKRLFQKEVSK

SEQ ID NO: 84737 - DNA, 924 bp, Zea mays
  misc_feature: Ceres CLONE 1570889
  misc_feature: Encodes the peptide sequence at SEQ ID NO. 84738
  misc_feature (384)..(384): n is a, c, t, g, unknown, or other
ccgcggtggcggccgctctagaactagtggatcccccgggctgcaggaattcgtctcacccctagaaaaaaaaccctacacccgcccgccggcgcactcggggaccgtcgaatcgagcaggttgacggaggagaggaagcctcgaagatgttccggaaccagtacgacaccgacgtgacgacatggagcccccaggggcggctgttccaggtggagtacgccatggaggccgtcaagcagggctcagcctgcgtcgggctccggtccagcacccacgccgtcctcgccgccgtcaacaagcccgcctccgagctctcctcctaccagcggaaggtgttccgcgtcgctgaccacgccgggggtcgcgctcgccggcctcaccgncgaagggccgcgttttctcgcggcttctccccaacgagtggattaacaactcctttcgtctacaaaggccccgcttccccgttttccaggcttggggcttaaacctccccaaaaagggcccgggttttgcccaccgcgggttatggaaaagagccctttgggggggtggcctcccatatttcctggaattgaacaaaatttgggggcctcctttgttttttaaaatcgcgcccccgggggaaaattcttttttttaaccaagggtttttcccccttggtgttttttttttccccaaacccccaaaaaatttttcttgggggagccaggtgttcccggggctccaaataataatccccccccggagagccttttttagggggggccccccctccccccccattaaagaaaacaccccgggggggagaaatttttccccccccccacactggggggggggcttttttgggggggagagagaggaggggacccccccccccccttttaaaatttttgggcccccaagaattaagaaatatttc

SEQ ID NO: 84738 - protein, 112 aa, Zea mays
  misc_feature: Ceres CLONE 1570889
  misc_feature: SWISSPROT Homolog: EC 3.4.25.1 Proteasome endopeptidase complex
MFRNQYDTDVTTWSPQGRLFQVEYAMEAVKQGSACVGLRSSTHAVLAAVNKPASELSSYQRKVFRVADHAGGRARRPHRRRAAFSRGFSPTSGLTTPFVYKGPASPFSRLGA

SEQ ID NO: 84739 - DNA, 928 bp, Zea mays
  misc_feature: Ceres CLONE 1570892
  misc_feature: Encodes the peptide sequence at SEQ ID NO. 84740
  misc_feature (475)..(475): n is a, c, t, g, unknown, or other
  misc_feature (575)..(575): n is a, c, t, g, unknown, or other
  misc_feature (631)..(631): n is a, c, t, g, unknown, or other
  misc_feature (680)..(680): n is a, c, t, g, unknown, or other
ctccccgcggtggcggccgctctagaactagtggatcccccgggctgcaggaattcgtctcacccctagaaaaactagaaaaagccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagtggttcaaggagtcagaggtgtaccactgccgctgggccatgcttgccgtccccggggatcctggtgccggaagctctgggcctgggcaanctgggtgaaaggcgcaagagtggggcgggccgtcccccggcggggcagggccacgtacctggggcgccccccggtgccgtgggggcacgctgccgaccantcctgggtgaatcgagtttcgtgggccatcggcctttcgccgagcacccagcgcanccatggggagaaaggacccccgaggaaagaagaagtaccccccggcggncgccttttcgacccgcttcgggcttctccaaggacccccggccaaggtttggaggagtacaagccttcagggagattcagaacggggcgcctcgccatggctggcctttcgtcgggcttctgcgtcaaggcagttcggcgttaccccggcaccggccccctgggagaactttgccttccaaccttggcgaaccgtgggaacaacacatcggggacatcatcatccccagaatcatctccccttgagtc

SEQ ID NO: 84740 - protein, 114 aa, Zea mays
  misc_feature: Ceres CLONE 1570892
  misc_feature (54)..(114): Pfam Name: Chloroa_b-bind Pfam Description: Chlorophyll A-B binding protein
  misc_feature: SWISSPROT Homolog: EC 1.6.5.3 NADH dehydrogenase (ubiquinone)
  misc_feature (113)..(113): Xaa is any aa, unknown, or other
MVMASSSGLRSCSAVGVPSLLAPSSRSGRLAPFCANATTSGRVTMSAEWMPGQPRPAHLDGSSPGDFGFDPLGLATVPENFEWFKESEVYHCRWAMLAVPGDPGAGSSGPGQXG

SEQ ID NO: 84741 - DNA, 800 bp, Zea mays
  misc_feature: Ceres CLONE 1570893
  misc_feature: Encodes the peptide sequence at SEQ ID NO. 84742
tctccgcggtggcggccgctctagaactagtggatcccccgggctgcaggaattcgtctcacccctagaaaaaagcggcagcagcaggagaagggaagactcaaacgagggatctccgagagaggagtgtggtaggcaggaagaaagaataaggcgagccgagagccattcgcatggaggcggcgatggatctgatgcggcggatgccgccacggagcgcggagacggcgctcaacgcgctgctctccctcctccccgaccactccctcgacctcctctcccaggtcgacctcccgctccaggtttgcatggataaggagagcctgaaggaatacattctatgcgaatataaccgtgatgctgactcctaccgatctccttggtcaaacaaatatgacccccctttggaagatgggacagttccttctcaagggatgaggaatcttgaggttgaggcaaacgaagttttctcagtgtatcgtgaccagtactatgaaggtggcatctcatctgtttacatttgggaggatgaagataatgggtttatcgcatgctttctaattaagaaagatggaccaggaaaaaagaggtacatgcagattggttcaggggatgccattcatgttgttccgggtgggccctggaaaaaaaggagcgaccctttactgcctgggacagccctgggattgctctcattggacaacaaaggattccggggataccgcatccgcccccaccttgaacccctatttcccgtgtggctttggcttggctttggccttggcttcccccggtggggg

SEQ ID NO: 84742 - protein, 209 aa, Zea mays
  misc_feature: Ceres CLONE 1570893
  misc_feature (1)..(206): Pfam Name: F_actin_cap_B Pfam Description: F-actin capping protein, beta subunit
MEAAMDLMRRMPPRSAETALNALLSLLPDHSLDLLSQVDLPLQVCMDKESLKEYILCEYNRDADSYRSPWSNKYDPPLEDGTVPSQGMRNLEVEANEVFSVYRDQYYEGGISSVYIWEDEDNGFIACFLIKKDGPGKKRYMQIGSGDAIHVVPGGPWKKRSDPLLPGTALGLLSLDNKGFRGYRIRPHLEPLFPVWLWLGFGLGFPRWG

SEQ ID NO: 84743 - DNA, 832 bp, Zea mays
  misc_feature: Ceres CLONE 1570895
  misc_feature: Encodes the peptide sequence at SEQ ID NO. 84744
  misc_feature (778)..(778): n is a, c, t, g, unknown, or other
  misc_feature (786)..(786): n is a, c, t, g, unknown, or other
  misc_feature (787)..(787): n is a, c, t, g, unknown, or other
  misc_feature (798)..(798): n is a, c, t, g, unknown, or other
  misc_feature (799)..(799): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
ggagctccccgcggtggcggccgctctagaactagtggatcccccgggctgcaggaattcgtctcacccctagaaaaaagccagaaaaaggcagcctcctcccccaacccaagtctctctctctctcccaaaccaaaagaaggcttccacttccagctgcagcggagcatcgccagttcagagttcaccaccacgcctttgacctccagcccatagcccaatcccgcaagcatccatccacgcccaccgcacccgctataaaatctccccctctgctcccgattcgccacctaaaggaggcgcctttccccaaatccaccaccaccgagaaacaaccgcaggaaatccgctcggccctcggctccggtcactctgttgcggccacgatgaaagagggcagacccggcgccggcgactacattgccagcctgctaagctcgtcgccgaggctcgacttcggcggggaggaggaggaggactgcctggacaggttctgcggcgacccggggttcgcggctcgcgcagcgcggctgtccagcttcagcgggcagcgcttcgccgtcaccgcgggcctcttcgggctgcccccgccgctgtccgccgcgagcggcggcggcggcgagttcgccgggtcccgggaggcatcgtcggtgtcggacccggcgtcggcgatgaaagacgccaatgccaagaaagcggaaggcgcctggggcggccggcaaggggcaaaggcagggagccatctgcgcaggcgcaggcaggggagccgaaaggtctngaccccannaggctcagggnnaannngagagggagagagggggttaaaagggga

SEQ ID NO: 84744 - protein, 148 aa, Zea mays
  misc_feature: Ceres CLONE 1570895
  misc_feature (131)..(131): Xaa is any aa, unknown, or other
  misc_feature (134)..(134): Xaa is any aa, unknown, or other
  misc_feature (138)..(138): Xaa is any aa, unknown, or other
  misc_feature (139)..(139): Xaa is any aa, unknown, or other
  misc_feature (140)..(140): Xaa is any aa, unknown, or other
MKEGRPGAGDYIASLLSSSPRLDFGGEEEEDCLDRFCGDPGFAARAARLSSFSGQRFAVTAGLFGLPPPLSAASGGGGEFAGSREASSVSDPASAMKDANAKKAEGAWGGRQGAKAGSHLRRRRQGSRKVXTPXGSGXXXEGERGLKG

SEQ ID NO: 84745 - DNA, 850 bp, Zea mays
  misc_feature: Ceres CLONE 1570898
  misc_feature: Encodes the peptide sequence at SEQ ID NO. 84746
ctccccgcggtggcggccgctctagaactagtggatcccccgggctgcaggaattcgtctcacccctagaaaaacttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaggccgtcaacgccaggctccggcggctcgagcacccagacccgcgcttcctccgctacgccagccccgtgccgtcccacgcggaccacatggccatccttgcggcgcccgagaccggggcaccacactgcccaacgggcctgggcatcgccacggagtcttccctcgccgcgcgcacggttacggtcgggcgtgtggatcgatgcgggcagcaggtaccagaaacgaggaaggggggcgggcgtccccccatttttgccaagcaactgctggtccagagggacgggggaaaacccaacggcccccccaccctgaggcctgggaaatcaaaggaaattggggggggcccccctcttatggcggtacacccgtccgcggggaaggaaaaacaaacctttcttaccgcccaagggggggcttgggacaagaggaagtgtggcccccccgggcggaattgagaggggccc

SEQ ID NO: 84746 - protein, 209 aa, Zea mays
  misc_feature: Ceres CLONE 1570898
MAFRRILSTAVRRRSAVAAAAAGNAREASTAVAAAPGVLAPDATAVRAPVMPYDRIAEAVNARLRRLEHPDPRFLRYASPVPSHADHMAILAAPETGAPHCPTGLGIATESSLAARTVTVGRVDRCGQQVPETRKGGGRPPIFAKQLLVQRDGGKPNGPPTLRPGKSKEIGGGPPLMAVHPSAGKEKQTFLTAQGGAWDKRKCGPPGRN

SEQ ID NO: 84747 - DNA, 771 bp, Zea mays
  misc_feature: Ceres CLONE 1570901
  misc_feature: Encodes the peptide sequence at SEQ ID NO. 84748
  misc_feature (691)..(691): n is a, c, t, g, unknown, or other
ccgcggtggcggccgctctagaactagtggatcccccgggctgcaggaattcgtctcacccctagaaaaaacctgcaagcagaggtgtgctctactgacagagtttgaactcaagaggaggcgaggcagaaccgcaatcgcgaccgcgacccgcaggtgacatacatacggtgcgagcgccggcagccggaagcaccggtgacgaagccttccgtgtcatcaggatcgcagggttttgtttcgtttcgcgggcgttgggaatccatccatggcgaggaagatgctcatcgacggggaggtggcggccgtcgcggatggtgggcactatgactacgatctcttcgtcatcggggcgggcagcggcggtgttcgcggctctcgcaccgccgcctccttcggagctaaggttgcgatttgtgagctcccattccaccccatcagctcagagtggctaggaggacatggtgggacttgcgtgatacgtggttgcgtacctaaaaagatactcgtgtatggtgcatcattccctggagaatttgaggattcgaagatttttgggtgggagataacggagatattaacttcattgggaaacgctattggaaaatagactaaagaaatggttagattaaatgggggggatcaaaagatccttaccggtgccggggtacaatgattgaaggggcgggcncccaatggaagccaaaccggtgaaatttaccaccccaagggttaaaacaaagggtacccggaaaccccttttttttcgcc

SEQ ID NO: 84748 - protein, 113 aa, Zea mays
  misc_feature: Ceres CLONE 1570901
  misc_feature: SWISSPROT Homolog: EC 1.8.1.7 Glutathione-disulfide reductase
MARKMLIDGEVAAVADGGHYDYDLFVIGAGSGGVRGSRTAASFGAKVAICELPFHPISSEWLGGHGGTCVIRGCVPKKILVYGASFPGEFEDSKIFGWEITEILTSLGNAIGK

SEQ ID NO: 84749 - DNA, 834 bp, Zea mays
  misc_feature: Ceres CLONE 1570905
  misc_feature: Encodes the peptide sequence at SEQ ID NO. 84750
ggagctccccgcggtggcggccgctctagaactagtggatcccccgggctgcaggaattcgtctcacccctagaaaaaatccccgcggcgctacctgcctacccagatcccgctcgccggtggtgccctcctcagtcctcactctcccgccgctggcgccgccagagcgagggggagtgcccataccctactaggacgagcagtaggaggcggaggggcgagatccggcggaggccgccccgatgggggacttcaacgtggcactggtgatcgtggcggcggtggtcagcgtgctggtgctgctcgtcagcgtctaccttctcgtcaactaccagcaccccgacgacgtcaaccaggcctacttccccaagctcgtcgccaaccgccaggcatgccgcaaggccgtctacaacggcgcctgcagcctcacgctccccatgaggacgctctggctcgtcgtttacatcgttgacgccgtcctcgtcttcctcgtcatccccttcgcaatgttctactacgagggcgaccaggacaagtccgtcgggaagaggctcaggaccgcgctcatctgggtcgtcgcgtccgcggtagtgtgcggcctcgtcctcggcatcctatacggacttgttggtaaagtggacttcactgtcaggcacctatcttcctcggtccagacatttccaaacacattttctggatttctcagtggccagccgtgcattagtcccattgactcgtcagtggtgcgcttctactgcaccgggctaactcgcaaacactttggacaatgcgtgctaccttccctggaatatgtggttgctcttactaacaatg

SEQ ID NO: 84750 - protein, 197 aa, Zea mays
  misc_feature: Ceres CLONE 1570905
MGDFNVALVIVAAVVSVLVLLVSVYLLVNYQHPDDVNQAYFPKLVANRQACRKAVYNGACSLTLPMRTLWLVVYIVDAVLVFLVIPFAMFYYEGDQDKSVGKRLRTALIWVVASAVVCGLVLGILYGLVGKVDFTVRHLSSSVQTFPNTFSGFLSGQPCISPIDSSVVRFYCTGLTRKHFGQCVLPSLEYVVALTNN

SEQ ID NO: 84751 - DNA, 808 bp, Zea mays
  misc_feature: Ceres CLONE 1570910
  misc_feature: Encodes the peptide sequence at SEQ ID NO. 84752
tccccgcggtggcggccgctctagaactagtggatcccccgggctgcaggaattcgtctcacccctagaaaaaccgcctaatcccgaacgagactagggaggttccagcgccgccggtgggggagatggcgctggagctgagcctggcctcggcttcgccgccggcgggcggcggcttggcgcagccgccgcccctcgccccacccgggaaggagcagcaagtggccggcgtggggattctactgcagatctccatgctcgtgctctcgttcgtcctcggccacgtcctgcgccgccaccgcttctactacctccccgaggccagcgcctcgcttctaattggcttagttgttggtggcctcgctaatatttcaaatacagagaccaacacaaggacgtggttcaacttccatgaagagttcttcttcttgttcttattacctccgataatattccagtcgggtttcagcttatctcccaaaccattctttgcaaactttggcgctatcgtaacttttgcaattcttgggacattcattgcttctgttgtaaacaagagtcctggtctatcttggtgggctgaaatttcctatggacaaacttcccctggggtgaatgcccttaggttgggggctcttaaaattgcaaactgaaccctggcccagggggtatacaatattccagaaaactgggtttcaaaaggttaacactttaaggcctttgggggcgttagaaaatactgcttttgtaaagaacgcgacagggcaaattttctccttttcatgggaaaaaatgttccaccagtctg

SEQ ID NO: 84752 - protein, 175 aa, Zea mays
  misc_feature: Ceres CLONE 1570910
MALELSLASASPPAGGGLAQPPPLAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASVVNKSPGLSWWAEISYGQTSPGVNALRLGALKIAN

SEQ ID NO: 84753 - DNA, 1134 bp, Zea mays
  misc_feature: Ceres CLONE 1570914
  misc_feature: Encodes the peptide sequence at SEQ ID NO. 84754
  misc_feature (24)..(24): n is a, c, t, g, unknown, or other
tgtgtgtggggggtggtgtgttanagtttttttttattatcaaaatattataccaaaagaagccaattgtgaaaagtcggaggtccccgcgggtgcggccgctctagaactagtggatcccccgggctgcaggaattcgtctcaccccctagaaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggggggcaactgaggagtcaaacgagagagatcgagagagaaagaaaggggagggcatcccccagccggcgggctataagaagggaagaaaaagaagcccagagaagaaggagtaggtgaagaataataatgatcattttgccttcctgcctttccgaaaaaaaaaaggaagggggcccacccaaaaatgaaaaaaccctttccaaaatattacccccccccccccccttaaatttctcctttcttaaaaatcaagaaagtcccccccacaaaactaattacaaacattctttcacccttacaaaaaggaaatttttccctcccaaagggggctatgtggaatacccccagcccgttagctgaaaaggagcgtctaagaaagaaaaaacgcagggattatacacccgcaaaaactgttccccacaacaaacaccgcaccagcggtggctagtgaggaatcacaaaggaaaaatacccaccagataaaacgttgcttctaccgaatatcctccttataccaataaaaatgtaccagcgtaacacaaaatatctcccccatgtggtgttacaaaatagtgggagggattcccctgccatgtgagtctgccaagaaatacaccctcataaaaatgatgtcaccccacggtaatagggtcaggaaacccagctgggtagccatcatgataaaattcacacgagaagaaaataggccatatatatatatccggatatacggtgaaaaaatatttacccccctcgcctacgatgattctgcacgcgccctcttaggaagaaaaaa

SEQ ID NO: 84754 - protein, 49 aa, Zea mays; identical to SEQ ID NO: 71211
  misc_feature: Ceres CLONE 1570914

SEQ ID NO: 84755 - DNA, 886 bp, Zea mays
  misc_feature: Ceres CLONE 1570916
  misc_feature: Encodes the peptide sequence at SEQ ID NO. 84756
  misc_feature (572)..(572): n is a, c, t, g, unknown, or other
aaagctggagctccccgcggtggcggccgctctagaactagtggatcccccgggctgcaggaattcgtctcacccctagaaaaaacccgtctccggtctccgccttcccccacctattggggagcgctcctgattcgcgggagccagcgggcgagacaaagagaatcccccgctcctgcgccgccgcggatcagcgccgtcgccgatcggaggctctcgcttcccccggcgggcggcgcgcgccgggagatggacggcggcgcgggcgcgggcgccggccggaggaacgtctcatcgtcctccggatccaggaggagggtcctgcccgccgagaacgggcacgggcatgacgccccgccgccctccaggcggtcctccgtctccctcgtccgcggccactccacgtcactgaccggcgagaggaccgtcgaaaggctgaggctgtcccaggcgctgacgataccggatcacacaaccgtgcacgaagcttgttcgaagatggcgtcacgcaaggttgacgccgtgctgcttactgactacaacgctttggctctgtgggatcctccacgacnaggacattaaccccaaggtgaatggcccgtgaatttgagatgggaaaaaaaccgggtcttccaaggtattgaccccaaaacacctggtttttggtttttccggggaaacccttttggcactccaaggccgtgttcaaaaaaaggggcaagggggaatttcagggcctttccccctttcccgggaaaaaaaggggaggggtgcctttggaaatttttgggagaaaacaccaaaggggccccttatgagaagcgcccttttgccgccgaaaatgggaaaaaggcccccgcgcgaaaaaaaagagagatacactctt

SEQ ID NO: 84756 - protein, 110 aa, Zea mays
  misc_feature: Ceres CLONE 1570916
  misc_feature (108)..(108): Xaa is any aa, unknown, or other
MDGGAGAGAGRRNVSSSSGSRRRVLPAENGHGHDAPPPSRRSSVSLVRGHSTSLTGERTVERLRLSQALTIPDHTTVHEACSKMASRKVDAVLLTDYNALALWDPPRXGH

SEQ ID NO: 84757 - DNA, 784 bp, Zea mays
  misc_feature: Ceres CLONE 1570919
  misc_feature (627)..(627): n is a, c, t, g, unknown, or other
  misc_feature (648)..(648): n is a, c, t, g, unknown, or other
ctcaccgcggtggcggccgctctagaactagtggatcccccgggctgcaggaattcgtctcacccctagaaaaagctcaacactcggagtgtgtcctctcgcctcctcccctctccgccagcggctgccaccagcccaccaccgcccctcctcaaaacgccaaaaatttccccacctctagacgccctttcccctccccccgagatcccatccatggccacctcccgcccccggatctggcgctgagcccgccattgccggatccctgccaggcctccaccccgccgtcgcgctcccggcccggttctattgggcgcggcgtggcattccctctcttctttgtgcgctcaccgggggggtggttgatctgtactggcggatgcagcgcgccttgcgatctctagctgttgctgcgggaggaccggccgcctcgtcgccgtttgcaagcgcgctcttttaaagcccgagaatcgccccctccgcgtgttcgtgtcgccgagaggaggtcggaactgtcggaatggtcgtctaatggggagatttgatgtggtattggggccgcggatctcgccgacatggggaaacaatttatcggaaagctatcgggggaagtcaaatgaaatccanctcctggaaccgggggggccnccccccggggccacttattcgtcgcccccgggaataaatggagccccccccggcgggaaaaaagggggccccccgggggaaaaccctaaacgtcttcgcccctcgggccctccccccgggggttggggccccggaa

SEQ ID NO: 84758 - DNA, 809 bp, Zea mays
  misc_feature: Ceres CLONE 1570920
  misc_feature: Encodes the peptide sequence at SEQ ID NO. 84759
ctccccgcggtggcggccgctctagaactagtggatcccccgggctgcaggaattcgtctcacccctagaaaaaacggagagtcctggtggccgtgcgggcactgtgcgcccgtggaggtgtcgtgtctcggtgcccacacgacaacgacgctcctctgcacccccgtctctacaagtaccacctggctgactccagtttcccgacgccattccacgtatctcttgtttaggccgggctcgagagagttgggctccgaatcctgggtgggtttggagttggagaatcgccttcgtcgctcgacccagaaagattcgatggagagccacaacccatcgcactctcagatcgccgaagtgacgatggacatcgcagcgtcagcttctggagcggcagggagcaagttctgcaagggcgcagcctgcgacttctccgacgccagcaactcctcgaaggacgccagggagaggtcggcgtcgatgaggaagctgatagtcgcggtggtcctctgcgtcgtattcatggcggtggaggtggtggggggcatcaaggcgaacagcctggccatcctgaccgacgcggcgcacctcctgtcggacgtggcggcgttcgccatctcgctgttctcgctctgggccgccgggtgggaggcgacgccgcggcagtcgtacgggttcttccgggtggagatcctcggcgccctcgtctccatccagctcatctggctgctcgccggcatactggtgtacgaggccgtcgtgaggctcgtcggcgagagcggcgacgtgcgggggtcgctcatgttcgccg

SEQ ID NO: 84759 - protein, 164 aa, Zea mays
  misc_feature: Ceres CLONE 1570920
MESHNPSHSQIAEVTMDIAASASGAAGSKFCKGAACDFSDASNSSKDARERSASMRKLIVAVVLCVVFMAVEVVGGIKANSLAILTDAAHLLSDVAAFAISLFSLWAAGWEATPRQSYGFFRVEILGALVSIQLIWLLAGILVYEAVVRLVGESGDVRGSLMFA

SEQ ID NO: 84760 - DNA, 872 bp, Zea mays
  misc_feature: Ceres CLONE 1570922
  misc_feature: Encodes the peptide sequence at SEQ ID NO. 84761
  misc_feature (485)..(485): n is a, c, t, g, unknown, or other
ctccccgcggtggcggccgctctagaactagtggatcccccgggctgcaggaattcgtctcacccctagaaaaaacgcgctgctggtagcccgcagctacctgcctcccttcttgcacccaccgctgccgtcctgcccagatcccgctcgccggtggtgctcccctccccccgcgccgctggcgccgccggagcgagggggactgcccaaaccctagtgggagttggagactaggaggaagggcgcgagatccggcggcggccaccccgatgggggacttcaacgtcgcgctggtgatcgtggcggcggtggtcagcgtgctggtgctgctcgtcagcgtctacctgctcgtcaactaccagcaccccgacgacgtcaaccaggcctacttcccccagctcgtcgtcgtgctcggcctcaccgtcgccgtcctctcaatcctcatgctccctgccgacgtcgccaatcgccaggcctgccgcaangccgtctacaacgggcgcctgcagtctcacgctcccccatgagacgctctgggctcggcgtctacatcgaaaacgccggccttcgtcttcctcggcatcccccttcggcagggttctacttacaggggcgaaccagaacaattccctcgcggaaagaggctaaggactccccccatttggggcccccccccccccggggggggggggccccctcccccgggtttttttaaaggatttttttgggaaaaggggacttccccgtgggggggccctttttttcttggggccaaaaatttttcaaaactctttttttggggaattccacagggggccccccccttttttttaaccctttgaccccccccggggggggggggccttctctcc

SEQ ID NO: 84761 - protein, 85 aa, Zea mays
  misc_feature: Ceres CLONE 1570922
  misc_feature (72)..(72): Xaa is any aa, unknown, or other
MGDFNVALVIVAAVVSVLVLLVSVYLLVNYQHPDDVNQAYFPQLVVVLGLTVAVLSILMLPADVANRQACRXAVYNGRLQSHAPP

SEQ ID NO: 84762 - DNA, 831 bp, Zea mays
  misc_feature: Ceres CLONE 1570923
  misc_feature: Encodes the peptide sequence at SEQ ID NO. 84763
  misc_feature (323)..(323): n is a, c, t, g, unknown, or other
  misc_feature (345)..(345): n is a, c, t, g, unknown, or other
  misc_feature (354)..(354): n is a, c, t, g, unknown, or other
  misc_feature (444)..(444): n is a, c, t, g, unknown, or other
cccgcggtggcggccgctctgaatagtggatcccccgggctgcaggaattcgtctcacccctagaaaaaacacgcctcttctccccccaaaaaaatccagcagcagcagcaagccccacgcaactattagcagcagggagaccaccccaatcccccacggacattcgccgcgaacccttatctgcacgccgcgccatggccgccgccgccgccgccgcggtcgcccacctctccatccacggccgcctacgccgctcaccggagcatcggccgtccatcaccaccaccaccacctcctcctcttccccgtccgctcaccgccngtccctgctgcggtgccgcgcngttcagcanggagccagcgacggcgacccggctgatggcgacgcgcgcaaacccaagaaaggccccgctgtacaagctcaaggcggcgattccaaggcntcccggggatcccgttcccccccccgcccaggggtcccgggggaaaattacaattaccacccccccgtccaaaaagggggaaagaaaaattccttctcggtggctaccccacctagggcgaaatggttttcccctttaaaagaccccgggggtttgaacctgggggggttggaacccccgcgttcggggggggaaaaccccaattaaaaaaaaaaaaaattgtgtaaaaccgggggcggggggggggggggataatccgcgcccacaaaaaagggggggaacaaagggccccctaaagaaaaaacgccgaaaaaggtgggcgcccccccaagtgggcgccttatatgggggggacacccacagggggggggtgaaaaaaaacccctc

SEQ ID NO: 84763 - protein, 151 aa, Zea mays
  misc_feature: Ceres CLONE 1570923
  misc_feature (43)..(43): Xaa is any aa, unknown, or other
  misc_feature (53)..(53): Xaa is any aa, unknown, or other
MAAAAAAAVAHLSIHGRLRRSPEHRPSITTTTTSSSSPSAHRXSLLRCRAVQXGASDGDPADGDARKPKKGPAVQAQGGDSKASRGSRSPPRPGVPGENYNYHPPVQKGGKKNSFSVATPPRAKWFSPLKDPGGLNLGGLEPPRSGGENPN

SEQ ID NO: 84764 - DNA, 801 bp, Zea mays
  misc_feature: Ceres CLONE 1570924
  misc_feature: Encodes the peptide sequence at SEQ ID NO. 84765
ccgcggtggcggccgctctagaactagtggatcccccgggctgcaggaattcgtctcacccctagaaaaagcgcaccgtgcctcactgccggcctctgctcctcttccgccgccgcatgatctgcgtatgcgcctgagaccatgtacagcaccgccaggagccacctccgctccctcaagaatgatagtgcttctaggcttgccagtactactgtcgcgaagcagacctcaagtggtctgtgcacctggcttctgagtggataatctagcaaactctctccccttgatataccagtcgcagggattagcattccctcacctctaccagatgttgcacaggcatctaagacaaaactcactactgcttcaaatcgcgtcgaaatcgcctctgatacatcatcgcagcccaggagcatctgtgggtctgtacatagactgtgcttccatctacgatacacctgcttcatctgcagtatcacatctggtcgagagaatggcccttcacagcacacgggggcggactcacttacgggtagttcgtgacgtaggaaccgatggaggaaatccttctgcataacctttccggcaaacaattagctttccctatgatgccttggagaacgggtaccccccaaaggggtggaaggtcccctgacccgggggaggaatcccccctttccaccaattgggcagggcaaaagagggcctccccaaacaataaaaggtagaaataccttaatgccggctttccaaacccccgaaagagtttaatttttgggggggcccttttattcggggggg

SEQ ID NO: 84765 - protein, 82 aa, Zea mays
  misc_feature: Ceres CLONE 1570924
  misc_feature: SWISSPROT Homolog: EC 3.4.24.64 Mitochondrial processing peptidase
MLHRHLRQNSLLLQIASKSPLIHHRSPGASVGLYIDCASIYDTPASSAVSHLVERMALHSTRGRTHLRVVRDVGTDGGNPSA

SEQ ID NO: 84766 - DNA, 904 bp, Zea mays
  misc_feature: Ceres CLONE 1570926
  misc_feature: Encodes the peptide sequence at SEQ ID NO. 84767
  misc_feature (852)..(852): n is a, c, t, g, unknown, or other
  misc_feature (895)..(895): n is a, c, t, g, unknown, or other
ctccccgcggtggcggccgctctagaactagtggatcccccgggctgcaggaattcgtctcacccctagaaaaagtagtcgtagtctcgcacccaccactccatcgtctccatccacgcgcccgcgcgcggcccggcaacgggagccaaggaaaccgaagccccgatggcgagcttcttccgggacgcgcgcctcccgcagcagcgcgtcgtcgagggcgtcccgttcccggcggtgctggtcccgagcgcccccgcgggcggcgggctcgacgagttcctggcggccgtgcgctccgagagggcgtcccggctggagccgctggtgcgggacgcgggggccctgctgctgcgcgggttccccgcgacgacagccgcggacttcgaccgcgccgtcgacgccttcgggtacgaggagctgccgtacgtcggcggcgccgcgccgcggaccaacgtcgtgggccgggtgttcaccgccaacgagtcgccgcccgatcagaagatccccttccaccacgagatggcccaggttccaacgtttccgtccaaactgttcttcttctgtgaagtggagccaaagagtggcggggagacaccgatcgtactgagccattacatctacaagaggatgaaggaagaatttcctgaattcgtggagaaactggagaaggaagggctggtatatacaaaggttctgggagagggcgacgacccgtcttcgccaatcggccgtggatggcaatcgacatttctcactagagataaagccgttgctgacgaaaaggccgccaagctcgggatgaagctggaatggaccggcgacggcgtgacgacggtcatggtggccatcccngcgatgaaatgggagagagccgggggcggtatgtctagctcancgcatggtg

SEQ ID NO: 84767 - protein, 246 aa, Zea mays
  misc_feature: Ceres CLONE 1570926
  misc_feature (244)..(244): Xaa is any aa, unknown, or other
MASFFRDARLPQQRVVEGVPFPAVLVPSAPAGGGLDEFLAAVRSERASRLEPLVRDAGALLLRGFPATTAADFDRAVDAFGYEELPYVGGAAPRTNVVGRVFTANESPPDQKIPFHHEMAQVPTFPSKLFFFCEVEPKSGGETPIVLSHYIYKRMKEEFPEFVEKLEKEGLVYTKVLGEGDDPSSPIGRGWQSTFLTRDKAVADEKAAKLGMKLEWTGDGVTTVMVAIPAMKWERAGGGMSSSXHG

SEQ ID NO: 84768 - DNA, 883 bp, Zea mays
  misc_feature: Ceres CLONE 1570927
  misc_feature: Encodes the peptide sequence at SEQ ID NO. 84769
  misc_feature (324)..(324): n is a, c, t, g, unknown, or other
  misc_feature (366)..(366): n is a, c, t, g, unknown, or other
  misc_feature (374)..(374): n is a, c, t, g, unknown, or other
tggagctccccgcggtggcggccgctctagaactagtggatcccccgggctgcaggaattcgtctcacccctagaaaaaaggcgctctcggctctcctcgtggacaaaaccaccggctcccgatatccaaattggaacaggggattctgaacttggggtttgttccggggaccgattctggcatcggcagacgggatgtcagcccccctcgaccgacttgctaggccatgttttgaagggtttgtacataacgatgaaaggaaagagagcagatctgatgcagacaactcagaaggagataagaagactaagatcggatctttncagaaaaaagcaattaacgcgggggaacaaattcaggcattnccctgagnaggagaagcaaaaaagaagacccgaaaggggggatttccccatcaggatataagggaccattaaaggactttcaagaatgttgaagaacttttccaacaaggccttaatttaacaaggaaatttgctgcccccccccccctgggccaattttcccccgggggttaaggggttcccaaaaaccccggaaaattttttttttttgaaaaaaaaccaaaaaatttttggggcccaaccaccttttttaaagggggggaaggagaatttcggggtgttgccaaaaaaagagggggttttttttttcccccccccgttttttttagaatttttaaaaaaatttttcccccccctctttttttttgggggggggggaaaaaaaagggggggggaccaccccctccccccccaaaaatttataggggggggggggtgttttcggcaaccaacccctttttaaagggagggccccacccccctgtgggggggggggggggaaaaacacccccgccgg

SEQ ID NO: 84769 - protein, 58 aa, Zea mays
  misc_feature: Ceres CLONE 1570927
  misc_feature (43)..(43): Xaa is any aa, unknown, or other
  misc_feature (57)..(57): Xaa is any aa, unknown, or other
MSAPLDRLARPCFEGFVHNDERKESRSDADNSEGDKKTKIGSXQKKAINAGEQIQAXP

SEQ ID NO: 84770 - DNA, 788 bp, Zea mays
  misc_feature: Ceres CLONE 1570930
  misc_feature: Translation starting site: 245
  misc_feature: Pfam Name: Anth_synt_I_N Pfam Description: Anthranilate synthase component I, N terminal region
  misc_feature: SWISSPROT Homolog: EC 4.1.3.27 Anthranilate synthase
  misc_feature (473)..(473): n is a, c, t, g, unknown, or other
ctccccgcggtggcggccgctctagaactagtggatcccccgggctgcaggaattcgtctcacccctagaaaaaaggacccgaatgccccactcttattacctgctaattttgaatttcctaatcgggttgcagctgcttatataagctcactaaccccgcattcgcttttccgactcccacctccagccaaatcgggctatagatcaaacgctgcactgtagggagcgtgaagccagcggcgaatggaatccctagccgccacctccgtgttcgcgccctcccgcgtcgccgtcccggcggcgcgggccctggttagggcggggacggtggtaccaaccaggcggacgagcagccggagcggaaccagcggggtgaaatgctctgctgccgtgacgccgcaggcgagcccagtgattagcaggagcgctgcggcggcgaaagcggcggaggaggacaagaagcggttcttcnaggcggcggcgcgggggagcgggaaagggaacctggtgccatgtggggagtgcatcgtgtcggaaccatctcacccccgtgctcgcctaccgctgcctcgtccccgagggacacgtcgacgcccccagcttcctcctcgagtccgtcgagcaggggcccaagggcacaccaacgtcgggcgctacagcatggggggagcccaaccagtgattgaagatgtggccaaaaaccacaaggtaccatcctggacacaagaagaccaagtgaccgaccaagtattggacgaccccatgcagatcccgaagaacatgaatg

SEQ ID NO: 84771 - DNA, 722 bp, Zea mays
  misc_feature: Ceres CLONE 1570932
  misc_feature: Translation starting site: 217
  misc_feature (366)..(366): n is a, c, t, g, unknown, or other
  misc_feature (370)..(370): n is a, c, t, g, unknown, or other
  misc_feature (374)..(374): n is a, c, t, g, unknown, or other
  misc_feature (390)..(390): n is a, c, t, g, unknown, or other
  misc_feature (398)..(398): n is a, c, t, g, unknown, or other
ctggagctccccgcggtggcggccgctctagaactagtggatcccccgggctgcaggaattcgtctcacccctagaaaaacccgcagcccgccccgtccgcccgcccgagtcacactcacacagagccgagccgagcccaggcaggcaggcaggcggcccaggcgcccagcccacccccctacccccgcggcgccgccggagccagagcgagagcgatggacgcgctgccggaggcgtggtcgcaggtgcgcgcgccggtgatcgtgccgctgctgcggctggcggtggccgtgtgcctcaccatgtcggtgcttctgttccttgagcgcgtgtacatgggccgtcgtcatctccggggatgcgcntggntcgnctccgcccccgaacgncgctaccngctgcgaaccccctcccccccaagggaagaacccgggaaactggggttcttccgggttccccggtcggggtcctgccaaatccccaggtttaaaaagcccaagggggaaccggtttccattggggcccgtgtggggggttttctggccccggggaacccctttggggggaaagggtttcccaaaatcctcccggaccaaaagattaaaagagaaaatgggccaaaaagagtgcccccccggggggggcctcccaaggggggaaaaaaaaaaattcccccccaaaccctggggggagaccccccccggggggtataacaaggccc

SEQ ID NO: 84772 - DNA, 800 bp, Zea mays
  misc_feature: Ceres CLONE 1570935
  misc_feature: Encodes the peptide sequence at SEQ ID NO. 84773
  misc_feature (390)..(390): n is a, c, t, g, unknown, or other
gcggtggcggccgctctagaactagtggatcccccgggctgcaggaattcgtctcacccctagaaaaacccacgccacacaccaccaccggacgctagctcaccaccaacctcagcacatcgaggagaagaggagtggccatggcttcgtcggtggccaccgcggcgagcacattcctgggcacccgcctggcggacccggcgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcnagaagcccgtggagtacctgcagttcgaactggactcgctggaccagaacctggccaagaacgaggccggcggcatcatcggcacccggttcgagtcctccgacgtcaagtccaccccgctccagccctacagcgaggtgttcggcctccagcggttccgcgagtgcgagctcatccccggccgatgggccatgctcgccaccctcggggccctcaccgtcgagtggctcccccggcgtccccctggcaaggatgcctggcaaggtgggaccctggggggatggggtccccccctacctggggccaagccggcttgcccgtttcaccatttctcggaaccccttcattctgggatacccaaaaggggcctttggtgagaatccggggctttaaaatatcggagggttccc

SEQ ID NO: 84773 - protein, 208 aa, Zea mays
  misc_feature: Ceres CLONE 1570935
  misc_feature (63)..(194): Pfam Name: Chloroa_b-bind Pfam Description: Chlorophyll A-B binding protein
  misc_feature (84)..(84): Xaa is any aa, unknown, or other
MASSVATAASTFLGTRLADPAPQNGRIVARFGFGGGKPKAAVPKKVAKTSISSDRPLWFPGAVAPDYLDGSLVGDYGFDPFGLXKPVEYLQFELDSLDQNLAKNEAGGIIGTRFESSDVKSTPLQPYSEVFGLQRFRECELIPGRWAMLATLGALTVEWLPRRPPGKDAWQGGTLGGWGPPLPGAKPACPFHHFSEPLHSGIPKRGLW

SEQ ID NO: 84774 - DNA, 861 bp, Zea mays
  misc_feature: Ceres CLONE 1570938
  misc_feature: Translation starting site: 361
  misc_feature (657)..(657): n is a, c, t, g, unknown, or other
  misc_feature (750)..(750): n is a, c, t, g, unknown, or other
ctccccgcggtggcggccgctctagaactagtggatcccccgggctgcaggaattcgtctcacccctagaaaaagcgcgcggcccggacctggctacgaagcgcaggcagtacagacagcaccgcctggtttgagcggctgccgccgctgcatatactccctccctgccttccagtgccaggggtgaccggcgtgcgtgccattccacgctctcgcggctcgtgtgccagcggtgaccagcgctcgtgctcgtccagtccaccaggcgctgctgttccggcaagccagccagcagcagcagccgccgccgccgtctcggagctcgagctcctagtcccccggggcccaggcggcggcgccatggaccagctccggcccgagccggccgcgggcgcgcggcacgagatcgagaagacggcggcgccggacgtggagtcggagcccgcggcggcggagccggagccggagcgcgtgccgccgtggcgcgagcaggtcaccgcgcgcgggatggtggcggcgctgctcatcggcttcgtctacaccgtgatcgtcatgaagctgagccctcacacggggctcaccccaccatgaacgtctccggcgcgctgctcgccttcctgggcgctcgccgctggacgcgcgcccttcgccgcctangcattgcctgccgccccttcacccggcaggagaacaccgtcctgcagacctgcgtcgtcccctgctacaacatagggttcggcggtgggttcnggttcgttcctgctgggccctgaacagaagagtacgacttctccggggtgagccgccgggcaacctgccggggagctacaggagcctgccatcggctggaatgacggatcc

SEQ ID NO: 84775 - DNA, 983 bp, Zea mays
  misc_feature: Ceres CLONE 1570942
acccgcggtggcggccgctctagaactagtggatcccccgggctgcaggaattcgtctcacccctagaaaaagtcaatattcctgtactaccccttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaagggtacctgtacccgataccgacacaggtgggtaggtagagaatacctaggggcgcgagacaactctctctaaggaactcggcaaaatagccccgttacttcgggagaaggggtgcccacctttttcccttctcacctcccgcaagcaaaattacgggtcacgggaccggccccccgtacccatttgccttttagctttctttcctccccgcttttcttgggaaggaaaaggttgaagggcatttatgccccctttggcccatccctgtttgaattccatgccatcccttgaaaccctttttaaaattcgtggccccatacccgggggcaactcccggatattttttatttttctttacccccccgttgtgcccctggggttatacctcccccctcccggggtttcgggtttgtggtttttgcccaaatataaccggtggggaaaaatttttgtttgtgttttaaagggccctctttttgcttcccctttaaggtgcccccccccatttttccttcgttttttcccccaccaaaaaaagctctcggctttttcttttgaagaaatttttctccccaccattgtggttttttgggggaatagtcaccactactttttcctccc

SEQ ID NO: 84776 - DNA, 833 bp, Zea mays
  misc_feature: Ceres CLONE 1570944
  misc_feature: Encodes the peptide sequence at SEQ ID NO. 84777
ctggagctccccgcggtggcggccgctctagaactagtggatcccccgggctgcaggaattcgtctcacccctagaaaaaccaacacaagccgccgtcatgtcgaagcgaggtaggggaggttcggctgggaacaagttccgcatgtcactgggtctaccggtggcggccacggtgaactgcgcggacaacacgggcgcgaagaacctctacatcatctccgtcaagggaatcaagggccgcctcaaccgcctcccgtccgcctgcgtcggcgacatggtcatggccaccgtcaagaagggaaagcccgacctcaggaagaaagtgatgcctgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgctagtgcagcaaatgccatcgtttgagagcttgttggaatgtgtttagacttgagtatgatcatctcaattgtgtgttgcagctgctgtaagggtgctattggacttgatggctccttttatgtttggtcactcaattttgtagtgaacagaaatttgtctaccctggttgcctcaagtttgctgtctgagatggttatactacttattctagtcaaaaaaaaagaaaaaaaaaaatccaccttacatctctacagcctccgattgagtgactcaccttctttcccagccagcactagctttgcagcaagcgagctcctgagatttcagctcgccgcc

SEQ ID NO: 84777 - protein, 140 aa, Zea mays; identical to SEQ ID NO: 84187
  misc_feature: Ceres CLONE 1570944
  misc_feature (19)..(140): Pfam Name: Ribosomal_L14 Pfam Description: Ribosomal protein L14p/L23e

SEQ ID NO: 84778 - DNA, 952 bp, Zea mays
  misc_feature: Ceres CLONE 1570946
  misc_feature: Encodes the peptide sequence at SEQ ID NO. 84779
  misc_feature (25)..(25): n is a, c, t, g, unknown, or other
  misc_feature (33)..(33): n is a, c, t, g, unknown, or other
aaaaaaaaagaataggggagatttngaggggcnaaggaaattaaacagatttaggggcttggggggggtcgggcaaactggagctcaccgcggtggcggccgccctccaacagaggatcccccgggctgctttcctccaacgagccctagaaaaaaccaccacactgtgcagcagcctcctttcgtctcgtagttggctggggttgccaacgcgacacctcgtcggaatccggtcgcgcgacctccccttctcgccggccggagcgggtgcgccatcaccatggacccggaagcggtacggaaaagcctggagcccaccgcaactgtcgaaaaaatcaccggctccacccctgcgcggctccacttctacgaccccttcgtcctcagcggagtcagcatcgaagccgccgagcacggtcgcctcctctgctcctttgtcgtcacccctcgccttgcgagtcccgcggggtacctccgcagcggtgtcacagcgacgctcgccgaccagctgggatcggccgtgtttttctgcagcgggctccccagcagcggggtatccctcgaaatcagcgtctcctttgtggacgcggctgccgtcgggggaggaaaaagagggcgaagggaaaaactggtgcgggcccggcaaagtcagtccgggggccgttctccggccaaatttcagggaaagaaaaaagaaagggaaaaactggaagggcggcaaggccccgtcaacacccaaagaatcctgggggggaatcaaaaacaggaagtggggaaggctggcccccccttcctgggtgaaacaaggaaaggggcaaaacagaaattggccgccccggaaacgggggccaaagtaccggggagggccactttatttaaaaagaggcaaggcaaaccgaaataccaacggcccgggggagaggaaaaaaaccgctatcaagggggaaaaaat

SEQ ID NO: 84779 - protein, 224 aa, Zea mays
  misc_feature: Ceres CLONE 1570946
MDPEAVRKSLEPTATVEKITGSTPARLHFYDPFVLSGVSIEAAEHGRLLCSFVVTPRLASPAGYLRSGVTATLADQLGSAVFFCSGLPSSGVSLEISVSFVDAAAVGGGKRGRREKLVRARQSQSGGRSPAKFQGKKKEREKLEGRQGPVNTQRILGGNQKQEVGKAGPPFLGETRKGAKQKLAAPETGAKVPGRATLFKKRQGKPKYQRPGGEEKNRYQGGKN

SEQ ID NO: 84780 - DNA, 861 bp, Zea mays
  misc_feature: Ceres CLONE 1570947
  misc_feature: Encodes the peptide sequence at SEQ ID NO. 84781
  misc_feature (638)..(638): n is a, c, t, g, unknown, or other
  misc_feature (653)..(653): n is a, c, t, g, unknown, or other
  misc_feature (655)..(655): n is a, c, t, g, unknown, or other
  misc_feature (663)..(663): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (688)..(688): n is a, c, t, g, unknown, or other
  misc_feature (689)..(689): n is a, c, t, g, unknown, or other
  misc_feature (693)..(693): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
ggagctccccgcggtggcggccgctctagaactagtggatcccccgggctgcaggaattcgtctcacccctagaaaaaaaaatcactcccaccgtctccacagcaaccagcacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtgcctggcgttcccaccccctgccacctcgcccgctcccggctcctcccccctcggccgtcctgctctggtcgcggcggagccgccagatctgggccacgggtgccagcccagccggcgggcggcgggacggagggctgcgggatgaagtcgtcgctgaggagccggcaggagccgcggcgggtcagcaacggcgtcatcatcggcgccatgctgctatccctctgcgtcctcagcatcgtcaaggccagatactgcgccacccccttcggcaaggccgaggaccagctcccagagcagatgaactccagcatccggatggagcccggangagtcgtcgctgcangnaccccccnggaaaggaannnaggagagaccacnngaanaatggggcgacagcgcacgcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 84781 - protein, 189 aa, Zea mays
  misc_feature: Ceres CLONE 1570947
  misc_feature (163)..(163): Xaa is any aa, unknown, or other
  misc_feature (168)..(168): Xaa is any aa, unknown, or other
  misc_feature (171)..(171): Xaa is any aa, unknown, or other
  misc_feature (174)..(174): Xaa is any aa, unknown, or other
  misc_feature (175)..(175): Xaa is any aa, unknown, or other
  misc_feature (180)..(180): Xaa is any aa, unknown, or other
  misc_feature (181)..(181): Xaa is any aa, unknown, or other
MGGGMEVHKNRWIEEWNAGRENLEFNFRWTRRSLAVVGLFGLAVPILVYKGIVPGVPTPCHLARSRLLPPRPSCSGRGGAARSGPRVPAQPAGGGTEGCGMKSSLRSRQEPRRVSNGVIIGAMLLSLCVLSIVKARYCATPFGKAEDQLPEQMNSSIRMEPGXVVAAXTPXERXXGETTXXMGRQRTPR

SEQ ID NO: 84782 - DNA, 942 bp, Zea mays
  misc_feature: Ceres CLONE 1570949
  misc_feature: Encodes the peptide sequence at SEQ ID NO. 84783
ctccccgcggtggcggccgctctagaactagtggatcccccgggctgcaggaattcgtctcacccctagaaaaactcttccggcataacaatatgcaccgaatattcagctcatccgctctcctataaaaacgaagcgcaaatccaaaaaaaaaaacccgcccgcacgacgcattgtccgttccgtttggacccatgatatatctcgctgggatcttgaccgtgcgcgagacgaatctcctcgtgcggtaaccgataccccccaagtcaaaaatcagcccataaaatttttatgggcggaggatcacccgtcgccgcagttcaggacgcgagcgacgacggcgccagggtcgtggtgctagtcgcgggttctcccgtcgattccgcctccgattccctccctcctcccgttgcggcgactcctgctcctgcggcggaggccaagcaggagtcggtgtcggagacggaggaaactaagcaggcggcggcggcggcagcagcagcagcggcaggaggtgtgcaggccatggcggtcaccgtagtgcgggacgtcgagacgggcctggacgcgagcaccagcgaccgggacggtgacaagccttcctggttcacacctaagagattacttgtcatgttctgcattatcaacatgctgaactatattgatcgaggagtaatagcaagtaatggggtcaaatggtacccgcaaaaagttgttctggtggcacatgcacctcgggctcaggaattcaggagacttcattcttataatcttgaaagagggacactgtccccaacatttatggtggggttgtgtggggcctccgttaaaattggcagccctgtaaaaaaaaaaaatcctttcaggctttttggggtttgcttgttaggggggactaccccaaccgcggggtgggggaaacatttggattcccgggcaata

SEQ ID NO: 84783 - protein, 217 aa, Zea mays
  misc_feature: Ceres CLONE 1570949
MGGGSPVAAVQDASDDGARVVVLVAGSPVDSASDSLPPPVAATPAPAAEAKQESVSETEETKQAAAAAAAAAAGGVQAMAVTVVRDVETGLDASTSDRDGDKPSWFTPKRLLVMFCIINMLNYIDRGVIASNGVKWYPQKVVLVAHAPRAQEFRRLHSYNLERGTLSPTFMVGLCGASVKIGSPVKKKNPFRLFGVCLLGGTTPTAGWGKHLDSRAI

SEQ ID NO: 84784 - DNA, 757 bp, Zea mays
  misc_feature: Ceres CLONE 1570953
  misc_feature: Encodes the peptide sequence at SEQ ID NO. 84785
  misc_feature (595)..(595): n is a, c, t, g, unknown, or other
gcggtggcggccgctctagaactagtggatcccccgggctgcaggaattcgtctcacccctagaaaaaatgctggctctgtgtgtcccccattcacttcacactctagactctagttcgccccatgagtctggcaggtcaaagaagggaagagacaaccgaaggatcaacggatcaagcgaggtagacgactccgcgtctaattaaacctgtggtctgcggacgggcggtcgtcggttagagcattgcttccgtgtggtgcggttgatagctcggatcttctgctggcggagttcgtcttggaggagaagagagagagagagcgcgcgcgccgggatcggagccaggaagcatccagcagcgatggcgggcggcggggtggcggcgctgggcgtgaagacggagcgcgcggcgcagtacaaggggcgcatgacgctcgccgtcgccacgacctgcctcgtggccgccgtcgggggcgccatcttcggctacgacatcggcatctccggaggcgtgacatccatggacccattcctggagaaattcttcccggtagtgttccaccggaagaactccggcgggaagaaacactactngtagtacgacaaccagggactagcggcgttcacatcgtcactctacctcgccgggctcgttgcctccctcgtcgcgtccccccgtgacgagaactacgggcgcaaaagctagcaatgtcttgcggcggcttgagctttcctcattgggggcggcccttaaag

SEQ ID NO: 84785 - protein, 77 aa, Zea mays
  misc_feature: Ceres CLONE 1570953
MAGGGVAALGVKTERAAQYKGRMTLAVATTCLVAAVGGAIFGYDIGISGGVTSMDPFLEKFFPVVFHRKNSGGKKHY

SEQ ID NO: 84786 - DNA, 923 bp, Zea mays
  misc_feature: Ceres CLONE 1570954
  misc_feature (923)..(923): n is a, c, t, g, unknown, or other
ctccccgcggtggcggccgctctagaactagtggatcccccgggctgcaggaattcgtctcacccctagaaaaacggcgagaaccgaccggctcgacccttctgccggcgatgcgctcctggccttaactggccgggtcgtgcctccggcgccgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccagggatcagcgggtgttactaccgcagtaccgcaccaccaccaagcaccgcaaccggagccggagccagaggagggcgagaggccgaggggagaggagcgaaggaggccgccgaccgaccgtgcgtccggccccgcggcggcgtcggcaggtcgtagacgacagacgagcagtagcagcagcagcagcacgaggcggccgggcccgggccacgccatgccggaataggatgcgcaagccgccgcgttctgcggcgaggcggtgatcgccgagttcgagtccctcacgcgggacgccgccgccgtgcagcgcgacacgctgcgccggatcctggcagacaacgcctgcgccgagtacctcccctgccgggggcctcccgggcccgcacgacgccgccagctttccgggcttgggttgccgttcgccacgaaggcggaattgaagcccttaatttggcgctatgcccaacggcgaan

SEQ ID NO: 84787 - DNA, 1329 bp, Zea mays
  misc_feature: Ceres CLONE 1570958
  misc_feature (4)..(4): n is a, c, t, g, unknown, or other
  misc_feature (14)..(14): n is a, c, t, g, unknown, or other
  misc_feature (52)..(52): n is a, c, t, g, unknown, or other
  misc_feature (953)..(953): n is a, c, t, g, unknown, or other
  misc_feature (1230)..(1230): n is a, c, t, g, unknown, or other
aaanaaaaaataanatataataaataaataaaaaaaaataaaaataaatagnttttctctttactatacataatggaactccccgcggtggcggccgctctagaactagtggatcccccgggctgcaggaattcgtctcacccctagaaaaggccttgttccccgttggacccagcctaataaaattccccattccaactcacacagatctcgtacccggcagtggcgacgaatctcgcggggcggaggtggtggcgcgactgaggcggtgtcgactccgacgaactcgcagccaccgggggatacgcagcagcagcaccggcgtactccatcgacgttcatatttaaggacttggtttggataattctactcgtcaacaaaagtgattaaaaaatggtggttcttgcagcttcaatctgtttcaagtcgggaaaagcacttgtttcaagacagtttgttgacatgtctcgcataagacttgaaggattacttggctgcgttccccaaactggttggaactgggaaaacaaacaacaccttttgtttgaaactgaaaaaatgtgccgttacggtttttatcaaaccggagtgaaagggatcaatatccttacaagcttttacccccgaaaccaaaggcacgacgcagaatattttcctttggaaagaattcttggagaccacaatttggaatggtctctcccccttctctcttcaaacatttgggtgtccccttgagaaaataacaccgcccacgcctggtcaacttcgtgggtagagttgaagtgtacatccgccgctagcttcttttcgcgttgaagaaaaattagtagagtctcgctttttttggtgaagcgaagatttcgtgtgtcagtgggtgtatccccgcttgctgtatagcccagggtcttagaaaaagaagccgccgcgacgtcggtacggttccctgtttatnggaggacaaacacacaaagagagagtaaaaaactagattgtgagtgcaacccaagatggggtagatcaaaggcacccgaagtatcgtaaaatacccgagatccgctccctggtgtgtgagcgcgaacaaggtggcacaccaatctcctcacacttgcttatcacgtagacacaaaggccgcatgccgcacataaatgctgcatggagagagcgaaataagacgtcgatccctcgccacaacatttatctatcggcataaacgacgcattgtgctacnacctgctcagttgtgtatagatataagaaggggaccgccaaatgaggaaaaacctgttgcgccaacaaagatgagcggctaattggaacagacacaaac

SEQ ID NO: 84788 - DNA, 846 bp, Zea mays
  misc_feature: Ceres CLONE 1570960
  misc_feature: Encodes the peptide sequence at SEQ ID NO. 84789
  misc_feature (155)..(155): n is a, c, t, g, unknown, or other
  misc_feature (361)..(361): n is a, c, t, g, unknown, or other
  misc_feature (373)..(373): n is a, c, t, g, unknown, or other
tccccgcggtggcggccgctctagaatagtggatcccccgggctgcaggaattcgtctcacccctagaaaaagcccatcctctattcctcttcccctcccactccccagctcctgccgccccgctccacgttccagaacatctggggcggtatcnccattcgcatggtcaccccatagccccccgacaaccaccccaccgacgcaccggcagcaatggcggtgggcagcggcctggccctgtacacgtccctcgagtggccactgcgtggcgctgctgtactttcacttcggcgaggtggaccctcgcacatctcgctcccgtccttgcccgtctccgggcccgtccccctttcgcgcggnttgcgtggcggnccccctccttggaggcggcccggcgcgcaactgttccttgggccgcccggcctttttaggtgaacgggtgggaaatcctactgggtctctgggaccaagcccggtggaacccaaggtcccgggaacccccttttcccccaaatgtttcccaacccgggcccaaaaatggggcccccaccggggggccccccccccggggggtttaaaagggaggggccttaaaaaaaccccttctcggggttttccccccggggcccttttttaaaaaaggggtttttttaagggtcttaaaaccggggggtctctttgaagagccccgggggcccaccggggggggcggctttatatctctattttttgtggggaaacaaccttttggggggctcttgggggggaaaaaaaacaaaaaacccggccccgggggggggggaaaaaaaaaaaaattttttttattttctcgcccccccacaaaa

SEQ ID NO: 84789 - protein, 73 aa, Zea mays
  misc_feature: Ceres CLONE 1570960
MAVGSGLALYTSLEWPLRGAAVLSLRRGGPSHISLPSLPVSGPVPLSRGLRGGPPPWRRPGAQLFLGPPGLFR

SEQ ID NO: 84790 - DNA, 837 bp, Zea mays
  misc_feature: Ceres CLONE 1570963
  misc_feature: Translation starting site: 259
  misc_feature: Pfam Name: Prenyltransf Pfam Description: Putative undecaprenyl diphosphate synthase
  misc_feature: SWISSPROT Homolog: EC 2.5.1.31 Di-trans,poly-cis-decaprenylcistransferase
ctccccgcggtggcggccgctctagaactagtggatcccccgggctgcaggaattcgtctcacccctagaaaaacttctcatcctcgtcctcagatccgcctccttcaccccactggtcggcgagcagcaaaatccattcaccccactggccggcgagcagcaaactccattctccccactagcaggcgagcagcagactggagatctcgtcctcacgagcgctttggtaattggtcgcatagtccctcatcatcggaatggtggggtcacttatctttcactcacctaatgtggatccgaaggcagagaatcctaatgagatggctacagctggtgtgctttcaagccttcagaatttcctacacaagtgcctcatagctatcctctcatatggcccaatgccgaagcacattgcatttactatggatggcaatcgtcgatatgctaaagtcacagcatgcatgaatgagctggtcacaggatgggtttctctacgcctattgcaagtcagatgtactgctatgaaatgggtgtgaagtacatcactgactacgcattctgcatcgacaatttaaaagggacccaatgcaggggaatccttgatgctgttaatggaggaaaaatcaacgacctccttaagaaccaagtggtaaccaacagattaacggtaagagcaactttgggggaaaatcggacctggtttataaacccggtccggccggggctttaaaaaccaagggggagcccccctggggaaacaggggctgggctttttcatattggaagccaaaaaatccgaacctccgaaaaattgcaaatggttttcaaaacaggga

SEQ ID NO: 84791 - DNA, 817 bp, Zea mays
  misc_feature: Ceres CLONE 1570964
  misc_feature: Encodes the peptide sequence at SEQ ID NO. 84792
gcggtggcggccgctctagaactagtggatcccccgggctgcaggaattcgtctcacccctagaaaaactccctatcctgaaacgccaatccgataaaaagcgcgcaccggcgtggcgcgcttcgcccccaggagccccgatcatctcccgctcccttccttcctcctcctcctcctcatggctctgtcgtccgccggctcgttcgtggcctgcagcctccggccaagcggagctagcatccatgccccgaggtcgccgccgggcgaacgcgaccaagggcggcgtgtccaccgtgtgcgagccgctgggccccgacaggccgatctggttccccggcagctcccctccgccgtggctcgacggaagccttccaggagactttggatttgaccctctcggactaggttcggagccggagctgctgcggtggttcgcgcaggcggagctgatgcacgggcggtgggcgatgctggcggcggcgggcatcctggtcccggacctgctggcgcggtggggcttcatcgacgcggggttctcgtggttcgacgccgggtcccgcgagtacttcgcggacccctggacgctgttcgtgtcgcagatggcgctgatggggtgggccggaggggcggcgggtgggcggacttactgaggcccgggtgcgtggacatcgagaccgcgcttcccgaaccgcaagaaccgggtgcccgacggggggtaccccgggggggctgttgtttccactgggcccactgggggcccgcgggttcccggaaccccggtgagggggctgcgccccaaggaaaatcaggaacggga

SEQ ID NO: 84792 - protein, 135 aa, Zea mays
  misc_feature: Ceres CLONE 1570964
  misc_feature (34)..(135): Pfam Name: Chloroa_b-bind Pfam Description: Chlorophyll A-B binding protein
MPRGRRRANATKGGVSTVCEPLGPDRPIWFPGSSPPPWLDGSLPGDFGFDPLGLGSEPELLRWFAQAELMHGRWAMLAAAGILVPDLLARWGFIDAGFSWFDAGSREYFADPWTLFVSQMALMGWAGGAAGGRTY

SEQ ID NO: 84793 - DNA, 860 bp, Zea mays
  misc_feature: Ceres CLONE 1570965
  misc_feature: Encodes the peptide sequence at SEQ ID NO. 84794
ctccccgcggtggcggccgctctagaactagtggatcccccgggctgcaggaattcgtctcacccctagaaaaaatctgggatgaacttatcatctagggcaatgagtgggcaaactatggaccagtctcagctctatcaggatgttgataacgtccagaagtttctttttgatcgacagggtgaccaaccaaatggcaatcagcagcactacatgaggcgtcctgagcatggacaatctaagttatctgatggatattctgccaatttggccaattcatccacgatgagaaaccagattaattctggcagtttcacatcttttgacagtttgtctcttggatctggctttccttcccctaggattggttctagatcccctggagggactgtatcttctcgacaaaatttagctggtatgtctaacatgctaaactataatggaattggaaagtccactgcgtcaccttctcttcagacttctattgatccagcgtatatccagtaccttgctcaaattgcagctacctgggatgatcctctaatggacaggagccatcttggaagttcttacatgaacttacttggaacccgaaagctaaccttgggcctttacttcagtccaaaaaccaaaatggtactgggggcaacctggaatttaacctgggggtgtaagccgaaaagccattgaaaaatccgggtccttcccccttccccccttgggccccggggagcccctttagggtggggggacccaaaaaatgggttttccccccggggagaagaaaccccggggaattcctttggttgtttggaaatccgcccccggggggaaaaaaaggttttattttttgccccccc

SEQ ID NO: 84794 - protein, 202 aa, Zea mays
  misc_feature: Ceres CLONE 1570965
  misc_feature (1)..(201): Pfam Name: NABP Pfam Description: Nucleic acid binding protein NABP
MNLSSRAMSGQTMDQSQLYQDVDNVQKFLFDRQGDQPNGNQQHYMRRPEHGQSKLSDGYSANLANSSTMRNQINSGSFTSFDSLSLGSGFPSPRIGSRSPGGTVSSRQNLAGMSNMLNYNGIGKSTASPSLQTSIDPAYIQYLAQIAATWDDPLMDRSHLGSSYMNLLGTRKLTLGLYFSPKTKMVLGATWNLTWGCKPKSH

SEQ ID NO: 84795 - DNA, 1194 bp, Zea mays
  misc_feature: Ceres CLONE 1570967
  misc_feature: Encodes the peptide sequence at SEQ ID NO. 84796
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (33)..(33): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (71)..(71): n is a, c, t, g, unknown, or other
nnnnggaggggtatttaatattattatagttgntaaannatncnncgcaaaacaccccaaccccccgtgtnttttttgctggggctccccgcggtggcggccgctctagactagtggatcccccgggctgcaggaattcgtctcacccctagaaaaaacgaacagctacgcatcctgcatgctcgtcgccctcctctgactcctcgcctgctgccccggcgccagcgcagcaagtgccaccgcgccaaacgcacgcccgatgcgcgtcggcctactcgacagcgcctacccgtctctgcgacccggtggtctccatcccggaccgcgcgcgcgcgctcgtctcgctgctcaccctggacgagatccatcgcgcagctgtccaacacggcgggcggcgtcccccgcctgggcataccgcccataccagtggtggtcctagtcgatccaaggcctcgccgactacggcgcccgggtcaacttcacccctggcccttgtatgagcagccaccgacttcacgcaggtcatcatgtccacgcgcctccttttatcgatcccctgtggccccgcgatacgccgaatgcagttcgccccgaaaaggcccttcgagaatggcacaaagaggacaagctcaaagtcccggcccttcatccttatttggtggcagcccttaataatcctctccttccattgtcccgtaggaaccccccaaagggtggggggcgcccccgccgggtatccctgatgtaacatccgggtccctccgggagctatagggtactccccccccggccctctggataagtaactcttggtcccccctaggagttaaacgatcgcgcgccttacgggaaaggctagtggtccccctgaggggggggttttttcccccatgggagaatatgctaagcgctaaagggggatatttgggcaaagagcggcatgttaaaatttttcggggggccttcctttcgtgggaccgcgtggttctatcccttatgaaaaaccatggttgccccaccccatgctatatataaaacatgtgggcgacaaataacattgcgctaaaaagagaggttttaatacagggggaggtgaatatcagattttttgaatagtgtccccaaaggtgataattctgtgcacaaatacaatctccagggaaatgtaaaccggtgcccaaaatgcggaccgtc

SEQ ID NO: 84796 - protein, 71 aa, Zea mays
  misc_feature: Ceres CLONE 1570967
MSTRLLLSIPCGPAIRRMQFAPKRPFENGTKRTSSKSRPFILIWWQPLIILSFHCPVGTPQRVGGAPAGYP

SEQ ID NO: 84797 - DNA, 798 bp, Zea mays
  misc_feature: Ceres CLONE 1570969
  misc_feature (508)..(508): n is a, c, t, g, unknown, or other
ctccccgcggtggcggccgctctagaactagtggatcccccgggctgcaggaattcgtctcacccctagaaaaaacctcgtgtgtctgtttctccgccctgggctctgggctcgggcgtagtccagttgccaccaaccgagccagagagagaacaaagaacgggtgaaagaaatctccgaaaggttccagatttcctcgaggtggaggcctccttttcctcggccgaatcgctcgttcgctttctctctctctctctttcctcccatcgagcatgcattcttttctgctgctgcgaccgtaggatcggcgtccagcagcctcgccgcgtcggtatggttttcccttggcccacacatcctagctcttccgcactcttgaatttcgtggtcgaggattagggggtttctcgtgcgctggtccaatttcgcgctaatcgtcctgttcctgccctcggatactcgccttctcgtggtccccatctgttccttggcgttccacgcctgcccntgcggcgggcaaggctgcaacaaccacccgggaggccgtggatttttgggaacccccttttcaaaaaaccagctggaagctttgggctttttcctccgggccggacccccaaaaatcccccaggaaaaccccccccccacaaaaaaaaaaagggggccccccttttggggggggggggggggggggatttttttttaaagcccccccccaaaaaaaattttttgtgggggagggtgtttgttttataaaaacaaaaaaagcgccctttttttttttcataaaaaaagaga

SEQ ID NO: 84798 - DNA, 955 bp, Zea mays
  misc_feature: Ceres CLONE 1570971
  misc_feature: Encodes the peptide sequence at SEQ ID NO. 84799
ggagctccccgcggtggcggccgctctagaactagtggatcccccgggctgcaggaattcgtctcacccctagaaaaagctcctgcctcgcctctcctccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgccgggggatccaccgctgaccttaccctcgaaatcgccaaccgtatgcagaacatggtgtgtgtggaaaccatgatgcacctgacatgtacaaacatgccagtagagaagattgaccatgccttggaaaccatcaaatccaatgggattcaaaattgttttggccctcagagggggatcctccacatgggcaagacaaaattttgtgcaaattgtaaggccgattttgctttgggctccttgatttgggttgcaccctttttaaaccccaagttacgggtgaattttttttggcattaactgttgcctgggtttttcccaaaggccccccccctgtatgtccttataagggggggaggggaggtgtgccctcctttggaaagcgctttttgccaatgtttcttggcttatcttgaaaaaaaaaaaggttgaatctctggtgccctaccctcttttgtttacaaaaatttttctttggtaccaaatatcttttttccaaagtttgtggaaagtaccgccccccaaattgggttttcatctgcccctttggttcgtgggtcattggcacaaataaaattccacggttcttcttcgccaatatgggggtttttgaaaaataaataaacctcgcgaaacacccgcgtcttaattct

SEQ ID NO: 84799 - protein, 153 aa, Zea mays
  misc_feature: Ceres CLONE 1570971
  misc_feature (6)..(149): Pfam Name: MTHFR Pfam Description: Methylenetetrahydrofolate reductase
  misc_feature: SWISSPROT Homolog: EC 1.5.1.20 Methylenetetrahydrofolate reductase (NAD(P)H)
MKVIEKILEAAGDGRTAFSFEYFPPKTEEGVENLFERMDRMVAHGPSFCDITWGAGGSTADLTLEIANRMQNMVCVETMMHLTCTNMPVEKIDHALETIKSNGIQNCFGPQRGILHMGKTKFCANCKADFALGSLIWVAPFLNPKLRVNFFWH

SEQ ID NO: 84800 - DNA, 878 bp, Zea mays
  misc_feature: Ceres CLONE 1570973
  misc_feature: Encodes the peptide sequence at SEQ ID NO. 84801
  misc_feature (465)..(465): n is a, c, t, g, unknown, or other
ctccccgcggtggcggccgctctagaactagtggatcccccgggctgcaggaattcgtctcacccctagaaaaagactgggctacgccgccgccgccgtcctccgtctggtgccgaggtcttcgttggacccttcgcccgcgactagcgtccgccaggctgaaggcgatggcgacggagaggaggcgcgcgtcagtcgtggtactgggcgacatcggccgcagcccgcggatgcaataccactccctctcgctcgctaaccaggccagtatggaagtggacattgttgcaaatggaggaagtgatcctcacttgtcactgagagagaatccatcaattcacatccacgagatgaaaacagtgcagttaactggaatttcaaagatatctggtgctctgtcacttctacttaaagctgctgtcccagtcattttgctgggttggggttcttttgttttagattccntcgcctttgatgtcttttttgttcagaatccaccctctggtcccaccactggctgctgtaaaactgccaagcctggcttaaaaggtgctaaattttattggtggattgggccttaactttgggaattactttggctgggggttgtccccttggcaaaaattcccctttattggccaaatcttattttgggggttggagaaaatacttttggggcaaaaggggctaaagggggcccttttggggtgtccaaaaacaattggcgcccgtgggccttgtcccaaaaattggggaaaaacgggggcaaaaagtcccttttagaacacaacccccccgggtttttttttcccccccgccttttttttggggggaaaaacaccaggggttgtttttctcgcgggcgggggagattcccc

SEQ ID NO: 84801 - protein, 137 aa, Zea mays
  misc_feature: Ceres CLONE 1570973
  misc_feature: SWISSPROT Homolog: EC 2.4.1.142 Chitobiosyldiphosphodolichol beta-mannosyltransferase
  misc_feature (100)..(100): Xaa is any aa, unknown, or other
MATERRRASVVVLGDIGRSPRMQYHSLSLANQASMEVDIVANGGSDPHLSLRENPSIHIHEMKTVQLTGISKISGALSLLLKAAVPVILLGWGSFVLDSXAFDVFFVQNPPSGPTTGCCKTAKPGLKGAKFYWWIGP

SEQ ID NO: 84802 - DNA, 993 bp, Zea mays
  misc_feature: Ceres CLONE 1570975
  misc_feature: Encodes the peptide sequence at SEQ ID NO. 84803
  misc_feature (394)..(394): n is a, c, t, g, unknown, or other
  misc_feature (993)..(993): n is a, c, t, g, unknown, or other
ctccccgcggtggcggccgctctagaactagtggatcccccgggctgcaggaattcgtctcacccctagaaaaagcgccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccaaccnccgctggtgctcctgcaacatcttctccacgcaggaacacgccgacgccgccatcgcgcgcgactctgccgccgtggtcgcctgggaggtggagaccctcgaagagtactggtggtgcaccaagcgctgcctcaactggtgccaagcgggctgccccaacctctcgtcaaagaaggcggggacccaccctggtcatccacaaggggggcaagggccaaggaggatttcaaaaagaacggccataatcccccaacccggaatccccccgaaaacccttgagtgtcaaaattggggcccaccctccttcccgcaaaggggtcctagaggtgaaccccaaaaaatatcccccaataattaaaggaagactcttgtcgggcctcctaagagaacacccccggggggggaaaagagggccccccaataaagaggaaagggggcccctccccttccccgggaattaaaaagaaaaatttctctcccaaaaaaaagttttacacacctgttttggtgcgcgccccccccccccctttgtgttttttatagccctctatcttttttttccccacaaaaggtcccgggttcctaaataaatgatatan

SEQ ID NO: 84803 - protein, 199 aa, Zea mays
  misc_feature: Ceres CLONE 1570975
  misc_feature (12)..(189): Pfam Name: AdoHcyase Pfam Description: S-adenosyl-L-homocysteine hydrolase
  misc_feature: SWISSPROT Homolog: EC 3.3.1.1 Adenosylhomocysteinase
  misc_feature (81)..(81): Xaa is any aa, unknown, or other
MALSVEKTSSGREYKVKDLSQADFGRLEIELAEVEMPGLMACRAEFGPSKPFAGARISGSLHMTIQTAVLIETLTALGANXRWCSCNIFSTQEHADAAIARDSAAVVAWEVETLEEYWWCTKRCLNWCQAGCPNLSSKKAGTHPGHPQGGQGPRRISKRTAIIPQPGIPPKTLECQNWGPPSFPQRGPRGEPQKISPNN

SEQ ID NO: 84804 - DNA, 803 bp, Zea mays
  misc_feature: Ceres CLONE 1570976
  misc_feature: Encodes the peptide sequence at SEQ ID NO. 84805
  misc_feature (577)..(577): n is a, c, t, g, unknown, or other
ctggagctcaccgcggtggcggccgctctagaactagtggatcccccgggctgcaggaattcgtctcacccctagaaaaatcagtcctcacccaccaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctgggctcatcccgcccccgccggcgtgccccgcaacgcgtggcagctcctagccatcttncctctcaccatcgtcggcatcatcacccagccgctgcccctcgggggcgggcgcccttcctcgggctttcgggcccgccgtgctcagccgcaacgctcacgtttggccgcgggcccttcttggggcctttggggaaacccgaatccccctgggtttaattgggggttcggcctttctttcttttggcgagaggggggggttccaatcaaaaaaaaccgggccctcc

SEQ ID NO: 84805 - protein, 221 aa, Zea mays
  misc_feature: Ceres CLONE 1570976
  misc_feature (146)..(146): Xaa is any aa, unknown, or other
MASSTAASPLTCHHLGSVGARPRLPSLSISLRRRSSSSSKPTSLSHSLPSKHSLAPPPAASASSRRGLTPVPASASAAAAPAPDPVPVPAPAPAPAPAPAAPPKKPALQGAAIKPLLASIATGVLIWAHPAPAGVPRNAWQLLAIXPLTIVGIITQPLPLGGGRPSSGFRARRAQPQRSRLAAGPSWGLWGNPNPPGFNWGFGLSFFWREGGVPIKKNRAL

SEQ ID NO: 84806 - DNA, 927 bp, Zea mays
  misc_feature: Ceres CLONE 1570979
  misc_feature: Translation starting site: 134
acccgcggtggcggccgctctagaactagtggatcccccgggctgcaggaattcgtctcacccctagaaaaacaaaaaaaaaaacccccagccgggccagcccccccaagccaagcagaatcctcgccccgcaatgcagcacctggccgccgtgctcctcgtcctggcggctaccaccgcgctgccgcccggcgcggcggcgtggcgcccgtggccgccgcgcgacaacgcgacggctgcggcgggccttggcgcgtccaagaggctggagggctcgtcggagttcgtgaagctggagtaccacatgggcccggtcctggcgtcggccatcacggtgcacccgatctggtacgggccctggccggcggcgcagaagcgcacgatccgcgcgttcctccgctccctgtcgccttctgccgccatcccttcgccgtccgtgtcggcgtggtggcgcacggtgcggctgtacgcggaccagacctcggccaacgtgtcggcgtcggtgtcgctgggcgcggagaagtcggacgcgcgcatgtcccgcggcgcgcggctgtcgcgcatggacatccaggcagtggtccgcgacgccgtgacggcgcgcacccggcccctgcccgtggacgccagcggcggcgtgtacctggtgctcacgtccccggacgtcgccgtggacgacttctgcgggcaggtgtgcggcttccactacttcaccttcgcgtcggtggtcgggtccacgcctgccgtacgcgtgggtgggcaactcggcgcgcaggtgccccgaagtgtgcgcgtacccgtttcgcggtccggcgtacgtgcgcgggccaagccccaagccccgccccaccggcgaccttcgggtggaccggatggtcaacgtcatcccgcacaagcccccggagatgggtcaaccgcgtcgcaaag

SEQ ID NO: 84807 - DNA, 797 bp, Zea mays
  misc_feature: Ceres CLONE 1570981
  misc_feature: Encodes the peptide sequence at SEQ ID NO. 84808
tggagctccccgcggtggcggccgctctagaactagtggatcccccgggctgcaggaattcgtctcacccctagaaaaaaccccaaaaagccccccattcctttccccactctcatgccaccgccatcgcctcctcccactccttattgccgccgctgccctgctccaaccccccgcctcctctttcctcgcaagaccacgtcctcatccactacatccaccagctagacgagcaagaagccgccaccatggtccgcaagcgccccgcgcccgacatggacctcccgccgccgcgccgtcacgtcacgggcgacctctccgacgttacggccgcagccgccgccgctggtggtcctggcgcgccgtcctccgctagcgcgcagctacccgcgctgcccacccagctccaccagctgccccccgcgttccagcaccacgcggcggaggtggacgtgcccccgcaaccgcacccgccggcccattcgcaggcgggcggcgaggcgcccgcgtccacgaccgcgtgggtggacggcatcatccgcgacatcatcgggagcagcggcggcggcgctgtctccatcacgcagctcatccacaacgtccgcgagatcatccacccctgcaacccaggcctcgcgtccctcctcgagctccgcctccgttcccttctcgccgccgaccccgccccgctgccgcagcagcagcgcgctctcctgcacggcgctccggccgccgccgcggggctggcgctccctctcccgccaccgctttctgaaagcgccgccacgagcctgcgc

SEQ ID NO: 84808 - protein, 183 aa, Zea mays
  misc_feature: Ceres CLONE 1570981
MVRKRPAPDMDLPPPRRHVTGDLSDVTAAAAAAGGPGAPSSASAQLPALPTQLHQLPPAFQHHAAEVDVPPQPHPPAHSQAGGEAPASTTAWVDGIIRDIIGSSGGGAVSITQLIHNVREIIHPCNPGLASLLELRLRSLLAADPAPLPQQQRALLHGAPAAAAGLALPLPPPLSESAATSLR

SEQ ID NO: 84809 - DNA, 855 bp, Zea mays
  misc_feature: Ceres CLONE 1570982
  misc_feature: Encodes the peptide sequence at SEQ ID NO. 84810
  misc_feature (520)..(520): n is a, c, t, g, unknown, or other
tccccgcggtggcggccgctctagaactagtggatcccccgggctgcaggaattcgtctcacccctagaaaaagtggactccttccccacaaaactaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcggctgcgccggcaccttctgctccggccctcccacctccgcctccgcgcgccccactccatcgccgacctctcccgctcctccaattccgccccgagcccggcccgcccagcgctgggctccggcccggagaacggcagcggcggcgtccgcgcggtggagaaggacccgatcaagctgtgggagcgctacgtcgagtggctctaccagcacaaggagctcggcatcttcgtcgacgtcagccggatggggttcacggaggagttcctgcngcagatggagcccgcgatgcagcaggccttcgtcgacatgcgggagctcgagaaaggcgccatcgccaaacccgacgagggtcgcatgttgggccactactgggttcgcgaccgggccctggttccaaatccttcttcgggaacagatcaaaacgcactcgacaaaatcttcgccttctcccaagaaggcatctcttgaaagaatctttccccatcgggtcgtttcattccaattccccctaaaagaaatcggaaggtcaactttggggccctcaattggttggccaagggcctttgcccctgaaaaaccctcccctgaaaaaaaaaattttttc

SEQ ID NO: 84810 - protein, 174 aa, Zea mays
  misc_feature: Ceres CLONE 1570982
  misc_feature: SWISSPROT Homolog: EC 5.3.1.9 Glucose-6-phosphate isomerase
  misc_feature (109)..(109): Xaa is any aa, unknown, or other
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLXQMEPAMQQAFVDMRELEKGAIAKPDEGRMLGHYWVRDRALVPNPSSGTDQNALDKIFAFSQEGIS

SEQ ID NO: 84811 - DNA, 1164 bp, Zea mays
  misc_feature: Ceres CLONE 1570985
  misc_feature (871)..(871): n is a, c, t, g, unknown, or other
  misc_feature (877)..(877): n is a, c, t, g, unknown, or other
  misc_feature (924)..(924): n is a, c, t, g, unknown, or other
gaaaagagaattaaaaaaaaagagaaaaacgagaaacacaaaaggtgggacacaacaacacctcttttttgtttttttgaaggctggggctccacgcggtggcggccgctctagactagtggatcccccgggctgcaggaattcgtctcacccctagaaaaatagcgtcgtagtcctagtcaccgcgttcgcttcccgagcacgcaaccatggctcgactgtcagccaccgccgcgctcctcctcctcgtcctctccctcctcgccgtcgcgcactgcgagtgccctcgcagtcgcagcagagcacgacaccgagcccgaatcaaccgccgccgtggccgtcagcgacgacaacgtgctatccgaccccacggtccacgctgaggcgggcaccgccagcgccactgaagatgaggccatcccggcggaacagcagcggcaggggttccgaaatccttccgcctggccggttttcaacggggcttccacccacccacacaacaaaccttttggggtgggaaaagcggccaccccccccgggggaaattctttaccccgcggagaaccgggtggattcgccccactgaacggtttttcctccactagttgggaggtgcctctgggggcctccccacaccgctcgctccccccctctcattgatggggctcgtcaccccggtagagtgaagaacatacctggtcgtcactacatagagttatctttgttttatgtattttgggtgtttctctctaggcggcccacggggttaaaattagagccgtgcggcgccagttgcaatatacccgccgtgctattaattagtttgcgcaggcgcgcttccccgcgggggagggaagaaggcgtatatttntcgcanctaacagacagcgccacaaccatagacgactgattcttgttgttagncgcacacacacaattctaggacgcgcagcgacaaaatggaagtcactttattggcaccgtgtgcgggagcacccacatatattatatctaatgatcactcgtcgctcccctcacccccttctattgtgcatacccctccatataaaatagggaggagaaggtcggagtacagaggatacatacagaaggaggtgagtggaggatatccatactaaatcaccccttctagcgatcaggtgg

SEQ ID NO: 84812 - DNA, 892 bp, Zea mays
  misc_feature: Ceres CLONE 1570988
  misc_feature: SWISSPROT Homolog: EC 1.1.1.86 Ketol-acid reductoisomerase
ggagctccccgcggtggcggccgctctagaactagtggatcccccgggctgcaggaattcgtctcacccctagaaaaaaccgacggcctgtctccgttctctatctgacacgtgtgctggacctagtgactgcacccggcttcttgtctgccgcgtccgacctcactttcgggcaccaaaaaacactagccaccggctgtgcaaattgggagccctggggtacatctagggctttctccttcacgtgcacacccacgagtgggcgtgcctgctctcctcctccgcgcctgggtctctgcgccgacgggattttgtggccagggtataagcaccacggggcctcggcagagacatacctgtcctgcagttccacacttgcgcttttcacaaggataacggccccctgggccgacgcgagcagtacatcctgcgcctacggagaaacatgttcccactaatttaagacgcgtgctggtggagctagctattggactgcttgtgatggagatagcatggtcctgcccgacatttaactggatatgtttgatgggtgatgccaagtgagatattgatgcgaacattggcctccggaaaggatccaaatatctagaagaacacgtcttcatggactaaccgaacagagggtatcatctggcgatatctgggaaaacgaatcccgcaaagaacctgtagtgctgctgatatgcgatgctgcacaaggagacatctatgacaaaatgttctgtgtcatgaatcatacagcctacttgcatatgtcatggattcttctgggacactaggagttctcgactcgtttaccaatgaaatgaaagtagtcctgtgtgccaacggaatgcgactatcgttcacagattaggtcatgccagcagtg

SEQ ID NO: 84813 - DNA, 898 bp, Zea mays
  misc_feature: Ceres CLONE 1570989
  misc_feature: Encodes the peptide sequence at SEQ ID NO. 84814
ctggagctccccgcggtggcggccgctctagaactagtggatcccccgggctgcaggaattcgtctcacccctagaaaaaccccgtcggcttccggagtggaaaccattttcctaccacccgcgggagatccacacgcccacgagcagtggagctcggcagcgaggcttcggagttctgccatggcgtcgtcccacatcatcctgcccaaggaggaggaggaggaggcggctgcggcagcggtggcggaggtcgggttgggagcggcggtggaggcggaccacgaccaccggccgtaccaggagcaggggcccgggaaggcggcgctgccgttctcggcaacgtgcgtccggatctcccgcgactcgtacccgaacctccgcgcgctgcggaacgcgtcgaccatgacactccacgatgatgacgccgccttcgtcaagctcgaggagggcgactacggatacgtgctcgacgacgtcccgcacctcaccgactacctcccggacctccccacttttccctatcctctgcaagatcatcctgccgattcaactgtcaggcaatattttgtcaatgcagaagataccgtccctgaaaagggtatttggtcagaaaaacagtccaccaaggagttcaccttccgtcctggctggacctcctcagaaggggggatttttgagtccaaaaaaagccaaaagctggcaattggcacccgggggaaggccttttcccctggggccccaaaactggcaatccaaaaaaattgggttttgggggcctgtggcccccaatgggtacaaacgttttggcaattggcttcccggaaaaaacgaaaattggggtaccaggggggtttcctatttcgaagaaaaatatatccttcccacggtagctacaaa

SEQ ID NO: 84814 - protein, 239 aa, Zea mays
  misc_feature: Ceres CLONE 1570989
MASSHIILPKEEEEEAAAAAVAEVGLGAAVEADHDHRPYQEQGPGKAALPFSATCVRISRDSYPNLRALRNASTMTLHDDDAAFVKLEEGDYGYVLDDVPHLTDYLPDLPTFPYPLQDHPADSTVRQYFVNAEDTVPEKGIWSEKQSTKEFTFRPGWTSSEGGIFESKKSQKLAIGTRGKAFSPGAPKLAIQKNWVLGACGPQWVQTFWQLASRKKRKLGYQGGFLFRRKIYPSHGSYK

SEQ ID NO: 84815 - DNA, 1224 bp, Zea mays
  misc_feature: Ceres CLONE 1570992
  misc_feature: Encodes the peptide sequence at SEQ ID NO. 84816
  misc_feature (31)..(31): n is a, c, t, g, unknown, or other
  misc_feature (72)..(72): n is a, c, t, g, unknown, or other
  misc_feature (1224)..(1224): n is a, c, t, g, unknown, or other
gttattggtgttggggggggggggagaggcnaataatataatacatgaagattgagggaggagagggaagangcccatgctggaactccccgcggtggcggccgctctagaatgatggatccgccgggctgcatgaatgcgtctaaccgctagaaaaagcccaagtacgataccgtcttctccgcgatccaccaccgccgcgccaactggttccccgtcctccaatgcagaagttctaccccgtcgcggacgtcgccgcccagctgcggctagttgcggacgcccgcaccgacgcatggtcctgctgctactccgaggaggccacgaccactgtgatccaagagcccatggaagaggctgaggctgaaactgaggctgagcccgaatccgagcgcgagcacgagcaggatccggcaccggcggccgagcttgctgacggcgccggggactaccacaagcccgaacccggaaaatggattcatgcgcaacatacgtcagaacgggaagccccccttccacaaaaaatgaaacgcgttgcatgaacgcacatcttgaccggagctaagggatcctcataaggggaaacaaaccgcccttagccaggaggaagggtattcccccattcctgccttcgtgaacccccacaagggaagtacgcattttggcccacgatcccctggagaaaaggagtaccgaggggaacccccgggggataagggggaccataccgctggagggccgcgtaggtgtatattctccccggtgggggcatcacgggggtgtggtgcgacccccctcgtgggttcggctaaagactcattccccgagtcacatcgtgttgtgacagacacaagtaaacatatcattggatacgaggagaacaaaaaatatggccctcggttggtgatctcgcattatcgggagatactccccaggaaaagagtaacccaccgcccggatctaaaaaaatgggtcgacgatattaacaaatgagcccgccctgtagaaaaaatgttcactatggataagagatgttctccagagcaatcactcggacaagttccatgagaatcgtactcggtggtggatagatatgagccgacaaatatggctctgtctcaacagaaatcatattgagatcacgatggacagtggtcgctcgacaatgtagcaggaaaaatgttgttgtgggggggcatacaacatgtgatgataatatgggcn

SEQ ID NO: 84816 - protein, 105 aa, Zea mays
  misc_feature: Ceres CLONE 1570992
MQKFYPVADVAAQLRLVADARTDAWSCCYSEEATTTVIQEPMEEAEAETEAEPESEREHEQDPAPAAELADGAGDYHKPEPGKWIHAQHTSEREAPLPQKMKRVA

SEQ ID NO: 84817 - DNA, 832 bp, Zea mays
  misc_feature: Ceres CLONE 1570997
  misc_feature: Encodes the peptide sequence at SEQ ID NO. 84818
  misc_feature (620)..(620): n is a, c, t, g, unknown, or other
  misc_feature (814)..(814): n is a, c, t, g, unknown, or other
ctccccgcggtggcggccgctctagaactagtggatcccccgggctgcaggaattcgtctcacccctagaaaaacgcaaacccctctcgatcgacgcacgcagccgcgacccatcgcgacctgacccgaccctcccgaggccgccagccttatgctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaacggaaggaatgtcgctttggagagcaagtacggctctcccaagattgctaacgatggcgttacagttgcaagagaggccgagctggaggaccctgtggaaaacattggagctaaattggtcaggcaagctgcagctaagaccaacgatcttgctggagatgggacaaccacctctgtggtccttgctcatgcgctgattgctganggtgttaaggtcgtagcagctggtgctaatcctggtcagattactcgcggtatcgacaaacagctaagcacgactcgaagaactacggaagtcgtctaaagacggtgagatagtgagcttgcagatgtcgctgcatttagtgctggcaacaactatgaaattggtagctgactacataagccatgaacaagacngttccgagttcgatgtcc

SEQ ID NO: 84818 - protein, 168 aa, Zea mays
  misc_feature: Ceres CLONE 1570997
  misc_feature (136)..(136): Xaa is any aa, unknown, or other
MASTFGATSTVGLMAAPTGKNVRLQRRANFRVKAAKELYFNKDGSAIKKLQTGVNKLADLVGVTLGPNGRNVALESKYGSPKIANDGVTVAREAELEDPVENIGAKLVRQAAAKTNDLAGDGTTTSVVLAHALIAXGVKVVAAGANPGQITRGIDKQLSTTRRTTEVV

SEQ ID NO: 84819 - DNA, 796 bp, Zea mays
  misc_feature: Ceres CLONE 1570998
  misc_feature: Encodes the peptide sequence at SEQ ID NO. 84820
  misc_feature (585)..(585): n is a, c, t, g, unknown, or other
  misc_feature (665)..(665): n is a, c, t, g, unknown, or other
  misc_feature (676)..(676): n is a, c, t, g, unknown, or other
ctccccgcggtggcggccgctctagaactagtggatcccccgggctgcaggaattcgtctcacccctagaaaaagacgctccagcggcatccgccacttcgtcgtcgtcgtcgcacggattggcattggctgccccccggccctgttcctcgtcctcctcatcaattcccgtctctcagtcctcccaataatggtggcgtggtgagaaatccttccgtccggccgtcgtcttagaagatgaactgttcctcttgctgcgccgctgccactccatcttctccggcgcttctcgccaggccgcgggggggtttagctgctagctgctccacgacgacagcaaatcagaaggtgcttttcctgggctcaaaacagtttccacggatcacgtatagccgtgcgtcgtcacggttgtcgcggagagaggtaatagcttttgccgggcaacaaccttgggacatcggcagatttgtcaagacgctgtatttcttcaacgggcctccaaaccttctcaagattgtagaatctatcatcagcagtttcactggacctgcttctagtgaagtgccaaagataatggaaacgtcngatgtggtgctggttactggagccaccggtggtgttgggcgacgggtggtggacgtcctgcagaagaagggagtacctgntcgagtatggnctaagaatgtagacaaggcaaggagcatgttgggggccgatgtacctctgatcataggagatgctacgaaaggagatacacttgatccctagcttattcaagggataaaaaaaagagcca

SEQ ID NO: 84820 - protein, 176 aa, Zea mays
  misc_feature: Ceres CLONE 1570998
  misc_feature (143)..(143): Xaa is any aa, unknown, or other
  misc_feature (147)..(147): Xaa is any aa, unknown, or other
MNCSSCCAAATPSSPALLARPRGGLAASCSTTTANQKVLFLGSKQFPRITYSRASSRLSRREVIAFAGQQPWDIGRFVKTLYFFNGPPNLLKIVESIISSFTGPASSEVPKIMETSDVVLVTGATGGVGRRVVDVLQKKGVPXRVWXKNVDKARSMLGADVPLIIGDATKGDTLDP

SEQ ID NO: 84821 - DNA, 813 bp, Zea mays
  misc_feature: Ceres CLONE 1571000
  misc_feature: Encodes the peptide sequence at SEQ ID NO. 84822
  misc_feature (587)..(587): n is a, c, t, g, unknown, or other
  misc_feature (595)..(595): n is a, c, t, g, unknown, or other
  misc_feature (653)..(653): n is a, c, t, g, unknown, or other
  misc_feature (687)..(687): n is a, c, t, g, unknown, or other
ctccccgcggtggcggccgctctagaactagtggatcccccgggctgcaggaattcgtctcacccctagaaaaagtccccggacccgccgcactactgctataggcgcatccccggcgccttcgcacactctctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccatttcgcttcggcggtcgagctccatgtcaacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtcacatgaagaatctgtctgtgaangagctgcngcagctggccgacgagctccggtccgacgtcatcttccacgtctccaagacgggcggncatctcgggtccagcctcggcgtggtggagctcnacgtcgcgctgcactacgtctttcaacgcgcgcaggaacgcatcctcctggacgtccggcaccaatcgtaccccgacaagaaatctgacggggcggcccgacaagatggcgacgaatgcgcaaaac

SEQ ID NO: 84822 - protein, 114 aa, Zea mays
  misc_feature: Ceres CLONE 1571000
  misc_feature: SWISSPROT Homolog: EC 2.2.1.7 1-deoxy-D-xylulose-5-phosphate synthase
  misc_feature (39)..(39): Xaa is any aa, unknown, or other
  misc_feature (42)..(42): Xaa is any aa, unknown, or other
  misc_feature (73)..(73): Xaa is any aa, unknown, or other
MRVGVAVVGARGGVLLAEAAHAAAGHHQLPRHMKNLSVXELXQLADELRSDVIFHVSKTGGHLGSSLGVVELXVALHYVFQRAQERILLDVRHQSYPDKKSDGAARQDGDECAK

SEQ ID NO: 84823 - DNA, 891 bp, Zea mays
  misc_feature: Ceres CLONE 1571001
  misc_feature: Encodes the peptide sequence at SEQ ID NO. 84824
  misc_feature (828)..(828): n is a, c, t, g, unknown, or other
  misc_feature (891)..(891): n is a, c, t, g, unknown, or other
tggagctccccgcggtggcggccgctctagaactagtggatcccccgggctgcaggaattcgtctcacccctagaaaaagaggtcctgggtgactgactgaccacactagcgcagcgcgcacaggagcaaaggggggcatcctctatcgcgcgcgcgccatggccaccaggccgggccctttgactgaatggccatggcaaaggcttggaaacttcaagtacttggtgatggctcccgtggtggtccacggcgcgcggcgggtgttggcgcggggctggggcgacatcgaccttgccttcgcgctcatcctgccgtcgctgctgctgcggatggtgcacaaccagatctggatcagcgcccgcgcgctaccagaacggcgcgcggcaagcaacggcatctgtcaaccccccggcatcgaagtttcgaccccaggtccaaaccgggcagccccggcctggggaaccaaaccaaattcatcccttcaaacgggccttggcttcctttctaccgtttggggctaaccttgggcgcattcccccaagcccccaaaggccccaatgcccccggcccttggaaaaggtccgaaaaagggcccccccctgtggcaaaaaggggccccttttctcccccaagcccccggggcccccccggggggaaatttccccctccttaacaaaaaaggggggttcccccaccccggggggggggggttttaaccaccacaccaaatttttttcccccttttataattgcggggggctgtttaacaacattttttggagaagaaagaaaaaaaaaatcttctccccctcaaatattgggggtcncccccgggggagggccgccccttcttacaaatattttcgggggagggaaatacccaccccccn

SEQ ID NO: 84824 - protein, 120 aa, Zea mays
  misc_feature: Ceres CLONE 1571001
MATRPGPLTEWPWQRLGNFKYLVMAPVVVHGARRVLARGWGDIDLAFALILPSLLLRMVHNQIWISARALPERRAASNGICQPPGIEVSTPGPNRAAPAWGTKPNSSLQTGLGFLSTVWG

SEQ ID NO: 84825 - DNA, 1036 bp, Zea mays
  misc_feature: Ceres CLONE 1571002
  misc_feature: Encodes the peptide sequence at SEQ ID NO. 84826
  misc_feature (393)..(393): n is a, c, t, g, unknown, or other
ctccccgcggtggcggccgctctagaactagtggatcccccgggctgcaggaattcgtctcacccctagaaaagcctcctcatcgacttatacgcctccttctcttaactcgacgcactagcctcagccaattgtcgcatttcgtcgctatggggtccacagcggccgtctccgtctccgcctcggcgatcgcgtcccgcggctgcgccagatccgaggctgcgcggcggccaggtggaatccgggtctgcggactccggagcgaggccctcacgtgtcactcgcttcggatctcgcaggcgcccgcgaggctgacggtggcgaggccgccgccgccggcggcggcgaccaatggcgcggcggcggggaccctgcgggtcgactacgatctcntcatcatcggcgcgggcgtcgggggtcacggcgccgcgctgcacgccgttgaagaagggctaaaaacagcaataattgaaggagatgttgtggggtgggactttgtgtaaacagaggctgtgtccccatccaaaagcgcttctttgctgtcaccgggcgaatggcgggagcttcctgatggaacatcaaatgaagccctttggggccacagggttccccctcccgggatatgaaaaaacaaactgtttggtgattcagggaaaaaaaccttggcccgcaaaaaacccgttaaaaacttggactaaacccaaggaaaaccccctgggaaggggaaatttttgtgccggggtgtggggccccttttgtgtgggaaaaacaaaaggcccaatttgggaaaaagcggtgttcccccaaaataagaaaaactctcgccggaaaaaacttaatatgccccgcgggttactttcctttttttcccacaagggtgttgaaattggtgggaaaaacgtttttcttctgtaggatctccccgaaaaaagtgggcggctccacaagagagaattctttggtggagaagggcaccggggccctctctccgtgttaaacacaccctcttgagaggagggtcgtctttgtgaacccc

SEQ ID NO: 84826 - protein, 117 aa, Zea mays
  misc_feature: Ceres CLONE 1571002
  misc_feature (82)..(82): Xaa is any aa, unknown, or other
MGSTAAVSVSASAIASRGCARSEAARRPGGIRVCGLRSEALTCHSLRISQAPARLTVARPPPPAAATNGAAAGTLRVDYDLXIIGAGVGGHGAALHAVEEGLKTAIIEGDVVGWDFV

SEQ ID NO: 84827 - DNA, 826 bp, Zea mays
  misc_feature: Ceres CLONE 1571005
  misc_feature: Encodes the peptide sequence at SEQ ID NO. 84828
  misc_feature (687)..(687): n is a, c, t, g, unknown, or other
  misc_feature (746)..(746): n is a, c, t, g, unknown, or other
ctccccgcggtggcggccgctctagaactagtggatcccccgggctgcaggaattcgtctcacccctagaaaaaattgctcaagctgctcccaactcccatcctccccctcccggagtacgaagtactagaaagagagcggctttcctctaagaatggcgggtggcggcgccggcgacgacgacctggtggtggtgagctgcggcggcagacgcggcggcgaccccggcgcatactccgcggtgctcaagaggaagctcgacctgtactgcgccgccgtcgcctaatccgtggaagctaaatcacaagaacattcgttgggctaccccaactcacaagcttcatgatgcttcgcaattgatttctcaagcttcctttgatggtgacatatatggggcaagcctagttactaactctaatgtcgtataacatgatgattttcaaggcaagccaaccaacagtggcacatcaaaggaactgtcagacgatgatggtgaccttgaacagaatactgaccccgctaacgcctagaagatgaggagaatggtgtcaaaccgggaatcggctacgcgatcacgaaagaggatgcgagcacacttgaccgatcttgaatcacaggtttccaggttaacgtctgagaatgcatctatgctgaagcgattggctgatatgactcagatatacgacnacgcttcccgttgacataaaaatctcacagttgatgttgagactatgaggactaaaggntctttcatgctgtatgcatcacagaccgtcttccgtctttttttttgttgtacgagaactcctaactgcctccagtcatc

SEQ ID NO: 84828 - protein, 55 aa, Zea mays
  misc_feature: Ceres CLONE 1571005
  misc_feature (2)..(55): Pfam Name: bZIP_1 Pfam Description: bZIP transcription factor
  misc_feature (52)..(52): Xaa is any aa, unknown, or other
MRRMVSNRESATRSRKRMRAHLTDLESQVSRLTSENASMLKRLADMTQIYDXASR

SEQ ID NO: 84829 - DNA, 1274 bp, Zea mays
  misc_feature: Ceres CLONE 1571006
  misc_feature: Encodes the peptide sequence at SEQ ID NO. 84830
  misc_feature (56)..(56): n is a, c, t, g, unknown, or other
  misc_feature (64)..(64): n is a, c, t, g, unknown, or other
  misc_feature (68)..(68): n is a, c, t, g, unknown, or other
  misc_feature (1149)..(1149): n is a, c, t, g, unknown, or other
tcattttcttttttcatttctcctccctccttccttttatatccataccctatttnttcttttnttcntttatgctggagctcaccgcggtggcggccgctctagaactagtggatcccccgggctgcaggaattcgtctcacccctagaaaaagagcaccagaggcgtagcgcaaaatgttcaagttcctcaaggaggtggtcgcgggatccggatcgggactcaaggacttcccctacaccatcggtgagccctacgcatcggcttgaggctcatggaaacaccaccgcgatacctccaaggatgatgggtcgcctgagtcaattttttctctgtcatggagctaccctcaggacagacacatggttgctggtcgcaatggcgttaagagattaacaaaagtgcggcctccaaataccttatcctttatacaaagcactgaagcagaagctgcggatggacctgccttcccccccccaattttattggaaacgaacctggtatgccacctttctaaaaacctcaaggaaactgaatcctgggtggtatcaccaaaaagatgaattcctttgcctggggggtctttttcaaaatattccaaagcccgcgatcctttccctcaatatttgcctgccaaacttttttcaaccgggcaaaagctctttcttttggtcccacggtcttcttgtgcttgtctaccaaagacccttcggcaattgttgaacgctttcattggcattttttcgaatggacccctgcacacctgcaaatttgcacaatatacgctaaaattcaatgtaataatcgcctcccctctgtgattataactctctccccgttttacttttctcacatgttctctttataaatgattcatacagattgtagagagatattccccccttaggcaaactagccctcacaatacgtgtccacctagtctcatatatttctcccgaacctagtggcggcgtctacactatcaccataaataaagctactcacaccctcttggggggacactatgtgtgtctccctctgtcggggaaatcaacaggatgtccttctacatgcaatatcttcacacatatttttctgtgtattagcaaatccgttctgtctcgctaattaccgcgcatctaatcganataatatgctgttctgctcattgcacaaaaggcctcgattcctatttaggagtcacccctgagcaagtcagctttgagcatttccgctctcttttcattctatatatgatacgtatagaaaattg

SEQ ID NO: 84830 - protein, 30 aa, Zea mays
  misc_feature: Ceres CLONE 1571006
MFKFLKEVVAGSGSGLKDFPYTIGEPYASA

SEQ ID NO: 84831 - DNA, 874 bp, Zea mays
  misc_feature: Ceres CLONE 1571007
  misc_feature: Translation starting site: 303
  misc_feature (532)..(532): n is a, c, t, g, unknown, or other
  misc_feature (535)..(535): n is a, c, t, g, unknown, or other
  misc_feature (592)..(592): n is a, c, t, g, unknown, or other
ctccccgcggtggcggccgctctagaactagtggatcccccgggctgcaggaattcgtctcacccctagaaaaaacgcctcccacttctctccctctgcaactgctcaccccctgtgaaagcgcgcgagcgtggagaagagtagggaggaagttcagttccgtgccgtgctcgcgcgcacccaccccgcacgccgcatgccgccttttactccgcgctgctgctgctgctgggacgaagaaaatcttttccttcacctttctctcctctttcccagttcatgcacgggctctgattgacgccatgggggatgccgccgccgccgcaacggcctccacgtccgctcccgccacgcccacctccatcctcatctgcctggaggacggcagcgaccttctctccgacgcctacgatggcgccggcgccaccgacttcgtcgtcgcccgcgacgagcatctgcttgtcgaggaccagacgaggagtacgtcgcgctgctcctgtccaaggagagcgcggcagtatgcgccccggcnggnagagaaacggaggagtggatgaagaccgcacgctccggatgcgtccgctggatcatncagacacggcgatgttcggggtcggcgggaagacgcgtacgtcgagtgacttacctcaatcgcttccgggttcaacggcgagtcaagtaactgccctattagtaaccctgcatttccatccgcgtcgccattgcgggtttccttttttctttccgtttgggggggttccaaggagtggccgaaatggcctgaagggacctgggggccccttttgggtcgggggaaaaaattattgcctcaaagggggaaaccaggggggtttttgggctctcacccgggggc

SEQ ID NO: 84832 - DNA, 771 bp, Zea mays
  misc_feature: Ceres CLONE 1571009
  misc_feature: Encodes the peptide sequence at SEQ ID NO. 84833
ccccgcggtggcggccgctctagaactagtggatcccccgggctgcaggaattcgtctcacccctagaaaaaactggactgccctgccagtgctcggtgcccgtgcccgcgcgcgctagcctagctgctcctgcctggttcgccgtagcccgtagcccgtagcacaacaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcggcaggccgtcatgctgatcggcggcggcctgttcttggccggcgccctcgtcaacgccgccgcggcacacatcgccatgctcatcgtccggaggatgctgctcggcctggggcttcggcttctccggccagcccaccgcggtgtaccctccgccaaagtgtccccccccgcgcctggcgcggggggtttct

SEQ ID NO: 84833 - protein, 174 aa, Zea mays
  misc_feature: Ceres CLONE 1571009
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTRRLGRQAVMLIGGGLFLAGALVNAAAAHIAMLIVRRMLLGLGLRLLRPAHRGVPSAKVSPPAPGAGGF

SEQ ID NO: 84834 - DNA, 752 bp, Zea mays
  misc_feature: Ceres CLONE 1571010
  misc_feature: Encodes the peptide sequence at SEQ ID NO. 84835
ctccccgcggtggcggccgctctagaactagtggatcccccgggctgcaggaattcgtctcacccctagaaaaacccttctgctttgccgttttccccttcctctctcccctgtcccccctccgtcccagccgagcgagaaagcgaaagggccaaaaaagccacaccggcttccttcccccacccgaagagatggaactgttctacgaactgctcctcacggcggcggtcaccctcctcgctgccctcctgctcgccacgctcttcgcagccaatgattcccatcgccggaccgatcgcgccgcagccgctatcgccgaggaggtggcggaggaggagaggatcatcgaggtcgacgaggtgatgcgtatcgaagggatggcggcggtggcgccgtccgaggcggatgggtgggttgaggcggataatgcgcccgcggtggtcgtcacggaggtgaacgaccggaagccttgccgaggaggagggcgttccgtgtaagctgttcagggaggtgcgctcgctgccataaatggaggaggcggatgaccctccttgcctcattgtaatccctgttttaactccggaactgctgttgccccgtgccgtccccaaatctacccttaaggtgacgggctctgaaagcaaaaccataggatggtcccgggccccgcctaggttagaacaaccaaaacatgccccaattgtattggggaaccctcttggttccccggggcctggaggattggaataatc

SEQ ID NO: 84835 - protein, 101 aa, Zea mays
  misc_feature: Ceres CLONE 1571010
MELFYELLLTAAVTLLAALLLATLFAANDSHRRTDRAAAAIAEEVAEEERIIEVDEVMRIEGMAAVAPSEADGWVEADNAPAVVVTEVNDRKPCRGGGRSV

SEQ ID NO: 84836 - DNA, 811 bp, Zea mays
  misc_feature: Ceres CLONE 1571011
  misc_feature: Encodes the peptide sequence at SEQ ID NO. 84837
  misc_feature (384)..(384): n is a, c, t, g, unknown, or other
  misc_feature (405)..(405): n is a, c, t, g, unknown, or other
  misc_feature (417)..(417): n is a, c, t, g, unknown, or other
acccgcggtggcggccgctctagaactagtggatcccccgggctgcaggaattcgtctcaccccctagaaaaattttttcaccgcatctgcatcctctcgccatggcgccgccgcccgcgtcgcctgctgactcggtccctgatccaaggccgaccgccagcgcgcccgtgcccatcaccgtgccgagcccgcgtgaccacgcgcaccaccaccacctggtagatcgtcgggacacgccgcggggccgcgcgtgggaaccggagcggaccggccggagaggcgatggacggtgctgcagcggcaagctggtacccggtgaggccggtacgtcttaaagacgtgccgcacgtgtcggactacctcccgatctcccgacctactcnaatccatttacagataacccnggcatactctgnttgtgaagcagtacttttgtaaaccccagatgacaccggtctgcccagaaggattgtttgttcaccaagggatggggccccagaggggaaacaaccttcccgttccgtgccggggaccttcccccccaaaaggggttatttttttgaaacccggaaagaagggtccctgggcctggcttttggtcccctttgtggggagaggaattgggcccccccgggaaacttaaaaaaccgtggggattaaagaaaaaaatttgtttggggggccttttttcccgaaaaaagtgttttggggggggccccccccaaaaaaaaaatttggggggaatttcaggggggggggggggaacacaaggggggtttttttttgttttgttctcccaacaaaccaccc

SEQ ID NO: 84837 - protein, 111 aa, Zea mays
  misc_feature: Ceres CLONE 1571011
TRGGGRSRTSGSPGLQEFVSPPRKIFSPHLHPLAMAPPPASPADSVPDPRPTASAPVPITVPSPRDHAHHHHLVDRRDTPRGRAWEPERTGRRGDGRCCSGKLVPGEAGTS

SEQ ID NO: 84838 - DNA, 833 bp, Zea mays
  misc_feature: Ceres CLONE 1571012
  misc_feature: Encodes the peptide sequence at SEQ ID NO. 84839
  misc_feature (565)..(565): n is a, c, t, g, unknown, or other
tacccgcggtggcggccgctctagaactagtggatcccccgggctgcaggaattcgtctcacccctagaaaaaacggtcatgccccaaattcttatgcttttcgaaaattacaatcacccacccccaataaaagcgcccacaccctcctgcacctcccttcctcaacctccgccatcaccgacgctgactcccacaccggccgccgcgcgagccccggcaccatctccgcacgagcagaaatgggggatgcgtgtttctcaacacagctaattgatggagatggggtcttcaacgtctctggattggagaacttcatgaaggatgccagattgggtgaatgcgggctctcctatgctgttgtatcaataatgggcccgcaaagtagtgggaaaagtacacttttgaatcatctttttggcaccaattttagggagatggacgccttcagaggaaggtcacagactaccaaatgtatatggttagcgaaggcccagaatattgatccgtgcacccttgttatggatttggaagaactgatggaagggagagggagaagattacacncatttgagaacaaaatgcatgtttgcttggcccgttcaaacttgggttgataaaaaggggggccagaaattggaagaaaaaggctgcaaaaaacctctttgaaaacggtttccgggccagatgagggtggccaaccccccaaaaaaaaattgttgtttggcttccggaaaaaacaaggaccccctaaaaaatttgaccctttttaagggaaaaattcaaaaaaagtgggaggggttcacaaaccccgcgcccaaaaaacccccccctg

SEQ ID NO: 84839 - protein, 124 aa, Zea mays
  misc_feature: Ceres CLONE 1571012
  misc_feature (109)..(109): Xaa is any aa, unknown, or other
MGDACFSTQLIDGDGVFNVSGLENFMKDARLGECGLSYAVVSIMGPQSSGKSTLLNHLFGTNFREMDAFRGRSQTTKCIWLAKAQNIDPCTLVMDLEELMEGRGRRLHXFENKMHVCLARSNLG

SEQ ID NO: 84840 - DNA, 737 bp, Zea mays
  misc_feature: Ceres CLONE 1571013
  misc_feature: Encodes the peptide sequence at SEQ ID NO. 84841
acccgcggtggcggccgctctagaactagtggatcccccgggctgcaggaattcgtctcacccctagaaaaaatctccaacctcgagagcccaccaaacccaaagcccaggcctctccgtccccaatcccccatccggcttgccccccatgtcgtcgcagtgcccctactgccgcgcgtcggggccggcgcggtgcgcgacgacgcagccgccgctctcgcgcgccgtctccgagtgctccgcctgcgcccgaatcgtcctcgagcgccacctccacacgcaccccttcttccccctcctcccctcactccatccgctcccccttgtcacccccgacctcgccacagccatcgatcccgccccgtctccttcccccggcgacgaagatgacgaggacccctttctccccgcgggcttcgtctccgccttctcggctttctccctcgagcgccaccccgtcctcgcccgctccgcctccaccttctctggacacctcgccgagctcgagcgcgcgctcgctgtcgactccgccaccgcggcctccaacccggaccccgccggccccatggtctccgtcgacagcctccgcgcctacctccagatcgtcgacgtcgcctccatactcaggctcgacagggacatagccggatcacgcttttcgagctccttcaaggattgctccgtccgccgacttggcctcaagaaatcggaagcgtccgagggcgcctccgcaacca

SEQ ID NO: 84841 - protein, 57 aa, Zea mays
  misc_feature: Ceres CLONE 1571013
MVSVDSLRAYLQIVDVASILRLDRDIAGSRFSSSFKDCSVRRLGLKKSEASEGASAT

SEQ ID NO: 84842 - DNA, 838 bp, Zea mays
  misc_feature: Ceres CLONE 1571015
  misc_feature: Encodes the peptide sequence at SEQ ID NO. 84843
  misc_feature (374)..(374): n is a, c, t, g, unknown, or other
ctggagctccccgcggtggcggccgctctagaactagtggatcccccgggctgcaggaattcgtctcacccctagaaaaaatcgcaaacaccagcggcggcgccgggaccccgaaaaccctctccccgcgcaccacggccaacaggaaccactccgctcttccgagccctagccgtcccgggccgggccgggctcccctacatgacgccggcgtgaggcaggcgcttagtggatcgcgctggtgggaggatgcagggcagtgtcatggcccatgccgccgcggcggcggcggccgcgtcgacggtgaccacggcggtggcgcccccagtcacggcgcacgcggtggcggtggcgcccccggtcacggcgcatcntgctggcggcggcgggcaacggcagcgccaccgccgcgccgccggcgccgttcctcatgaagacctacgaggtggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaaggttgatccagacagatgggaatttgcaaatgagggttttctgagaggacagaagcatctgctgaagactattcacagaaggaaaccatccttgcaggggaacagccaaccacagcaacctcagtcgcagaacgctcctgtgccttcctgtgtaaaggttggtaaagttggggttggaaggaaaaaaaatgaaacgggttaaaagggaataaaaaaggtcttttag

SEQ ID NO: 84843 - protein, 127 aa, Zea mays
  misc_feature: Ceres CLONE 1571015
  misc_feature (2)..(128): Pfam Name: HSF_DNA-bind Pfam Description: HSF-type DNA-binding
MKTYEVVDDPATDDVISWGPGNNSFIVWNTPEFARDLLPKYFKHSNFSSFVRQLNTYGFRKVDPDRWEFANEGFLRGQKHLLKTIHRRKPSLQGNSQPQQPQSQNAPVPSCVKVGKVGVGRKKNETG

SEQ ID NO: 84844 - DNA, 893 bp, Zea mays
  misc_feature: Ceres CLONE 1571016
  misc_feature: Encodes the peptide sequence at SEQ ID NO. 84845
  misc_feature (510)..(510): n is a, c, t, g, unknown, or other
  misc_feature (521)..(521): n is a, c, t, g, unknown, or other
ggagctccccgcggtggcggccgctctagaactagtggatcccccgggctgcaggaattcgtctcacccctagaaaaaaaagacgctgcgggggacgcattccctctccgtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccntggaggcggcngctaccgctgtggcgggcgccctgatggccgcggcggctacggcggtggccgccgccgctaccgtggcggcggcggttacggtgggggggggcggcggctacggcggtggcaaaccgggggggcgggctagggaaactcccacgggaaactggaggaacttgaccggtgggggccacccccgtgcaaatttatcctgtttccctacccggggtgtttttcccccatttcccaagagggttttttcttccccttccgccccacgggtttgggtggtgcccccccccgggggtttttttaaaaggcacggggccccctttttgtgtcccagttgtttaagaggcgtgggttttccaccccctggggtacccccg

SEQ ID NO: 84845 - protein, 147 aa, Zea mays
  misc_feature: Ceres CLONE 1571016
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (101)..(101): Xaa is any aa, unknown, or other
  misc_feature (105)..(105): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGXGGGXYRCGGRPDGRGGYGGGRRRYRGGGGYGGGGRRLRRWQTGGAG

SEQ ID NO: 84846 - DNA, 909 bp, Zea mays
  misc_feature: Ceres CLONE 1571017
  misc_feature: Translation starting site: 188
  misc_feature (813)..(813): n is a, c, t, g, unknown, or other
  misc_feature (870)..(870): n is a, c, t, g, unknown, or other
  misc_feature (871)..(871): n is a, c, t, g, unknown, or other
  misc_feature (876)..(876): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (893)..(893): n is a, c, t, g, unknown, or other
  misc_feature (894)..(894): n is a, c, t, g, unknown, or other
  misc_feature (896)..(896): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (908)..(908): n is a, c, t, g, unknown, or other
  misc_feature (909)..(909): n is a, c, t, g, unknown, or other
ggagctccccgcggtggcggccgctctagaactagtggatcccccgggctgcaggaattcgtctcacccctagaaaaaagtccaccaccacacaagaagaggcccccagccagccagtccacagctctccactcgagaaacctccagtccagctccacccttcgtccagaggcacaccacacacaccatggctcccagcaagcttgcggtggtcgtcgccttgatagcgtcgctcctcctgctcaccaccagcaacaccaagcttggcctgttcgtgctcggccaggctgctccgggcgcctacccaccacgggctcctccgccgcaccagatcgtcgaccccgccaaagactgcgggggcgcgtgcgacgtgcggtgcggcgcgcactcgcgcaagaacatctgcacccgggcggtgcctcaagtgctgcggcgtctgccgctgcgtgccggcgggcacggccggcaaccagcagacctgcggcaagtgctacaccgactggaccacgcacggcagcaagaccaagtgcccgtgactccttgtccttgatgagagcagcatgagtccatggggcggcgggcgcgccactgcccacactggcgcgcacgttttgtatgatccgaccccgtcggcgtagatgtgcgagcctgtagctatctagcttagatgtacgaggttgatgtgctctgctgtttgtttgttgctagtacttctatagggtatctttgtgttgaagttgaagggtctggtgtcttgtgtaaaaaaaaggtgtgggaagcgtttccccgtacagtaaaatccatctgggtggnatcaaaaaaaagaaatccggcccactttgggaaagaccggaagactccccccacaannccccnannnncggcnnnncagnngntgggnnncaagnn

SEQ ID NO: 84847 - DNA, 817 bp, Zea mays
  misc_feature: Ceres CLONE 1571018
  misc_feature: Encodes the peptide sequence at SEQ ID NO. 84848
ccgcggtggcggccgctctagaactagtggatcccccgggctgcaggaattcgtctcacccctagaaaaaaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattggctgagggtggttaggtcgtagcagctggggctaatcctgttccgattactcggggtattgagaaacagctaaagcactagttgaagaaactccggagtgttctaggagggttaagatagtgagcttgcagatgttgctccagttatgctgggcacacctttaaattgggtacatgattgccgaggcatgaacagggtcggtcggaaag

SEQ ID NO: 84848 - protein, 135 aa, Zea mays
  misc_feature: Ceres CLONE 1571018
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIG

SEQ ID NO: 84849 - DNA, 800 bp, Zea mays
  misc_feature: Ceres CLONE 1571019
  misc_feature: Encodes the peptide sequence at SEQ ID NO. 84850
  misc_feature (753)..(753): n is a, c, t, g, unknown, or other
ccgcggtggcggccgctctagaactagtggatcccccgggctgcaggaattcgtctcacccctagaaaaaaccctccgctccgccgcccctcttcattttttattgctccccccggcgccggccccggtctctccagtctccacccacgtatccgcggaggcggaggagctgccctgccgctcagagaaatcggcgcgcccatcccgtctcccccctggcgattcattcggccgcccaaacccacagggagtcgcagccggaggagggaggcgtgctggagtccgtccaaggagcgcagcacacgagcaacgtacgagggaaaggggaaacaaagagccttctccgatcgtcgccagctagctacccacctgtcctccggatgtcctggagttctgcatgcccatggaaaactcagttcgccgcgtgagatgcccgagatgccgcagcgttctcgatgagcccagcgcgccggtgtaccagtgcggcggatgcggcactagccttcgagcaaagaaccgcaccggcaccggcaccggcagcacgggagacgcggccggtgcgtcgccggcgcggagctgggcttctcctcagagcaggcacctggacgccagcgacgtcgcgagcaccagcagggtcagcaccccgacccctcctcgtgtcgggagcaccagcaggtctgggaccccgaccccctctgacgtcgggaacagctggcaccgagaacccgacgcgacaggcacccggcatgggtncggtgatctcgctctcctgtcggccgggaccctggggtccggtgact

SEQ ID NO: 84850 - protein, 134 aa, Zea mays
  misc_feature: Ceres CLONE 1571019
  misc_feature (119)..(119): Xaa is any aa, unknown, or other
MPMENSVRRVRCPRCRSVLDEPSAPVYQCGGCGTSLRAKNRTGTGTGSTGDAAGASPARSWASPQSRHLDASDVASTSRVSTPTPPRVGSTSRSGTPTPSDVGNSWHREPDATGTRHGXGDLALLSAGTLGSGD

SEQ ID NO: 84851 - DNA, 833 bp, Zea mays
  misc_feature: Ceres CLONE 1571020
  misc_feature: Encodes the peptide sequence at SEQ ID NO. 84852
agctccccgcggtggcggccgctctagaactagtggatcccccgggctgcaggaattcgtctcacccctagaaaaaagcagatccaccggcacgagaccgaccccgtttcctcgctccttcgtctctcgctgacactgtttgacccctgtcctccaggctcggctccagctaaggtcgagcggcgaggcgacagccctagtgtagcgcggcgcggtaccatagatggggagacgaatggaggccccctcctcgccggcgtccctcgtcgtcgtcctcctcctcggctcgctgctcctgcaggcacgcgccgatgacccctacaggttctacacctggaacgtcacctttggcgacatctacccgctcggcgtcaagcaggaggggatactgatcaacggccagttcccggggccgcagatcgacgccgtcaccaacgacaacatcatcgtcaacgtcttcaacaacctgccggtccccttcctcctctcctggcagggaattcagcagcggaggagctcatggcaggacggcgtgtacggcaccaactgcccgatccctccgggcggcaatttcacttacaacatgcagttcaaggaccagatcgggagctactactacctcccctccccttctggttcacaaggcagcctgcggttacggggccatcaggggttcccaagcggccgaagatccctggtccgtttgacccgcttgccggggattcaccctattgggggggggaactggttaaagctcaacccaccccaacctgaaagggcttcttggaacatgggaattgaaccgcccttttcctgaaaggcccttttttaat

SEQ ID NO: 84852 - protein, 197 aa, Zea mays
  misc_feature: Ceres CLONE 1571020
  misc_feature (39)..(150): Pfam Name: Cu-oxidase_3 Pfam Description: Multicopper oxidase
  misc_feature: SWISSPROT Homolog: EC 1.10.3.2 Laccase
MGRRMEAPSSPASLVVVLLLGSLLLQARADDPYRFYTWNVTFGDIYPLGVKQEGILINGQFPGPQIDAVTNDNIIVNVFNNLPVPFLLSWQGIQQRRSSWQDGVYGTNCPIPPGGNFTYNMQFKDQIGSYYYLPSPSGSQGSLRLRGHQGFPSGRRSLVRLTRLPGIHPIGGGNWLKLNPPQPERASWNMGIEPPFS

SEQ ID NO: 84853 - DNA, 828 bp, Zea mays
  misc_feature: Ceres CLONE 1571027
  misc_feature: Encodes the peptide sequence at SEQ ID NO. 84854
tccccgcggtggcggccgctctagactagtggatcccccgggctgcaggaattcgtctccccctagaaaaaagagcattgcttccgtgtggtgcggttgatagctcggatcttctgctggccgagttcgtcttggaggagaagagagagagagagagagagagagagcgccgggatcggagccaggaagcatccagcagcgatggcgggcggaggggtggcggcgctgggcgtgaagacggagcgcgcggcgcagtacaaggggcgcatgacgctcgccgtcgccacgacctgcctcgtggccgccgtcgggggcgccatcttcggctacgacatcggcatctccggcgtgacatccatggacccattcctggagaaattcttcccggtagtgttccaccggaagaactccggcgggaagaacaactactgtaagtacgacaaccagggactagcggcgttcacatcgtcactctacctcgccggcctcgttgcctccctcgtcgcgtcccccgtgacgaggaactacggccgcaaagctagcattgtctgcggcggcgtgagcttcctcatcggcgcggccctcaacgtggccgccgtgaatctggctatgctcatcctcgggcgcatcatgctcggcgtcgggatcggttttggcaaccaaggctgtgccgctgtacctgtccgaagatggggccggcgcaccttccggcgggggcctggaacatgaaggttccagcttcgcgaccaacgcctggggcatctttcccgggggaaccttgaatcaacctaggggcacgccagaacatttcaagcccggggggggggt

SEQ ID NO: 84854 - protein, 175 aa, Zea mays
  misc_feature: Ceres CLONE 1571027
MAGGGVAALGVKTERAAQYKGRMTLAVATTCLVAAVGGAIFGYDIGISGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQGCAAVPVRRWGRRTFRRGPGT

SEQ ID NO: 84855 - DNA, 786 bp, Zea mays
  misc_feature: Ceres CLONE 1571028
  misc_feature: Translation starting site: 171
ctccccgcggtggcggccgctctagaactagtggatcccccgggctgcaggaattcgtctcacccctagaaaaattcttctctctccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgttcaactggcgggtggtggtcgccaccgtcgtcgggttcctcggttccgcgtttggcaccgtcagcggcgtcagcggaggcgggatcttcgtgcccatgctcaacctcgtcgtcggcttcgacaccaaatcgccgccgcgctctccaatgcatgatcatgggggcctcggcgtcatcagtttggtacaacctccaggtgtcgcacccgaccaaggaagcgcccgtcatcgactacaagctcgcgttgctctttcaggccatgtctatgctcggcataaccatcggcgtagagctcagcgtcatcttcccatacgggctaaacacgtgtctcaattataatcctcctcgtaagcacctccgcccaaaatccttctacaagggcattcctgaatggtgaaaggaaggt

SEQ ID NO: 84856 - DNA, 935 bp, Zea mays
  misc_feature: Ceres CLONE 1571032
  misc_feature: Encodes the peptide sequence at SEQ ID NO. 84857
  misc_feature (766)..(766): n is a, c, t, g, unknown, or other
  misc_feature (910)..(910): n is a, c, t, g, unknown, or other
ctccccgcggtggcggccgctctagaactagtggatcccccgggctgcaggaattcgtctcacccctagaaaaaatccggccaagcgggactagtccctgtcgtctgtccaccaccctctgcgagtacgtctcctcctcccgtctgtctctctctgtgtgtcggtctgccgttcccgccgccgccgccgcagatgggcctgttcagctcgccggccaaggtgtacaagccggccgccgacgtggacctcggccccggcagcgacgagctctacatcagccccaatgtcaaagctcctcgggtcgccgggctcctggtgaagatcttcgtgtggatcctggagatgcccatcgtcgggcagatcgtgctctacatcctgaagaaggacaacctcatcaacaaggtgcaaagtccatccatctctatcccccttccgtgaaaactccgctgaattcaagaatcaaacctcttttctgccaacgcttccgtcaaacgaactgaaagtttggccccaagtttgactagttcagacgctgcctgcctgcctgcctgtgaaacgaactgaaaggcacgtacgccactgtggccacaagagtgttctgcagtatagttcagcgtcttctctgaccgcttctacttgtacttgtacccactgttggcagctggtgtccgacgccgacatcccggagccgccgctgttcacggcatcgcacagctgggtagacaccccggagcagagcgtgcggctgtacaagcccgtactgtcngctgctgatcgggtccaggaagccgtgggctgcctcccgggcgcgctggatggcgcgctggccgccgacccgcgcggcatcaggcgctgggaccgtcgcgacttctccgacgcgtacaggtcggcgaagtgacgccctgtcagntggcggctaggttctcgccggcggg

SEQ ID NO: 84857 - protein, 81 aa, Zea mays
  misc_feature: Ceres CLONE 1571032
MGLFSSPAKVYKPAADVDLGPGSDELYISPNVKAPRVAGLLVKIFVWILEMPIVGQIVLYILKKDNLINKVQSPSISIPLP

SEQ ID NO: 84858 - DNA, 831 bp, Zea mays
  misc_feature: Ceres CLONE 1571034
  misc_feature: Encodes the peptide sequence at SEQ ID NO. 84859
  misc_feature (640)..(640): n is a, c, t, g, unknown, or other
  misc_feature (731)..(731): n is a, c, t, g, unknown, or other
  misc_feature (732)..(732): n is a, c, t, g, unknown, or other
ctccccgcggtggcggccgctctagaactagtggatcccccgggctgcaggaattcgtctcacccctagaaaaaacgtacgccagaacccctctctcccccctccttctgcagccatgctcctccacctgcttccgctctcctgccccgcgccgccgttccacctgcgcaggaccggcggctcgccgcgggtccgcgccggggatagggccaggacacgggggctccgggggacggacgtggagccggagacagcgccgcgaaggcgccgcagccgcgatggcgacgatcctcaagcggctgggagcggtggagacaccggggcgctgctggcgtcggtcaggaggcttctgctctccgaggcgcctgcggcggcggagggagacagtgaggaggagcagggacagttccccaagcgttgggccatcgtcttcctctgcttctccgcatttctactctgcaacatggaccgcgtaaatatgagcattgctattctgcctatgtccgcagagtttggttggaacccacagactgttggtctcatccagtcatctttcttctggggctacctcctaactcagatagctggagggatatgggcagatactgttggaggaaagactgtccttggttttggtgtnggtttggtggtccatagctacagctcttactcctgttgcagcacatcttggcttgccatttcttcttgttgtgcgggctttcatgggaatnntggtgagggggttgcaatgcctgcaatgaaacatattctttcgaaatgggttcctgtatcagagaggagcagatcattgtctcttgtgtacagtggaat

SEQ ID NO: 84859 - protein, 238 aa, Zea mays
  misc_feature: Ceres CLONE 1571034
  misc_feature (206)..(206): Xaa is any aa, unknown, or other
MLLHLLPLSCPAPPFHLRRTGGSPRVRAGDRARTRGLRGTDVEPETAPRRRRSRDGDDPQAAGSGGDTGALLASVRRLLLSEAPAAAEGDSEEEQGQFPKRWAIVFLCFSAFLLCNMDRVNMSIAILPMSAEFGWNPQTVGLIQSSFFWGYLLTQIAGGIWADTVGGKTVLGFGVGLVVHSYSSYSCCSTSWLAISSCCAGFHGNXGEGVAMPAMKHILSKWVPVSERSRSLSLVYSG

SEQ ID NO: 84860 - DNA, 821 bp, Zea mays
  misc_feature: Ceres CLONE 1571035
  misc_feature: Encodes the peptide sequence at SEQ ID NO. 84861
  misc_feature (506)..(506): n is a, c, t, g, unknown, or other
  misc_feature (549)..(549): n is a, c, t, g, unknown, or other
  misc_feature (658)..(658): n is a, c, t, g, unknown, or other
ggagctccccgcggtggcggccgctctagaactagtggatcccccgggctgcaggaattcgtctcacccctagaaaaaaggcgagacgaggaagaggaagaactgcccagccgtaccctccatacaatccaaagtaccgaaaaccaagggcgggcggggacggcgtaggcgcacgcgcacacgcgctccaacctccaacacccctcttctcctcactcctccctcgcttgtcggcttgtcgctccgcttctccccagcagctagagcagagcccccttcacaccaaaaatttcctctttgcgtcgcgccccgccagctgggtccccgcggatgggctcggtctcgcggggctagggtttggtcggtcgtctcgtcggcgtcgagggcgccggcgctgctagctagtagctcgctcgcgctagggttctcaggagccatggtgatgcagcgcttctcgtggccgtacggaggccggagcgcctcctttgtgcgcagcttcaccgggntggagggagtatcccatggggctggtcgggggccgaagttcangtcgtcttcgatctgcctcccgggggttaccagtacgggtttttggttgatggtgtctgggagtgtgatgagaacaaaccctttgtatgggataaaatggactgatcanccatgaatggtttgtggaaaacaagggcaaacctgtttggcacccaaaacttttattaaagaaacaaatttgggagaagggtcccgtttttaaaaaaaaggcccccccgggttttttttttcaaaaaccgggggggggaaaaaaaaagtttttccccccgggt

SEQ ID NO: 84861 - protein, 75 aa, Zea mays
  misc_feature: Ceres CLONE 1571035
  misc_feature (24)..(24): Xaa is any aa, unknown, or other
  misc_feature (38)..(38): Xaa is any aa, unknown, or other
  misc_feature (74)..(74): Xaa is any aa, unknown, or other
MVMQRFSWPYGGRSASFVRSFTGXEGVSHGAGRGPKFXSSSICLPGVTSTGFWLMVSGSVMRTNPLYGIKWTDXP

SEQ ID NO: 84862 - DNA, 773 bp, Zea mays
  misc_feature: Ceres CLONE 1571036
  misc_feature: Translation starting site: 183
acccgcggtggcggccgctctagaactagtggatcccccgggctgcaggaattcgtctcaccccctagaaaaagtttccccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccaccctctgtggttcttgctcaggggctgatcgctgagggtgttaaggttgtggcagctggtgctaatcctgttcagattactcgtggtatcgagaaaacagcgaaagcactagttgaagaactacggaagttgtctaaggaggtcgaagatagtgagcttgcagatgttgctgctgttagtgcgggcacaactacgaaattggtatatgatagcagagc

SEQ ID NO: 84863 - DNA, 905 bp, Zea mays
  misc_feature: Ceres CLONE 1571038
  misc_feature (229)..(229): n is a, c, t, g, unknown, or other
  misc_feature (595)..(595): n is a, c, t, g, unknown, or other
aaactggagctccccgcggtggcggccgctctagaactagtggatcccccgggctgcaggaattcgtctccccctagaaaaatccccccagtccccacctcacctcgtcaaccccctccttggatagggttagagttcccccggcacgagcgcgagccatggcctccttcacctgctcccaggtcggcgctgcggcagcgggcggagcctcgcccttcctcggctaccnggcgggcggagcggcccctggggggcgccatttccggtccagcttccctccttcctggggcccggcggttttggccggcccgttgccaaaaagggggggggggccccttttttttggggggggggcccccccggggggggggggctccccccccccccctttttgggggggggtcacacccttgttccggcaaaaaaaaaaaaaaatattttttttttttggggggggggaaaataattctaccccaccccccccttgggggggggggcgcgcgccccccccccccccccaataaaaaaaaaattttcttttccccgcccgcagcgggggggggggggtgactttttaccctacccccccccccgncctctgtgttctcttttttctttgtaaaaagaagggggggagggggggcggcgcaaagcttaaataaaaaatagtgagaggtctgcccacacaatacccgcgccccgtcggtgtgttttttcttgttgcccccccccccgcacaaaaaaaaaaaatttttccctccccaataacaaagaggagaggaggggggggtggtgtgtttcctgtccaccccccccaacccacaaaaaaaataaaaaaaccccctcccccctccccccccccccgcccctataaaagagaaggagggggaggggcgggcgccccc

SEQ ID NO: 84864 - DNA, 791 bp, Zea mays
  misc_feature: Ceres CLONE 1571039
  misc_feature: Encodes the peptide sequence at SEQ ID NO. 84865
  misc_feature (791)..(791): n is a, c, t, g, unknown, or other
ctccccgcggtggcggccgctctagaactagtggatcccccgggctgcaggaattcgtctcacccctagaaaattctcctcctgcgggtctcctcgcccagcggactcctactctgctgcgctccgctccgttccgttccgctcccttcctctcggcagcaatcgaatgtctcccgacgtagacgccgccgtggcaaccgccgtcgctgccgggggaggctgcggcggtgacggagaggcgggcggtggcgcgtcgtcgtccccggcgtccgcggcggcggcgaacgggcgggcgttggtgcggtgggatcagatcctcccgcgccgctccctgcgggtcctcctcgtcgagcacgacgactccacgcgccaggtcgtcaccgcgctgctccgcaagtgcggctaccgcgtggccgcggtcgcggacgggatgaaggcgtggggggtcatgcgggagcgcgcctacgcgttcgaccttgtcctcaccgaggtcgccatgccctccctctccggcatccagctgctctccaggatcgtcgccgccgacgagtgcaagaacatccccgtcgtcatgatgtcatcccaagattctattggcacggtgctcaagtgtatgcagaagggtgcggtggacttccttgtgaaaccagtgagaaagaatgaactgcgtaacttatggcaacatgtgtggaggcggcatgcaatgaattgccagacaaatggatcagaaaataatgcagccagcaatcatattagtgccaacgttgctaatgggtcaaagacaggagaan

SEQ ID NO: 84865 - protein, 208 aa, Zea mays
  misc_feature: Ceres CLONE 1571039
  misc_feature (56)..(172): Pfam Name: Response_reg Pfam Description: Response regulator receiver domain
  misc_feature: SWISSPROT Homolog: EC 3.1.4.17 3',5'-cyclic-nucleotide phosphodiesterase
MSPDVDAAVATAVAAGGGCGGDGEAGGGASSSPASAAAANGRALVRWDQILPRRSLRVLLVEHDDSTRQVVTALLRKCGYRVAAVADGMKAWGVMRERAYAFDLVLTEVAMPSLSGIQLLSRIVAADECKNIPVVMMSSQDSIGTVLKCMQKGAVDFLVKPVRKNELRNLWQHVWRRHAMNCQTNGSENNAASNHISANVANGSKTGE

SEQ ID NO: 84866 - DNA, 1075 bp, Zea mays
  misc_feature: Ceres CLONE 1571040
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (307)..(307): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (315)..(315): n is a, c, t, g, unknown, or other
  misc_feature (318)..(318): n is a, c, t, g, unknown, or other
  misc_feature (319)..(319): n is a, c, t, g, unknown, or other
  misc_feature (322)..(322): n is a, c, t, g, unknown, or other
  misc_feature (339)..(339): n is a, c, t, g, unknown, or other
  misc_feature (876)..(876): n is a, c, t, g, unknown, or other
ggagctccccgcggtggcggccgctctagaactagtggatcccccgggctgcaggaattcgtctcaccccctagaaaaaaccgctctctgactcttcatccacgaaccacatcaaaactgatcaactctctccctctgcttcccgctagagcaaacgccacgagagtcgcgattcttccaccacttccacgggaccggtcggatccaatccgctgccgcccagccaccgccaccgccgccgccgccggctcctctataggggtcttcccccccccccaaannnnnnttnnnnntnnnaannnnnaantnnnnagnganngangagtatttttctccccntcccttggagcgactcagtggatgcgaggaaactgtgcgcgctaaacccaccttcaccccccccccggtgcgggggggggaggctcctgctcgggcctttctgttcccggaaatacccgcaggcccatgggctattggggacgtcgttccctctcctgcaattcccaaacgaagaaggcgccctgtcgtgatcccccctctccccaaatccaaataaactccctctccttggtaagaatttttggaatttccttgggcccgccccggtaaaaccaatttttcttctcatacagccccggtttcgggtgcttttttccttctcccgaaaaggggtgaaacaagagttgtttgactttctgtagggaccctgttcaattcctggttattatgtggtgaatgtacccccgaccccttctccgtggttaggctcccccctactccgccgcgctgttttgttgttgcttctttctctgtacaagtataagagctccagccaccttgtgggatcaattaatagtcgacatctggtcgggcggnttatggactggctctttgtggctgcgcagctatgcttattaagggtataatatatagcggcggatggtggaggaaaacgtagagaaacaaactctgtgaatccggcgtcgactatcattagacacttcggggaggttgctagtccgtttggtttcgcgcctatctacatcctgtggctattgtctcgtttgcagtctcg

SEQ ID NO: 84867 - DNA, 854 bp, Zea mays
  misc_feature: Ceres CLONE 1571042
  misc_feature: Pfam Name: SMC_N Pfam Description: RecF/RecN/SMC N terminal domain
  misc_feature (599)..(599): n is a, c, t, g, unknown, or other
ggcggccgctctagaactagtggatcccccgggctgcaggaattcgtctcacccctagaaaaataagcaattggttgaattaaaagagctttatgatgctgaacaacgtctgagtgcagagttgggtgaagaacttggaaagactcggaaagatctggaggacaccaagagagctctgcatgatctagaagaacaatacaaagaagcaaagtctactattaaagaaaaggaatatgtcatatttaatcttctgaaatcagaaaaatcattagtggactgtgcatataaccttcgtgcggagctagaaaatgcagcagcagatgtttctgggctattctccaaaatagagcgcaaagacaggatagaagatgggaacaggtcgatggtgcagagatttaggtctcaactgacccatcagctggatgcattgcataaaactgtatccagttctgtcatgcaacaggaggacctaccttatgaaatggaacatgatatgcaatcctttgtttcttcaaaagatgaggctgcacaggggctaagagagggtgtgcaaaagctcaaagtcttgcatggttcccgtatcactgctctggatgaantagcaggtgaaatcgacatgaactcgcggacaacatttgagagattaaatcacagattcagtccacacattcagcctttgagaactgtttcggaagaatcccttttgaaagcagattacttgttagatgagcttcagcgccgccctatccaaacagaagaaagggtagccccttttcccaatgaaccaaaagggaaggcaccctggaagacttggggaaccttccccttccttttcaaagaaaccttggcgtgtg

SEQ ID NO: 84868 - DNA, 857 bp, Zea mays
  misc_feature: Ceres CLONE 1571043
  misc_feature: Encodes the peptide sequence at SEQ ID NO. 84869
ctggagctccccgcggtggcggccgctctagaactagtggatcccccgggctgcaggaattcgtctcacccctagaaaaaaagattctgccaaaagatcctctcggatgcccccgcccccggccacccatttcgccagtcgccatcgagctctcgcttccgccgcccgctgcggctctatcaccgcggtgctgagccctaggatgtgactggtggacgtctctatggccgagccgtaggtggaggcggcagctcggcgccctgggagatggaggactatgacagaaagggtgtaggccagagcacctgtacccccgccgccgaccgaggaggctcctcctcgcccggcggcggcggcggcgcactcgcacaggtggactgacacatagaaggaggtctatcaccgccgcatggaaaagagaatcccggaggtcgtcgcggagccggtggcattgcgcgaagagctctgagccagttcgagcgcctggtgctgagctaccccgtccatgtgaacgtctacgatgcggacgacgtgctgctgcaccggaggattctcgacgagtgcgatcacactgaaaatcgcccgctcttacaagtgggcttcctgaactgacatcccagccctcggtggatccacagtataacgctgagggcattctttactagcgaaaaccgcaaattgtggggactctcagggaatcccttttgagaaaaatttgagcccatgcccaaggggaatagaggagcggaatctttaaattggaagcaaaaaattgggtggaagcaactcttggagggcccgtttcataagcgaagggggagaattcaaggaaaattcgttcgaaggaaaacaagaaa

SEQ ID NO: 84869 - protein, 37 aa, Zea mays
  misc_feature: Ceres CLONE 1571043
MEDYDRKGVGQSTCTPAADRGGSSSPGGGGGALAQVD

SEQ ID NO: 84870 - DNA, 827 bp, Zea mays
  misc_feature: Ceres CLONE 1571044
  misc_feature: Encodes the peptide sequence at SEQ ID NO. 84871
ccccgcggtggcggccgctctagaactagtggatcccccgggctgcaggaattcgtctcacccctagaaaaagtctgttcgtccggtttccctggaagcgcccccgatatttggtgcgcgcgggctgtgtgtgcggtgagcactgctactcctgcaacagcaagcgtcagtacgggagcccggccacccgagcacacttgccctcttcagtgcaaccccctgcatgctccgtcgggggcggccggtgctcctacgactcggtgcccgctacctagcatgatgttcctctccccgagggccccgccactgacaccatcgtgccgatctgtctcgccgtggaggatgatgattctcacgtagacgtgggggacgatgaccccttccgattcctgatacgcatctgaccccctgccgtcggtgcgccggttctgccgcgacgactgtgtttctacttatgatgatggagacgcctcagatcttcattggcggtttcatggtctcagaccagcacgtgtccatactcctgttacggcccatcttgtgttcctcccggaactctgaaggtccagtcgagagggctctcgttatcatcgggatcgccagtttcactatcaagctgatcttgcttctgtcgttagggcctgtttccgtcattctacaccttgaagctaagatgggtggactgactttgcattttcagcttgctgggatacccgccttatctggacagtttaaaaatttaatctaagaaatttttgaaataagcccaggccagggtcttcgtgggccttggaaatggtggacctgtggtaaattggccccaattc

SEQ ID NO: 84871 - protein, 97 aa, Zea mays
  misc_feature: Ceres CLONE 1571044
MMMETPQIFIGGFMVSDQHVSILLLRPILCSSRNSEGPVERALVIIGIASFTIKLILLLSLGPVSVILHLEAKMGGLTLHFQLAGIPALSGQFKNLI

SEQ ID NO: 84872 - DNA, 923 bp, Zea mays
  misc_feature: Ceres CLONE 1571045
  misc_feature: Encodes the peptide sequence at SEQ ID NO. 84873
  misc_feature (886)..(886): n is a, c, t, g, unknown, or other
gcggtggcggccgctctagaactagtggatcccccgggctgcaggaattcgtctcacccctagaaaaaacggttccacttccacccccatctcctcggcaagcccagcaaccccaatccccaatcccgtccgcttctttccccgtccccgaccttgccgaggaacctcccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgaacgggtcccaccgcttcgtgatccagggctactcgctcgccaagggcatgggcgtcgggaagcacatcgccagcgacaccttcaccgtcggcggctaccagtgggcgatctacttctacccagacgggaagaaccccgaggacaactccggctacgtctcggtcttcatcgcgctcgcgtccgacggcaccgacgtgcgcgcgctcttcgagctcacgcttctagaccagagtggcaagggcaagcacaaggtgcactcgcactttgaccgctccctagagtccggaccgtacaccctcaagtaccgcggatccatgtggggctataaaaggttctttcggcgtaatgctcttgagcaatcagattttcttaaagatgattgcttgaagataaactgtactgtggggtgttgtagtatcaactatgggatattccaggccacattcaatagagggttcagagtctgacataggctatcattttggaaactctttggacactctggaaggtgtagatgtcattttttagtgtagcaggagnagaagttcatgcccattaagttggttttggctggccg

SEQ ID NO: 84873 - protein, 199 aa, Zea mays
  misc_feature: Ceres CLONE 1571045
  misc_feature: SWISSPROT Homolog: EC 3.1.2.15 Ubiquitin thiolesterase
MEDEDAGLGDGGEASPPHHAAASGDRARDLAASPTSSRSVTQTVNGSHRFVIQGYSLAKGMGVGKHIASDTFTVGGYQWAIYFYPDGKNPEDNSGYVSVFIALASDGTDVRALFELTLLDQSGKGKHKVHSHFDRSLESGPYTLKYRGSMWGYKRFFRRNALEQSDFLKDDCLKINCTVGCCSINYGIFQATFNRGFRV

SEQ ID NO: 84874 - DNA, 757 bp, Zea mays
  misc_feature: Ceres CLONE 1571046
  misc_feature: Encodes the peptide sequence at SEQ ID NO. 84875
ctcaccgcggtggcggccgctctagaactagtggatcccccgggctgcaggaattcgtctcacccctagaaaaaatccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcgccgccgtcggtgccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctgggagacggcacgccggcgatcctgtacacggggatcgaccgggcggacatcaactaccaggtgcaggtgctggcgctcccccaagacgcgtccgacccgctgctccccgaagggggaaaaaccgggaggaattaaaccccggtgggcgaaccccgggggggccggggggtattcaacccgaaaccaattttcccccaaccccaacaaacagggggtgggcgggccacca

SEQ ID NO: 84875 - protein, 178 aa, Zea mays
  misc_feature: Ceres CLONE 1571046
  misc_feature (58)..(178): Pfam Name: Glyco_hydro_32N Pfam Description: Glycosyl hydrolases family 32 N terminal
  misc_feature: SWISSPROT Homolog: EC 3.2.1.26 Beta-fructofuranosidase
MGTRPRGVVLAPWAVVLVLVLALRLAGASHVIHRSLEAEAPPSVPASIVSPLLRTGYHFQPPMNWINDPNAPLYYKGWYHLFYQYNPKGAVWGNIVWAHSVSRDLINWVALEPAIYPSIPSDKYGCWSGSATILGDGTPAILYTGIDRADINYQVQVLALPQDASDPLLPEGGKTGRN

SEQ ID NO: 84876 - DNA, 1005 bp, Zea mays
  misc_feature: Ceres CLONE 1571047
  misc_feature: Encodes the peptide sequence at SEQ ID NO. 84877
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (44)..(44): n is a, c, t, g, unknown, or other
  misc_feature (45)..(45): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (76)..(76): n is a, c, t, g, unknown, or other
naaagaggaaataaaaaannnaccacctcaagaagttttaatanntttgtttaggaannnnnnnnnnnnnnnnagnctggagctccccgcggtggcggccgctctagaactagtggatcccccgggctgcaggaattcgtctcacccctagaaaaaaaaaaagccgaaagcccgaaaccagaggcgggtagggttctagctgcaggcgacggccatggccgcctccgccgccgccccggcgctgcttcgacgcctcttctgcagctctattccagcctcctcctccgtactgcgcgctaccttttgctcctccgccggcttcggctcgtcttctccgtcctccatattcggcgacgccaccgaggtcgccaacgtgccaccgctcaccacgcccaacctcttcgtcagtggtaacgtctctccgcttcgccccgtcccaccaaactcgtcgcactaatacaaaacaggtgtgtgcatgaatttaaagctgcgggcacttggataccttaatgctatgtttgtgagcaatccattggggaactagggataaccagtaagctttattgatgaagcacaacatttaaacctgttacagactcctagttttgcatcccatcctgcagctcttgtgccgtcaaaatcctattggcacctgtgcgtttttgcttgattttcctttttacccgttgcatagaaattggaaccctttttggaaagccctggggaatccccaaaaaactccggctttcaataaattataggtcaccccggaaatggtgtccaatttgcaaaactggtagttatttaataacaagcaagcttccgtttcggttccggtttggagaacaccggaaaacccaatttttagccctgtttcttggggaacaaaattttgaaattggggatttaggggaaagaattaaaacagggaaagaaaccgggcgttctcctcccttccccctttccttctcccgggtccccgcggttcccccccacccccacaat

SEQ ID NO: 84877 - protein, 80 aa, Zea mays
  misc_feature: Ceres CLONE 1571047
MAASAAAPALLRRLFCSSIPASSSVLRATFCSSAGFGSSSPSSIFGDATEVANVPPLTTPNLFVSGNVSPLRPVPPNSSH

SEQ ID NO: 84878 - DNA, 818 bp, Zea mays
  misc_feature: Ceres CLONE 1571048
  misc_feature: Encodes the peptide sequence at SEQ ID NO. 84879
agctccccgcggtggcggccgctctagaactagtggatcccccgggctgcaggaattcgtctcacccctagaaaaagtctcgtcctcgcatcccgcgccacaccatcccaatcccctccctccccctcgcgtctccagtctccacacctttcacacgcgacgccggagagacagagcgcgcgcgcgcgcccgaaagatgtcgacgtgcgcagcggacctggcgccgctgctgggcccggcggcggcgaacgccacggactacctgtgcgggcagttcgcggacacggcctccgcggtggacgccacgtacctgctcttctcggcctacctcgtgttcgccatgcagctcggcttcgccatgctgtgcgccggctccgtccgcgccaagaacactatgaacatcatgctcaccaacgtgctcgacgccgccgcgggggcgctcttctactacctcttcggcttcgccttcgccttcggcacgccctccaacggcttcatcggcaagcagttcttcgggctcaagcacctgcccaggaccggcttcgactacgacttcttcctctaccagtgggccttcgccatcgccgccgcgggcatcacgtcgggctccatcgccgagcggacccagttcgtcgcctacctcatctactccgcgttcctgacggggttcgtctaccccgtggtgtcgcactggttctggtccgccgacggctgggccggcgccagccgcacgtccgggccgctgcttttcgggtccggcgtcatcgacttcgccggctccggggtcgtccacatggtcgggggcatcccggggctgg

SEQ ID NO: 84879 - protein, 207 aa, Zea mays
  misc_feature: Ceres CLONE 1571048
  misc_feature (36)..(206): Pfam Name: Ammonium_transp Pfam Description: Ammonium Transporter Family
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGFVYPVVSHWFWSADGWAGASRTSGPLLFGSGVIDFAGSGVVHMVGGIPGL

SEQ ID NO: 84880 - DNA, 1042 bp, Zea mays
  misc_feature: Ceres CLONE 1571049
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (61)..(61): n is a, c, t, g, unknown, or other
ttatatcccgtcgggtgcgattaaaccccccaatttataatatccnntnnnnaaccgcaanttttcaaagttggtgctccccgcggtggcggccgctctagaatagtggatcccccgggctgcaggaattcgtctcacccctagaaaaaagcgcggcagagagtcgagaccttctagctaggccgctgccacgtcaaaactagctcctccagacaaccaatcagctagccgaagccggtcgattagcatgcagcagcgctagtagacgtcgtctccgggtctccactctccacacagaaacccatacaaaatccgcatccagaatcaccggagatacgagtccgcgcgtacgttgcagttgaattgtgaagagaggctgtgcgcagtgctgctgctgcttcttcttcttcgacgcatgcacgcacatggatggtgctgctgagtgctgacctccggccgtacgtgatcttcgatctccacacggcggcaagcgatcgagaggcgtggttcccgtggcgtcaaccgacacctagcagctgctagctcatctgcttgatctctagctgagactccgagcaaaatgcagcagccaggaacaacaagctaggccccctcacgcagaccgcacgaccgagcgcgcggcattgaccgacccatcgccgccgccgccgcctcgatcgaccatgacgcttgcgagcacggacaaggtggtgctgggatgcatcgcgttcaacatcttctggggtgctggccgtcttcccctcggggccgttcatggcggtggggccgcacccgcgggctctctcctggggccccatgctcatggtggctcttccgcggggatgacccccggaggaaggccacaaggcgcatcgaacttcccgaatcctggggcctgctctttcggaacccatggtgggtccacctatctctccgggaaacgcggccagacctgttcccaattccctccacaaacaccccttggactgggcggaaacacggaggccaaccaaggaacctggtcgtttccccccgtcctgcc

SEQ ID NO: 84881 - DNA, 784 bp, Zea mays
  misc_feature: Ceres CLONE 1571051
  misc_feature: Encodes the peptide sequence at SEQ ID NO. 84882
  misc_feature (200)..(200): n is a, c, t, g, unknown, or other
  misc_feature (681)..(681): n is a, c, t, g, unknown, or other
ctccccgcggtggcggccgctctagaactagtggatcccccgggctgcaggaattcgtctcacccctagaaaaaaccactccttgtctcactctccgccacaacgtcagccgccccgcgccgagcagacctcctccactagccgccgggccgcacaccaaacgctcctgggaatgccgacgccgacgatggtcaggcctntttccgctcttcttcttcatcgtcgtcgtcttgctggtccggtcgccggcgggtgcggcggccgacggcggcgggaacgcgacgaacggattcctgcccccgctagatctgggctacgtgcggacattccccatggggaccccctttgcccgtgcgccgggaagggccccgcccccaaaagttggaacaaccctttgttgtccaaaaaaaaacccggtttctccccccctttgtttggggagaaaatgaggcccccccccccaaaaaggaccccctctcccggggggggggagggggagaaatattttccccccccccccccgcggggggggggcccttttgggggtggttttttaaagagtattttggggggttttttttttttccccccccccgggggggggggaatccccggggggggtgccccctcttgggggggggggaggaggttttctttccccccaacaaaaaaaaaaaaacncccccccccccccccccccctttttgggaggggggggggggggggccccccccccccaagaaaaaaaaaaaagttgtgtggggccccgcccccccaccaaaaa

SEQ ID NO: 84882 - protein, 148 aa, Zea mays
  misc_feature: Ceres CLONE 1571051
PRGGGRSRTSGSPGLQEFVSPLEKTTPCLTLRHNVSRPAPSRPPPLAAGPHTKRSWECRRRRWSGLFPLFFFIVVVLLVRSPAGAAADGGGNATNGFLPPLDLGYVRTFPMGTPFARAPGRAPPPKVGTTLCCPKKNPVSPPLCLGRK

SEQ ID NO: 84883 - DNA, 836 bp, Zea mays
  misc_feature: Ceres CLONE 1571052
  misc_feature: Encodes the peptide sequence at SEQ ID NO. 84884
  misc_feature (508)..(508): n is a, c, t, g, unknown, or other
ctccccgcggtggcggccgctctagaactagtggatcccccgggctgcaggaattcgtctcacccctagaaaaactccacgcagctccactccacgggctagcagcagcagcagcttccccatgcatgcaatggcgtggtggggcggcgaggagggcgagccgttattcccgtccgtggacaagtgcgacgcgtcccgcctcggtcgggactccacgctggtggcggacctggacggcgcgctgctccgctccccggacgccttcccctactacgcgctcgtcgccttcgagacgggcggcgcggcgcgcctggcgctgctgctgctgctggcgccgctggccgcggcgctgcgccgcgcggtgtcggagtccgcgggggagcgggtgctggtgttcgcggccacggcgggcgcgcgcgtcgccaacgtcgagtccgcggcgcgcgccgtgctgcccaggttctacgccgccgacgtgcgccgggacgcgtggcgcgtcttctccgcntgcggggggcggaagctggtgctcaccgccgcgccgcgggtcatggccgaaacgtttccggcggcgggacctcggcgccgaagcccttccccggcacggaactcgccccttggcgggggaaccccccccggggtggggtggacccccccccccggccggcttggttttttgggggaaaaaaaaagggcccaggcgcttgggggaaaaaacctcctcacccccggggaagggggccccaaaatttcgggggccttgccccccccgcggaaaatcgggattttcccccccccccaaagagattttttctgccaggggggtttcctccaaa

SEQ ID NO: 84884 - protein, 235 aa, Zea mays
  misc_feature: Ceres CLONE 1571052
  misc_feature: SWISSPROT Homolog: EC 2.3.1.15 Glycerol-3-phosphate O-acyltransferase
MAWWGGEEGEPLFPSVDKCDASRLGRDSTLVADLDGALLRSPDAFPYYALVAFETGGAARLALLLLLAPLAAALRRAVSESAGERVLVFAATAGARVANVESAARAVLPRFYAADVRRDAWRVFSACGGRKLVLTAAPRVMAETFPAAGPRRRSPSPARNSPLGGGTPPGVGWTPPPGRLGFLGEKKRAQALGGKNLLTPGEGGPKISGALPPPRKIGIFPPPQRDFFCQGGFLQ

SEQ ID NO: 84885 - DNA, 730 bp, Zea mays
  misc_feature: Ceres CLONE 1571053
  misc_feature (311)..(311): n is a, c, t, g, unknown, or other
  misc_feature (312)..(312): n is a, c, t, g, unknown, or other
  misc_feature (321)..(321): n is a, c, t, g, unknown, or other
  misc_feature (322)..(322): n is a, c, t, g, unknown, or other
  misc_feature (396)..(396): n is a, c, t, g, unknown, or other
tccccgcggtggcggccgctctagaatagtggatcccccgggctgcaggaattcgtctcacccctagaaaaaacctggtcctcctctccactctctcttctccctccaataattctctccacccctgcttgctgcagcttcaagcactaccgaatcagggcgagtgggagcagaaggagggaatcccatgtctccgcccctcgctggagcagatcgttgtcgagccgacgtggagctgctgcggtagaaagctagcggagcctgcgagctagcctgatccgtccgcagtccgatcgggatcgatgggtggnngaggcgccnngacccgcgcggctgacccgggcgctgagcatcggcggcggtgacggcggcctggggttcccgaagagatgctgncactcgtgatggggttcgtccaagaccccgcgcgaccggggaaggccgcgtcgcctggtggtgtccaccggtgggcacccccggtcaacccgcttctccccgaaaacccccttgaaggggggcccttttgggtaaagcccgtttcccccggggaacccctgctcccccggggttcccccggggtctcaattccccccccggggaaaaagggaaaaacccccgccccggccccttttaagggggggtttttcccccaaaaaaaaggggggggggccctataaccccccccccggggggaataaaccaaaaactttcccccccccccccccttttc

SEQ ID NO: 84886 - DNA, 865 bp, Zea mays
  misc_feature: Ceres CLONE 1571054
  misc_feature: Encodes the peptide sequence at SEQ ID NO. 84887
ccgcggtggcggccgctctagaactagtggatcccccgggctgcaggaattcgtctcacccctagaaaaagaaaaggattcccagtttagtgtattttcctatgccataagcagagctcggtgttgataccgtgccagtacttgttggaccagtctcgtacctgttgctctcaaagcctgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatccctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccaaaagttgttgaggttgatgctcttgcttaagcattggcctgtcaaaaagatgatgcttacttcgcagcaaatgctgctgctcaggcctcgaggaaatcctcaccccgtgtgaacata

SEQ ID NO: 84887 - protein, 62 aa, Zea mays
  misc_feature: Ceres CLONE 1571054
  misc_feature: SWISSPROT Homolog: EC 2.1.1.14 5-methyltetrahydropteroyltriglutamate--homocysteine S-methyltransferase
MHTAVDLVNETKLDSEIKSWLAFAAQKLLRLMLLLKHWPVKKMMLTSQQMLLLRPRGNPHPV

SEQ ID NO: 84888 - DNA, 825 bp, Zea mays
  misc_feature: Ceres CLONE 1571055
  misc_feature: Encodes the peptide sequence at SEQ ID NO. 84889
ctcaccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaaagtcggcgaggcggtggtggttcaaggccggcgcgcagatcttctcggagggcgggctgggactacctgggggaaccccaacctggtgcacccacagagcatcctgggcatctggggcgttgcaggtggtggccccttgggccttcgtcgaggggctaccgcggttgggcgggggggcccccttcggggggaaaggcccccaaaaagggtggtaacccgggggggggccctttcgaaacccctttggggccctctccccgaaaaaaacccgtgagaacccccgcccgcccgagaaccccaaaggggtggaaaggaag

SEQ ID NO: 84889 - protein, 209 aa, Zea mays
  misc_feature: Ceres CLONE 1571055
  misc_feature (59)..(172): Pfam Name: Chloroa_b-bind Pfam Description: Chlorophyll A-B binding protein
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKVGEAVVVQGRRADLLGGRAGTTWGNPNLVHPQSILGIWGVAGGGPLGLRRGATAVGRGGPLRGERPPKRVVTRGGALSKPLWGPLPEKNP

SEQ ID NO: 84890 - DNA, 810 bp, Zea mays
  misc_feature: Ceres CLONE 1571058
  misc_feature: Encodes the peptide sequence at SEQ ID NO. 84891
ccgcggtggcggccgctctagaactagtggatcccccgggctgcaggaattcgtctcacccctagaaaaactcgctcaccctctcaccaaatccttctcctccgcgccgccacagccgggcgcgcctctcgatcgagatccaggagatatgcctcgttatgatgatcgccatgggaatacacgcttgtatgttggaagattggcccctcgcacccgttcccgcgacctagaatatcttttcagcaaatatggaaggttttcggttttttacccaaccatggaggtctgtggtggaagggtgcccttggtggaattggtggccattgttccgatatttgtggaggactttggtgaagggcgcccttggtgtaatcttattgactgttgtagatgaagttgcaagttgatgcatttgagtacttgactcatgtcagcagcttactgtttgtggaaactatttgcgcagaatacgtgaagtggagttgaagcgtgactatgcattcattgtatgttctactacactcagggtatctcccaacatttccccctcccaatccccccattttggactttccattccaaatttaaatacattccccctcaactattcttccccccttatttttttctcctctcccccccatttcccccttttcagcttcccccctttacccctttaacgggagctattgtgccctttaataattttattttttttttcccctttttggggattttttttaaattaatacctcccccctttttttgggggtacccggaataaccccaattggtgtattcctgagaaaa

SEQ ID NO: 84891 - protein, 81 aa, Zea mays
  misc_feature: Ceres CLONE 1571058
MPRYDDRHGNTRLYVGRLAPRTRSRDLEYLFSKYGRFSVFYPTMEVCGGRVPLVELVAIVPIFVEDFGEGRPWCNLIDCCR

SEQ ID NO: 84892 - DNA, 1000 bp, Zea mays
  misc_feature: Ceres CLONE 1571060
  misc_feature: Encodes the peptide sequence at SEQ ID NO. 84893
  misc_feature (710)..(710): n is a, c, t, g, unknown, or other
ccgctctagaactagtggatcccccgggctgcaggaattcgtctcaccctagaaaaaacagtatctcgatctccactactacattgatttccagccccccaatgacgagagcgcccccccgccgcctctggccagccgcagtaattgcagcgcagcccaagtgaccggcctttgaggtttgaccccgcgccggcgccatggccgcggacgccaccgcctccgcctcctcctcgtccgccgcatacctcccgacctcgcgcctggacatccaggccgccgtcgccaaggccgccgagctgcgcgcgctccacgccgcgctcctccagggcggcagcagcagcggcggcgccgccgccgccgcgtccaatgccggggcctacgccagcgctagccggagccccgccgtcatccgcctgccgccggccgcgtcgccggcgccggcccccctggccacggccgccgaggactaccccgtgtttgcgccgacttatgatgaagagcacttgggtggaacgaactacattccccaagaaaacaggagcctgtccgagaactggagcggcatcggtttggaccatgatcatgatggcctaaaaaacgagggggcggtcttcggattcgacaaccggcaacaccttcttcttcgtcgaacagcgaagctccgttttctcttccgcaaaatgaagccctggccggaacaagaaagggtnggcaaaaaaacctcccgttcccttccttccacccccccctctattgccaaacattttggcttagggccagtccgtcaggatggacggaactccactgtaatttaagggccgtttacacacggcaaaaacctgtaaatcccgcaaacgatccgtgaggggcgaaaccctgaatacgtgcgaatgccagggtccctataaaaaaccctatgaaggcccgcggccgcttttaatatatcccgaaaacaaggtggtatgggccaaacatatgccctcccggtggttaagcaaaa

SEQ ID NO: 84893 - protein, 205 aa, Zea mays
  misc_feature: Ceres CLONE 1571060
MAADATASASSSSAAYLPTSRLDIQAAVAKAAELRALHAALLQGGSSSGGAAAAASNAGAYASASRSPAVIRLPPAASPAPAPLATAAEDYPVFAPTYDEEHLGGTNYIPQENRSLSENWSGIGLDHDHDGLKNEGAVFGFDNRQHLLLRRTAKLRFLFRKMKPWPEQERVGKKTSRSLPSTPPSIAKHFGLGPVRQDGRNSTVI

SEQ ID NO: 84894 - DNA, 786 bp, Zea mays
  misc_feature: Ceres CLONE 1571063
ctggagctccccgcggtggcggccgctctagaactagtggatcccccgggctgcaggaattcgtctcacccctagaaaaacttcctagatcccctcctccacttgaagcgttcgtgccggcgtgtggaaggaggacacgaaggcgactctggggacgacggcctgtgcggcccggcgtagtcttcctagccccggcaaccggctcagaggttcggttcgagcagagatcgtcgaagcggagacctagagtcgaagcgacccaaatcgccgtcgggccttcgtcttggcggacgatggactcaagattcgtcagggccagaggaggacgccagcaccagatccagcaagacctaactcagaggaaggagcgatcaagcgcagccgtcagatagacgacgacgaggacgagtctgcgtcttcgcctactcccccgccgaacgtgggtgccggcgcgctatgggtggcaacattttggcaggctgtagcatagcagtggcggaggaccacatctgggagatgcgaagtggagcacgctgcgccactcaacatcgagatccgcttcttgggtcgggcattcgacagcgccgcgccctgtagacccgggcaacagcattgtgcttcgtggtgctatagtggccgctggagaccctccgacggggagccccccatgaaccctctatcgggctcccccgatgcccttgagaaccgcaagaaaggctgaaccccttttgactggcaaggaaggcccatgggtgggccaaccttgctgggccctccctatggaaa

SEQ ID NO: 84895 - DNA, 792 bp, Zea mays
  misc_feature: Ceres CLONE 1571066
  misc_feature: Encodes the peptide sequence at SEQ ID NO. 84896
ggagctccccgcggtggcggccgctctagaactagtggatcccccgggctgcaggaattcgtctcacccctagaaaaaagtcgcgtcacggacatgcggacacagcgggatccagcaccaagagcctaggaaggccaggggcaggggtcctcgccctcgccgcaatggagctgctggccaaggcgcccgtgctgggctgcgccgggaagatgcagaggcagcggcaacgggggtccgcgctgggcaggtggatttgccgtgccgtggcgccgccgagggccgcgccagccacgccgccgagggtgcggctcagggacggccgccacctggcgtacgccgagtccggggccagcaaggaggacgcgaggttcaaggtcgtcttctcccacggcttcaccggctcccgcctcgacaccgtccgcccggcgccggtcagtgtcccgccccggcctctggatctggctctgcacggaaaagattcgagcttttgtggatccgcttgtgttctcccccccagttcctgtacacatcgccagccagcgcgattgtgcattgcgtggttcgccggtgccatccgtgcgaccacacgaacatccttactgtaggcgagttcgtcttcgatcgggccgatgcaatcgactccgtatctcacagccgctccgtatcctcaactgaatgaatttgtttctactttctaggaagttgcggaggagctgggcgtgtacatggtgggtttcgaccgcgccgggtacgggcagagcgaccccaaccccaaccggttcgtcaagagcg

SEQ ID NO: 84896 - protein, 146 aa, Zea mays; identical to SEQ ID NO: 84159
  misc_feature: Ceres CLONE 1571066

SEQ ID NO: 84897 - DNA, 2158 bp, Zea mays
  misc_feature: Ceres CLONE 1571067
  misc_feature: Encodes the peptide sequence at SEQ ID NO. 84898
aatctagcctgcctgtccttagcgtagtcatgccatggcgggcgatgcgctcatcgtcatcgtcactagcttcctcctcgcgctgccgtcagcgacggcaataggcaaggtctgcggcaacgccggcaactacacggccaacggcaggtaccggtccaacctcgactccctcgccgcggccctcccagccaacacgtcctcgtcccctcagctcttcgccaacgccaccgccggccaggcccccgacgccgtgtacgcgctcgcgctctgccgcggcgacctgaccggcaacctcaccgggtgcagcgcctgcgtgaacggctcgttgcagtacgcgcggagggcgtgcccctacgccaaggccgccagcgtctacgacgacaactgcctcatcggctactccagcgccaacatcctcgtcccggcctataacgccacccgggacacgagcacgctcttcgactactggaacagcatgaccatcgccggcaacggcacactggtggccgcccacgtcgacgacctgctgacgcagactgcccagcaggctgcctccagcccgaggaggttcgtcacggcctacatggacggctccagcaacgccgtcatcccgacgctctactccctggcgcagtgcacgcccgacctgtcagccggcgactgcctggcctgcctccagcggatcctcggcttgctcaacgccacgacgtcggtgagccttggagggcgggtcctcctgctgcggtgcaacttcaggttcgagaataacatgttcttcgacggcgcacagatgacgcagatcaggccgtcgtccggcgctccggcgccaccaccaccgtctccgacgacaaataaaggatctggggtgaagccttgggtaattgcggtgtctgtagcacctcctgtggcggtagtagcattctgcttcatcctttacaaccgtaggcaaaggagaaggttcagaagaggtagatctaaactacgacaaaagcatcctcgcaacaacttgaaaggagacgaactagattgggaaatggaaacagagctctcagagttttctgtttttgacttccatcagatattggaggctacagataacttctctgaagaaaataaacttggggaaggtgggtttggccccgtttataagggtcagtttcctgatggaactgagatagctgttaagagacttgcttcacattcagggcaaggttttgtagagttcaagaatgaagtacaactcatagcgaaactccaacacacaaatttggttaggctcttgggatgttgctctcagggagaggagaaaattttggtctatgaatacttgccaaacaaaagcttggacttctttatctttgatgaaaacaggaaatcgttactggattggaaaaagcgtctagcgataattgaaggaatagcagaaggacttctctacctgcataagcactcccgtttgcgtgtcattcatcgagatcttaaaccaagtaacattctcctggacagcgaaatgaatcctaaaatttcagactttgggttagcaaaaatatttagctcaaataacatcgaaggaagcactacaaggagagtggttggtacatatggttatatggctcccgagtatgcctctgagggcatcttctctatcaaatctgacgtattcagctttggcgttctcattcttgagatccttagcggaaaaaggaattccggcaaccacgattatggagatttcatcaatattctcggatatgcatggcaattgtatgaagaggcaagatggatggatctcgttgatgcctcattggtaccaatggatcactcatctgaaatcatgaggtgcatgaacattgcattgctgtgtgtacaagagaatgccgctgatcgaccagccatgttggatgttgttgcgatgctaagcaacaaggctaagaccctggctcagccgaaccacccagcgtatttcaatgtacgggtaggaaacgaagaggagtccactgctgctacggcgtcaggcagtatcaatgagatgaccgtatctgtcacaactggtagataatttttgtttgtacaaagtggttactgttgagcttatatatataattatccttttgataatgtgcaatgcagacatatttcataaaaaaaaaaaaaaaaa

SEQ ID NO: 84898 - protein, 674 aa, Zea mays
  misc_feature: Ceres CLONE 1571067
  misc_feature (356)..(628): Pfam Name: Pkinase Pfam Description: Protein kinase domain
  misc_feature (195)..(249): Pfam Name: DUF26 Pfam Description: Domain of unknown function DUF26
  misc_feature (73)..(129): Pfam Name: DUF26 Pfam Description: Domain of unknown function DUF26
  misc_feature: SWISSPROT Homolog: EC 2.7.11.1 Non-specific serine/threonine protein kinase
MAGDALIVIVTSFLLALPSATAIGKVCGNAGNYTANGRYRSNLDSLAAALPANTSSSPQLFANATAGQAPDAVYALALCRGDLTGNLTGCSACVNGSLQYARRACPYAKAASVYDDNCLIGYSSANILVPAYNATRDTSTLFDYWNSMTIAGNGTLVAAHVDDLLTQTAQQAASSPRRFVTAYMDGSSNAVIPTLYSLAQCTPDLSAGDCLACLQRILGLLNATTSVSLGGRVLLLRCNFRFENNMFFDGAQMTQIRPSSGAPAPPPPSPTTNKGSGVKPWVIAVSVAPPVAVVAFCFILYNRRQRRRFRRGRSKLRQKHPRNNLKGDELDWEMETELSEFSVFDFHQILEATDNFSEENKLGEGGFGPVYKGQFPDGTEIAVKRLASHSGQGFVEFKNEVQLIAKLQHTNLVRLLGCCSQGEEKILVYEYLPNKSLDFFIFDENRKSLLDWKKRLAIIEGIAEGLLYLHKHSRLRVIHRDLKPSNILLDSEMNPKISDFGLAKIFSSNNIEGSTTRRVVGTYGYMAPEYASEGIFSIKSDVFSFGVLILEILSGKRNSGNHDYGDFINILGYAWQLYEEARWMDLVDASLVPMDHSSEIMRCMNIALLCVQENAADRPAMLDVVAMLSNKAKTLAQPNHPAYFNVRVGNEEESTAATASGSINEMTVSVTTGR

SEQ ID NO: 84899 - DNA, 1190 bp, Zea mays
  misc_feature: Ceres CLONE 1571070
  misc_feature (26)..(26): n is a, c, t, g, unknown, or other
  misc_feature (46)..(46): n is a, c, t, g, unknown, or other
  misc_feature (56)..(56): n is a, c, t, g, unknown, or other
  misc_feature (57)..(57): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (868)..(868): n is a, c, t, g, unknown, or other
  misc_feature (1190)..(1190): n is a, c, t, g, unknown, or other
ggaagagatatattaaaaaaaaatangtacaactcaccacaaaaangcgcccgcgnngagaagnnnnnnnnnaaaaactgggactccccgcggtggcggccgctctagaactagtggatcccccgggctgcaggaattcgtctcacccctagaaaaatagtcctggaaggtcaaacggttgatggaagcctcgctgggtgcttcaacgaacgccaaggtgtagctgtcatttacagccgcttgattgcatccgacctgttcgcctgatggcttgccgtcccttgattgacctccaggatcagcaagcgcgggctcagcagagctaccatcgctgattccaggtaccaggccgggtaacattaccaaggccgggtggtccacagcaagttcaagattaaggctggcacaagattaagtgctcccacagggcatgctctatttagtgctgatggctgactcgatcttgacactttccatatcacgatacacagaggaggtgtccatcccaaacctcatacgagaggtttggcaagtcctaacttatgctgcttttgagtcccacaaatacctttttgatggaaagggaaaaaagatccccgcgaaatacctggagggatacagggatgcttccaaatggaaaagggaaagaattgttcgcacgcagatgagatctccttcattccctccgggtaagatcgtttcaaaaagtttacaccccctagggaaaccccccgcttatattttaagctttgaaacggaaagtggggccccgaaaatccctatttttttaagagtgggggagccccccatcatagtgggggtctttttaacacccttttgggagggggcctatacatatatgccttgnaaaaagagccaccaccgcggcgttcttccaggggagaaaaagttccttacaagaacactattgccctcgaacacgacaaaaaaagagggaaaaaaaaaaaaacgatgtggaattcccacaaattgggcggagggagatcacccactcttctcgccggacttagaggtgaaaaattctttcctgaggggggccacaaatttggggaagcttaatagattaaacaattggggggaaactgtagaacatcggttgcgggggaacccaaattcaaacgcaaatagaagataatactatgtgcagaaaacaaaacatataaacactn

SEQ ID NO: 84900 - DNA, 694 bp, Zea mays
  misc_feature: Ceres CLONE 1571074
  misc_feature: Translation starting site: 154
  misc_feature: SWISSPROT Homolog: EC 2.4.1.13 Sucrose synthase
  misc_feature (367)..(367): n is a, c, t, g, unknown, or other
ctccccgcggtggcggccgctctagaactagtggatcccccgggctgcaggaattcgtctcacccctagaaaaaagccgcgtccttgccccccgccattttttgcggtttcggtgtgttcccgtgactcgccggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgttttagtgacaaggagaagtatgcaccctttgaagacattcttcgtgctgctcangaagcaattgtgctccccccatgggttgcacttgctatcaggccaaagcctggtgtctgggattacattcgggtgaatggaaatgaacctggccggtgaaagaacctgaatggtttcggaaaaacttgggcttttcaagggaaaaaacctgggggggatggaaaaatcccaaacaggaaaactttgtgggcttgagacctttattttttgaaaccccctttaaagggcgccccctttttttcccggggggcccttttcacaatggggcaaaaaaaacccccccccgcggaaaaaaaaggggggggggggggcaaaattttccccccc

SEQ ID NO: 84901 - DNA, 835 bp, Zea mays
  misc_feature: Ceres CLONE 1571075
  misc_feature: Encodes the peptide sequence at SEQ ID NO. 84902
gcggtggcggccgctctagaactagtggatcccccgggctgcaggaattcgtctcacccctagaaaaagcccactcccagaggctcttctcctcctcgcctcctctccctagcctccacgacgcaagggagagtgacggaaagcgacgcggcgcgagcgaggagggccaaggggaagaggggaagcaccgcaccaggacccttgttcgccgccgtcgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctctgccatggttgtctacaaggtgaagcttgtcgggcctgaaggtgaagagcacgagtttgatgctccagacgacgcctacatccttgacgcagccgagactgccggtgtggagttgccatactcgtgccgtgctggggcttgctccacctgtgctggcaaaatcgagtctggttcggttgaccagtcggatgggtccttccttgatgacgggcagcaggaagaaggttatgtgctgacatgcgtctcctacccaaagtccgactgcgtcatccacacccacaaggaaggccgacctgtactaggggctaggcttttccaatttggcgagggacaaaaaatgcttctgaggggttgttgttgtccagcaaaggttcattttcggccctaacccggttgtgcgaactgttttgggaatcaaacttgggtt

SEQ ID NO: 84902 - protein, 181 aa, Zea mays
  misc_feature: Ceres CLONE 1571075
  misc_feature (63)..(139): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MSTSTFATSCTLLGNVRTTQASQTAVKSPSSLSFFSQVTKVPSLKTSKKLDVSAMVVYKVKLVGPEGEEHEFDAPDDAYILDAAETAGVELPYSCRAGACSTCAGKIESGSVDQSDGSFLDDGQQEEGYVLTCVSYPKSDCVIHTHKEGRPVLGARLFQFGEGQKMLLRGCCCPAKVHFRP

SEQ ID NO: 84903 - DNA, 859 bp, Zea mays
  misc_feature: Ceres CLONE 1571080
  misc_feature: Encodes the peptide sequence at SEQ ID NO. 84904
ggagctccccgcggtggcggccgctctagaactagtggatcccccgggctgcaggaattcgtctcacccctagaaaaagttgaaatatccacagcgaaaactaaaaacattcctccgcgacggctccaggctgcgaagtctcccaccaacgcgcgccgatccggaccgaaggcctcctgctctccgtctccctcgcggcctcgccccgtggatctccgctccggccgacgggcgcgatggcggagccggagcgggagcagcgcccgctgctagaggtagagcaatccgtcacgtccataccggaagatcatgaagccacatgttggggctgtgggctccggcttgtttttgcgggttactcgcctatctataagtgtggctggtgtggagccatcacgcaaagcaaccagaccacaaggaaaacctgatagtggatggttttcccactggaagcgcgtgcgggacagattctttgtcaccgtgctccacctcttcatgcccctttgttaaagggggggggggtctggggcggtatattccatttggtttcaaaaacagcaacttctgggggaatctttcactgcatgggaaacagcctggggtaagctgggttttccccatcacaaggcaacggggttgggccctttttttaaattcggggggggccgccaaaaaaaatttaccctttggggggaactattcccttgggttggggaaaaaaggggatcttgggaaacacaattcctttttgggcacacccgggaaaaaaaaaccaaaacgccccccccgaaaaaaaaaaacatttggcgcgaattttttttaaaaaaatggggggggggggggaaaaaaagagaaaacc

SEQ ID NO: 84904 - protein, 63 aa, Zea mays
  misc_feature: Ceres CLONE 1571080
MAEPEREQRPLLEVEQSVTSIPEDHEATCWGCGLRLVFAGYSPIYKCGWCGAITQSNQTTRKT

SEQ ID NO: 84905 - DNA, 856 bp, Zea mays
  misc_feature: Ceres CLONE 1571081
  misc_feature (511)..(511): n is a, c, t, g, unknown, or other
  misc_feature (524)..(524): n is a, c, t, g, unknown, or other
  misc_feature (531)..(531): n is a, c, t, g, unknown, or other
ctggagctccccgcggtggcggccgctctagaactagtggatcccccgggctgcaggaattcgtctcacccctagaaaaacaggcacacacagcagcagcgcaatcgcagggcagggcgagaccagcaaagatccccggaaccagagcaaagcaagacacaaaacgagcaaaacaacagcaaaagaaggagcgagggaaaaaaaaaactcacgcaaaatccccacttcacttcgcttcgcctcctccctcctcctctcaaactgtaaacacttcttcaccagttcgctgcttctcctcgtcctcacaggcgcgtcgtcgatccggaaggcgcccgccaccgggagcggaggcctgagcgggagcaggagcggggccggcgaatctggagcccgggggacctgcattgcctcgggaccgccgcgcgtagccagatctcccccgtcccctgccgcggcaccggcacggcatggtggctgccgcggcggcggccaccgcgccagatccggaacnaatctcgcgcccngcgctcnacgcggggctcgacaagcccaactccgccgccgcgcggaagaactcgcgctccaacaagcccgtctccctcgaggtacctgtcccgcggcgcatccccgggctcttcaacttcgtccctcacggtcggcgtcggtcttcttggtcctcctcccggccggttccttttccggggaagggaacccgggaagtccaactccggccgccggaagaactccccggtgggtcaaaaaccacacggggtggggagggggaaagaattccccccccgcggaacccaaaatgggggaacccccctcccgtggtctgttcccgggggggaaaccc

SEQ ID NO: 84906 - DNA, 830 bp, Zea mays
  misc_feature: Ceres CLONE 1571083
  misc_feature: Translation starting site: 452
  misc_feature (803)..(803): n is a, c, t, g, unknown, or other
  misc_feature (806)..(806): n is a, c, t, g, unknown, or other
  misc_feature (808)..(808): n is a, c, t, g, unknown, or other
  misc_feature (827)..(827): n is a, c, t, g, unknown, or other
  misc_feature (828)..(828): n is a, c, t, g, unknown, or other
gcggtggcggccgctctagaactagtggatcccccgggctgcaggaattcgtctcacccctagaaaaagctccatcaccgagtctaacaagatccccttgtccatcttgtgccatcacgagcgagcgttgtcgcacatgccagataaagaagatcgccactgagagatagggtgtgacgcatttcgacttgcgcctatgctgcaccctcggatacagcgagtcatctgggagatagagaaggagctgacaaaaggagaaaggaagcagtgaggtcacgagaaactgaacagcaagttggtacctggaatctcaagtcccaggtcaagaacaggtaccgcacgatgaggcgcttggaggatgctgtgatgtgttcatgagagatctaggtcgtcactctcccagtcaactttgggttgctggaccgatgtctccttataatagctcgaggagatgctctccaagctgtcggcgtggttcgtgaacccgcggcggaatccgctcgcgcgcctccaccggaacgccgtcgcctcccgcctccgcaatacaggctcaggtatgacgacctctacgacccgtaccacgacctagacatcaatgaggctctggcgcggctgccgcgagaggtggtggacgcccgtaatcagcgcctcaagcgggccatggacctctccatgaagcatcagtagctacccgacgacgtccaggctatacagacgccattcaggagctactattatgacatgcttgctcttgtgagtgcaactgcattgtaggcaacgtatcattatgatgctctgcgggnaananaaaagagagagggggggannca

SEQ ID NO: 84907 - DNA, 769 bp, Zea mays
  misc_feature: Ceres CLONE 1571086
  misc_feature: Encodes the peptide sequence at SEQ ID NO. 84908
  misc_feature (753)..(753): n is a, c, t, g, unknown, or other
  misc_feature (754)..(754): n is a, c, t, g, unknown, or other
ctggagctcaccgcggtggcggccgctctagaactagtggatcccccgggctgcaggaattcgtctcacccctagaaaaaaccacacctgcagagcagcaagactagcttgtggctaccagcctagctagccaccgccgcgatccactatcatcgcttgctcgccgagtttcctgcggcggccggcgggcacctacatctcctctacctgactggctagtcattagcacagccagtacgtacgtagctcgcccggccggtgctcgacgacacagtgaattggcgacgcacgtagctaggaggccagcagctggggtcggagatggccatgccagtgaagctgactcctgcctccctctcgctgaaggcggtctgctgccgcttcagctccggagggcatgcgctgcgcttcggctcgtcgctaccgtgctggaggaggacgccgacgcaacggagcacgtcgtcgtctacgacgcgccctgcggctgaggttagctctggcaaaagcaagcagcacgatcaagaagcatcggaggctacgataagacagcagctccagctagtcgatgtgcttgagaacatggggatttctcggcattttgctgctgaaatcaaatgcatccttgacaggacatacagaagttggttacagagacatgaggaaattatgctggacacaatgacctgtgcgatggcatttcgtattctaagggtgaatggatacaatgtctctttctgatgaagtgtatcatgnntgttgaagcttccgg

SEQ ID NO: 84908 - protein, 138 aa, Zea mays
  misc_feature: Ceres CLONE 1571086
  misc_feature: SWISSPROT Homolog: EC 4.2.3.19 Ent-kaurene synthase
MAMPVKLTPASLSLKAVCCRFSSGGHALRFGSSLPCWRRTPTQRSTSSSTTRPAAEVSSGKSKQHDQEASEATIRQQLQLVDVLENMGISRHFAAEIKCILDRTYRSWLQRHEEIMLDTMTCAMAFRILRVNGYNVSF

SEQ ID NO: 84909 - DNA, 823 bp, Zea mays
  misc_feature: Ceres CLONE 1571087
  misc_feature: Encodes the peptide sequence at SEQ ID NO. 84910
tacccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaactcacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtctgcgtcggcgtcggcgacaaataacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcaacgatgccgtgctccgcacctacgaccacgtcttctcctcccgccagcgctccctggtgtccgacatcatcattgtacggcgccaccgactcgtgcttcgcgccctacagcgacactttcggcaagcgcgggatactggtcaccgtgcacctgctcaacgccagcaaagtgcggtcgcagcggccagcgcggatagaaagag

SEQ ID NO: 84910 - protein, 192 aa, Zea mays
  misc_feature: Ceres CLONE 1571087
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATNNDGAAAVAASDPDKLLSLLPSPPMKLPIIGHLHLMGDIPYVSLAALATRYGPDLMLLRLGAVPTVVVSSPRVNDAVLRTYDHVFSSRQRSLVSDIIIVRRHRLVLRALQRHFRQARDTGHRAPAQRQQSAVAAASADRK

SEQ ID NO: 84911 - DNA, 888 bp, Zea mays
  misc_feature: Ceres CLONE 1571088
  misc_feature: Encodes the peptide sequence at SEQ ID NO. 84912
tggcggccgctctagaactagtggatcccccgggctgcaggaattcgtctcacccctagaaaaagttccccgttggacccagcctaataaaattccccattccaactcacacagatctcgtacccggcagtggcgacgaatctcgcggggcggaggtggtggcgcgactgaggcggtgtcgactccgacgaactcgcagccaccgggggatacgcagcagcagcaccggcgtactccatcgacgttcatatttaaggacttggtttggataattctactcgtcaacaaaagtgattaaaaatggtggttcttgcagcttcaatcgtttcaaagtcgggaaaagcacttgtttcaagacagtttgttgacatgtctcgcataagaattgaaggattacttgctgcgttcccgaaactggttggaactggggaaacagcacacttattgttgaaactgaaaaatgtgcgttattgtttatcaaccctattggaagggattgtatccttcctacttttttcccaaaacaaggccgaaaccaatttttccttggaaaaatatgggacaccctttgaggggcctccccctcccaagccttttgtggccctggaaaaacccccccctttccccttggggaagaagggaaacgggattttttgttaaaaaccacccctttttgggaaaattatattttttgggctttttcccaaaaaaaaacccctcctccctcttttgtggggaaacacaaggggaaaaaatatgtggccccgcggggcccccccaagggttttaaaaaaacaatttttttgttgaaaaatgggggaaaaaacccccctcttaaaaaaaaaaagaggggccccccaccacgcggcgtgtggtttgggtggcggc

SEQ ID NO: 84912 - protein, 119 aa, Zea mays
  misc_feature: Ceres CLONE 1571088
MVVLAASIVSKSGKALVSRQFVDMSRIRIEGLLAAFPKLVGTGETAHLLLKLKNVRYCLSTLLEGIVSFLLFSQNKAETNFSLEKYGTPFEGPPPPKPFVALEKPPPFPLGKKGNGIFC

SEQ ID NO: 84913 - DNA, 791 bp, Zea mays
  misc_feature: Ceres CLONE 1571093
  misc_feature: Encodes the peptide sequence at SEQ ID NO. 84914
gagctccccgcggtggcggccgctctagaactagtggatcccccgggctgcaggaattcgtctcacccctagaaaaagctcgctcgcccgccaccgagagactacactctacgtgtgtgcctgcgagagcgagagcgcaccagcagccagcttcctctgcgcgcggcctgctggtcgcttcgcttcgctccagtccagggcggcacatggcggggggcgggggcggccgggacctcccgtcgacgccgacgtgggcggtggccctggtgtgcgccgtcatcgtgctcgtctccgtcgccatggagcacggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccggccaaggctggcagcatcatgctgccgtgcaagccgccgaaagccgccgccgccgacgacgacgacaagagcgacggccgccggagactcctctggtacccgccgtaccctggatacgatgagcccggccaccaccgccgtttcctcgccggcgcggctccggacgacaactactgcagtgaccaaggcaaggtgtccctcatctcctcggccggcgtccaccagctgcacatcttcatcttcgtgctcgcggtgttccatatcgtctacagcgtcgccaccatggcgctggggcgtctccaaatgaggaaatggaagaaatggggatcg

SEQ ID NO: 84914 - protein, 195 aa, Zea mays
  misc_feature: Ceres CLONE 1571093
  misc_feature (5)..(195): Pfam Name: Mlo Pfam Description: Mlo family
MAGGGGGRDLPSTPTWAVALVCAVIVLVSVAMEHGLHKLGHWFHTRQKKAMREALEKIKAELMLMGFISLLLAVGQTPISKICIPAKAGSIMLPCKPPKAAAADDDDKSDGRRRLLWYPPYPGYDEPGHHRRFLAGAAPDDNYCSDQGKVSLISSAGVHQLHIFIFVLAVFHIVYSVATMALGRLQMRKWKKWGS

SEQ ID NO: 84915 - DNA, 826 bp, Zea mays
  misc_feature: Ceres CLONE 1571097
  misc_feature: Encodes the peptide sequence at SEQ ID NO. 84916
tccccgcggtggcggccgctctagaactagtggatcccccgggctgcaggaattcgtctcacccctagaaaaagcccccttccgggggggcccgagccatcagtgagataccactctggaagagctcggattctaaccttgtgtcagacccgcgggccaagggacagtctcaggtagacagtttctatggggcgtaggcctcccaaaaggtaacggaggcgtgcaaaggtttcctcgggccagacggacattggtcctcgagtgcaaaggcagaagggagcttgactgcaagactcacccgtcgagcagagacgaaagtcggccttagtgatccgacggtgccgagtggaagggccgtcgctcaacggataaaagttactctagggataacaggctgatcttccccaagagtccacatcgacgggaaggtttggcacctcgatgtcggctcttcgccacctggagctgtaggtggttccaagggttgggctgttcgcccattaatgcggtacgtgagctgggttcagaacgtcgtgagacagttcggtccatatccgggtgtgggcgttagagcattgagaggaccttttccctagtacgagaggaccgggaaggacgcacctctggtgtaccagttatcgtgccctacggtaagtcgcatcgcacgccatcagcagctagcgcgcttctcgagcccagcagagaaagccggcagcgctaatcgtataagcatgggctccaccgcggcgacatggccgcggtggtgaaccaaggagcgtgcatgtacccatgcaactgggggccttcctccatctggccatgaagt

SEQ ID NO: 84916 - protein, 34 aa, Zea mays
  misc_feature: Ceres CLONE 1571097
PRGGGRSRTSGSPGLQEFVSPLEKAPFRGGPSHQ

SEQ ID NO: 84917 - DNA, 953 bp, Zea mays
  misc_feature: Ceres CLONE 1571098
  misc_feature: Translation starting site: 197
ggagctccccgcggtggcggccgctctagaactagtggatcccccgggctgcaggaattcgtctcacccctagaaaaagtcgctcccctcctctgtccgcgatctcggctggccgcctgggcttggccctcgccccgctcccgtctccggttccggcggccgagccagatttgctcgggtcttcgtgccagcgacgatgaaggacaagcgtggactcgaggacgccggcgacgggcgccctgatgccaagaggccgcggcctccggctctggccagtgttattgttgaagcgctaaaggtggatagtctgcagaggctctgctcatcattggaaccaattcttcgtagagtagtcagtgaagaagtggagcgtgcactgggcaaacttggccctgcaacaatcggtggaaggccttccccaaaaagaattgaaggtccaaatgggagaactctgccactcgaaatcccgaacaaagctgtcacctcccctttttactggaggaaaagttgaaggggaacagggagctgcaaatcatgttggttttgtttgaagcctggcccgggctgggttgtatcccccggacccaaagccggcggccaaacttgaaaatcgttgtttctaaaaggggatttccacaatgaaaaataaggggggctggccccgaaaaaaaatttgacacccccttttttaaggaccggagggaaaacggccctttttaacggggggtccccaagcccccttaaaaaagggggggggaaatttgggggctttctcttcccagaaacccttcgcgggaagggggtgggaattccccccgggctttaaaatccccccggattttggggggggtttccccctggggaaaaaaaaaacccttttggttgggcccccgggagaatgttataaacccctccccccccgcaaaaagaggggggggggaaaaaaaagaggg

SEQ ID NO: 84918 - DNA, 851 bp, Zea mays
  misc_feature: Ceres CLONE 1571099
ggagctccccgcggtggcggccgctctagaactagtggatcccccgggctgcaggaattcgtctcacccctagaaaaagagctccgtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcaattttttttttactgtcaaggataagcaagtgacctctgtgtgcataccaccaccacccatacctagcatacacaggcacagatgggagaccataaagggaacgttctctttgcacaagtatgaaaaggggaaaattgctttgcgcaaggcaacctttgccaagggttacccaggcttcgtaacacgggggactttcggaaagtgggccccgaatcaaagtgatttgaaataggagaaaagttttta

SEQ ID NO: 84919 - DNA, 923 bp, Zea mays
  misc_feature: Ceres CLONE 1571101
  misc_feature: Encodes the peptide sequence at SEQ ID NO. 84920
  misc_feature (716)..(716): n is a, c, t, g, unknown, or other
tccccgcggtggcggccgctctagaactagtggatcccccgggctgcaggaattcgtctcacccctagaaaaaagccccattcccgcgccccgacctttcctgtaccatccccgctggcccgctcgctctcttccggcctcgcgttccgtctccgaagccgcaggcagccatggacgtcaacgaggaggcaatggcggcgcacaagcgcgccttcctcgacttcctcgaccaagacgtcgggaagggggtttacatgcaggccgtccgcgacatggtccagaacaagcgccaccggctcatcatcggcatggacgacctccgcaaccacaacctcgatctcgcccgcagggtgattcggagccccggggagtatatgcagcctgcgtcggacgcggtttcggaggtagcgaagaaccttgatcccaaatttttgaaggaaggggagcgggtgatggtgggcttctcgggtccgttcgggttccacagggtcacgcccagggatctcatgtcctccttcatcggcaccatggtctgcgttgagggcatcgtcaccaaatgttcattggtaaggccaaaagttgttaagagttgtcacttttgccctgtgactggagccttctctcgcgtggatatagagacatcacttcttttgtagggttgcctaccggctctggttatcccacaagggatgaacacggcaactttgttgtcaccnagtatgaaatgtggggaattaagggatccccgaaatttgcccaggcagaaagtgctgaaaattttgacccgggacacctccaaggatcggtgatgtttttggagaaaaagatcttttaaattgttgaaaccctggggaccgggttccaatttgtgggggggtcaaggctctcccgggaaaaaacaaggaaatgttttgttgttgttt

SEQ ID NO: 84920 - protein, 161 aa, Zea mays
  misc_feature: Ceres CLONE 1571101
MDVNEEAMAAHKRAFLDFLDQDVGKGVYMQAVRDMVQNKRHRLIIGMDDLRNHNLDLARRVIRSPGEYMQPASDAVSEVAKNLDPKFLKEGERVMVGFSGPFGFHRVTPRDLMSSFIGTMVCVEGIVTKCSLVRPKVVKSCHFCPVTGAFSRVDIETSLLL

SEQ ID NO: 84921 - DNA, 889 bp, Zea mays
  misc_feature: Ceres CLONE 1571102
  misc_feature: Encodes the peptide sequence at SEQ ID NO. 84922
catagctggagctccccgcggtggcggccgctctagaactagtggatcccccgggctgcaggaattcgtctcacccctagaaaaagccaccacttgaattaccgcacacggctccgctgcttcgcgactcctctccggctctccgcacaggactccaaccgcctcgccgttgcatcgccgcgggcgtcaacctaggctgctgccggtaccggtgcgtccccagccatggctcggccgccgcaggaggcgatcgacaccttcgtcagcatcaccggcgccgacgaggtcaccgcagtccgcgtgctcgaggaacatggtcatgatctaaatgaagctgtgaatgcttattttaatgaaggagataggaccaccaccagaatcaatcagaatcctgtgcctgccactgccagttatgatgacatgatggagctggatgaaccactttgatcccatgtttcacacgacctttgttccccaaaaactttgggcaacccttttggcccttttggaacccagggtttgcctgacttaacggccgggggatatatttttggacgtgggacccccagttacacaaacccaagggaacgtgggggaaaatccccctttggaagtttaaggcagcaatactccaaacagggagtttcggggcaagggcccccttttttgggaggaaggtttacggggacgtgaaatcttttttttgggggcccaaaggcccccagggggaaccctttttttttttggccccgaaagagaggaagaaatgtcccccttaaaaaacattttggggcggggggggcccctaaaaaaaccccccacgaggggggtttttcccccgcgaaacaaattttttgtggccgagggggggggcccccccccagcgaag

SEQ ID NO: 84922 - protein, 73 aa, Zea mays
  misc_feature: Ceres CLONE 1571102
MARPPQEAIDTFVSITGADEVTAVRVLEEHGHDLNEAVNAYFNEGDRTTTRINQNPVPATASYDDMMELDEPL

SEQ ID NO: 84923 - DNA, 763 bp, Zea mays
  misc_feature: Ceres CLONE 1571105
  misc_feature: Encodes the peptide sequence at SEQ ID NO. 84924
ctggagctcaccgcggtggcggccgctctagaactagtggatcccccgggctgcaggaattcgtctcacccctagaaaaaaaccctactctgccttgtcttctcccatcattcccaagcgtgagcaaaaccccaccaccgaagactgcccgccgccgacgcccgcctccatcctctcctccagttcctcctagcgccgccgcccgactccctcctccagcgccggcgcccaaatccctcctccagtgccgtcgccgactctccgcccgcgtccatcctccggttccagcttacattggtccatcctctcctctgccccctcctccatccttcatcagattcagacggtgaagcacccagtcccagttcaggttcaaacagacgctccgcacgagctggagatggaggtggaggtggccaaatattcacgggggcagggtgctgacctgaaggcgctgggggacaagaagttgaaagggcagctcagtgtaaaagagaagctatatggccaatctgcaaaagctgctgcaaatgccgaaaagtggcttatgcctaatgatggaggtattttagagcctggtcatttggagaaaacatatagattttcacaagaggatatattgacagaggtggatcttttgagttcaagaaaaccatttgatatgatcttacctgtactcggtcctttatatataggatacacctcaaacggccgctacatgctagtaggcggacgaaaaagcccacctgcaatgatggatatg

SEQ ID NO: 84924 - protein, 121 aa, Zea mays
  misc_feature: Ceres CLONE 1571105
MEVEVAKYSRGQGADLKALGDKKLKGQLSVKEKLYGQSAKAAANAEKWLMPNDGGILEPGHLEKTYRFSQEDILTEVDLLSSRKPFDMILPVLGPLYIGYTSNGRYMLVGGRKSPPAMMDM

SEQ ID NO: 84925 - DNA, 841 bp, Zea mays
  misc_feature: Ceres CLONE 1571106
  misc_feature: Translation starting site: 127
ctccccgcggtggcggccgctctagaactagtggatcccccgggctgcaggaattcgtctcacccctagaaaaatcagccatccccttttgctgcaaatctttctctgaattgtgggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccagggcctacaagctgatccatgccagatgggccatgctcagtgccgctggcgctgtcatccgggaggcctgcaacaagattcggcgctaactgggggccctgaagctggtctggttcaagaacgggccccggctcctggaaaggaaaacaccctcaaactactttcggaaaacacatcccccataaaaccgggttgggtggcccggtatccccgaaaggccatccccccgtcgggggggccccaaaattctttcccggaatccccccaacggaatggggaaccataaaggaaaaaaccttggacccccgggggggggcccctctttaaacaccccactggaggccctgtggccaaaggaaacacccaaaacaaag

SEQ ID NO: 84926 - DNA, 861 bp, Zea mays
  misc_feature: Ceres CLONE 1571108
  misc_feature: Encodes the peptide sequence at SEQ ID NO. 84927
acccgcggtggcggccgctctagaactagtggatcccccgggctgcaggaattcgtctcacccctagaaaaagaggcaccatgaagggaaaaaaagagggacaggaaagaaatcgttctcgtttcgctctccgctagaccccgtccaaatcaatggaaattagggctccaccgacgagcctgatgctcgcgccgccacccgcctccggcagctaccgccaaaccccgcttaggacctccttccttcgcggcagcgtgtaacttaaagttgtgcaagaacggcactccaatgtcaacatatttaactgcaatagcatacgaagtaacctctttgataggctaacaagggttgtcaggacctacgccaatgcagttctaagttcgtttgaagaccctgagaagattctagaccatgcagttctggagatgaatgatgacttgacaaagatgcggcaggccactgcacaggtcttggcatctcgaaagcggcttgcgaataaatataaagctgcagaacaagcttctgctgattggtatcggagggctcaacttgctcttcaaaagggtgacgaggatcttgctcgtgaagcccttaagcggcgtacatcatatgctgacaatgcgagctccttaagatcccagcttgatcagcagaacggtgtagttgaacatctgatttcaaatagccggcttcttgagagcaagatcgcataggccaagcggaagaaggataccctataagctcgtgctctatcagcacagactgctacaaaagtgagtgcaatgctgggcatcgtgaatacaagtagcgcgctttctgcttttgagacaatggcacgaaaaagtatgggcgatgaaatcg

SEQ ID NO: 84927 - protein, 95 aa, Zea mays
  misc_feature: Ceres CLONE 1571108
MNDDLTKMRQATAQVLASRKRLANKYKAAEQASADWYRRAQLALQKGDEDLAREALKRRTSYADNASSLRSQLDQQNGVVEHLISNSRLLESKIA

SEQ ID NO: 84928 - DNA, 805 bp, Zea mays
  misc_feature: Ceres CLONE 1571112
  misc_feature: Encodes the peptide sequence at SEQ ID NO. 84929
  misc_feature (601)..(601): n is a, c, t, g, unknown, or other
ctccccgcggtggcggccgctctagaactagtggatcccccgggctgcaggaattcgtctcacccctagaaaaattcagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaagcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctnctttggattcctccctcctccaatctcaggattggtgttctgattcaactgctcaaatggcgtgtcctttcggcctgcggagctttccccgggctcagcttatcggggtttggaggcttttagaaaccccctttgaaattccatttctcggagggccccggtttttgggggaaccccccagggggggggggttggcgggccccc

SEQ ID NO: 84929 - protein, 50 aa, Zea mays
  misc_feature: Ceres CLONE 1571112
  misc_feature (1)..(50): Pfam Name: AdoMetDC_leader Pfam Description: S-adenosyl-l-methionine decarboxylase leader peptide
MESKGGKKSSSSRSMMYEAPLGYSIEDVRPAGSVKKFQSAAYSNCAKKPS

SEQ ID NO: 84930 - DNA, 715 bp, Zea mays
  misc_feature: Ceres CLONE 1571116
  misc_feature (203)..(203): n is a, c, t, g, unknown, or other
  misc_feature (223)..(223): n is a, c, t, g, unknown, or other
  misc_feature (232)..(232): n is a, c, t, g, unknown, or other
  misc_feature (239)..(239): n is a, c, t, g, unknown, or other
  misc_feature (319)..(319): n is a, c, t, g, unknown, or other
  misc_feature (658)..(658): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (700)..(700): n is a, c, t, g, unknown, or other
  misc_feature (701)..(701): n is a, c, t, g, unknown, or other
  misc_feature (710)..(710): n is a, c, t, g, unknown, or other
tggagctccccgcggtggcggccgctctagaactagtggatcccccgggctgcaggaattcgtctcacccctagaaaaagttccgcttcgtcccagcctctagttcttcctttcctccagagtgatggccaaatgctactcagattggccaccgattccgcctttccatccatcgcgaagaacgccgccgcaatcccacgccntccccgatcacgatcaggcnggcagctcngtgtccnttcgtgctcccagtgctccagatcctgcgctccccctcctcgagcctcagaacctgcccgatgagttcgaaggcgtgccngcgaagacgaacgccgccgctgccggacgccgccctgaagctgggggatttctaaccaggttcattcgaggccttttgcggggaaccccgcaaaaccgagcagcttggccttttcaggggctaaagaaagggggcttgcttggcaccccaaaatttccggcttgggaaaaaaaaaaaaggggccaaacgcccttaaccccttgggatttttaataggggggaaaaaacaagggggggggcctccctcctggggaacttttttggggttaaagaaaaaattttttgggggggccccccccgcgggggtgtgtgctcccccctccggggaaaaaaaaaaangggggggtttttttttctccccctcccccccnnnnccgcgcnntttccgccntcccc

SEQ ID NO: 84931 - DNA, 2007 bp, Zea mays
  misc_feature: Ceres CLONE 1571117
  misc_feature: Encodes the peptide sequence at SEQ ID NO. 84932
aactatgacccctgctgcctttccatcttcctcgatctccctagctcgctctccaatctcccatttctctctctctctctctcgtcttcgccatccaccatccatcccgtcgtcgtgatagatggcggcagtccagccgtccgtggagatgacgacgcagcaagggccgccagccgccagctattctccggccagggatggcggcggcggcaggagcgccgaggatgaggagaaggagaaggcggcggcgatcgacaactggcttcccatcagcgcgacgcggaatgccaagtggtggtactccgccttccacaacgtcacggccatggtcggcgccggcgtgctcggcctcccctacgccatgtcccagctcggctggggtgccggcatcacgatcatgctcctgtcgtgggtgatcacgctgtacacgctgtggcagatggtggagatgcacgagatggtgccggggaagcggttcgaccggtaccacgagctggggcagcacgcgttcggggaccgcctgggcctgtggatcgtggtgccgcagcagctggtcgtcgaggtgggggtgaacatcgtgtacatggtgaccggcggcacgtcgctgcagaagttccacgacgtgctggtgtgcggcgacgcggcgtgcgagggcgggcgcaagatcaggctcacctacttcatcatgatcttcgcgtcctgccacttcgtgctggcgcagctgcccaacttcgactccatctccggcgtgtccctggccgccgccgtcatgtcgctcagctactccaccatcgcgtggggcgcgtccgtgagcaaagggcgggtccccgacgtggactacggcctcagggccaccacgccgccgggcaaggtgttcgggttcctgggcgcgctcgggaccgtggcgttcgcctacgcgggccacaacgtggtgctggagatccaggccactatcccgtccactcccgagaagccgtccaagaagcccatgtggaagggcgtcgtcgtcgcctacctcgtcgtcgcgctctgctacttccccgtctcgttcgtcggctactgggccttcggcgacagcgtcgacggcgacatcctcgtcacccttaacagacccaggtggctcatcgccctcgccaacatgatggtcgtcatccatgtcattggcagctaccagatctatgcgatgcccgtgttcgacatgatagagacggtgctggtgaagaagctgcgcttccctccaggcctcacgctccgtctcattgcccgtactgtctacgttgcgttcacaatgttcatagccatcacgtttcccttcttcgacgggctgctcagcttcttcggcggattcgcgttcgcgcccacaacctatttccttccatgcatcatgtggctcgcaatctacaagcccaaacggttcagcctctcatggttcaccaactggatctgcatcatccttggagtgcttctgatggtgctggcgccgattggagggctccggcagatcattatcagcgccaagacatacaagttttaccagtaaacattgcacaattatcgtgcaaaaaacaacgcaaaccccttgcttcaccagtaactgacagacaagtcttgttaggccatatataccatgttacgatcagctgacacaggttctggattttgttccatgagggcttccaactccttgtttaatttggcacgacaaaaagctcgcaccgggtgctctaatcggcggccgattacagcgtccagtgcgagttctttgccgtgccaaaattgaaagggggtcggctcggatgccggggcatgcatacaggacctagaacccgtttcggttgatgagaatgttcctggcatgtaatgcttcccttgttggttgtggtctaacctaggagtttgctttgagtggatctttgtacaattgtacgtgtatatgatgtttttttcccttcttcatacttgtttacattattcaggggaattggatcttaaaaaaaaaaaaaaaaa

SEQ ID NO: 84932 - protein, 472 aa, Zea mays
  misc_feature: Ceres CLONE 1571117
  misc_feature (54)..(459): Pfam Name: Aa_trans Pfam Description: Transmembrane amino acid transporter protein
MAAVQPSVEMTTQQGPPAASYSPARDGGGGRSAEDEEKEKAAAIDNWLPISATRNAKWWYSAFHNVTAMVGAGVLGLPYAMSQLGWGAGITIMLLSWVITLYTLWQMVEMHEMVPGKRFDRYHELGQHAFGDRLGLWIVVPQQLVVEVGVNIVYMVTGGTSLQKFHDVLVCGDAACEGGRKIRLTYFIMIFASCHFVLAQLPNFDSISGVSLAAAVMSLSYSTIAWGASVSKGRVPDVDYGLRATTPPGKVFGFLGALGTVAFAYAGHNVVLEIQATIPSTPEKPSKKPMWKGVVVAYLVVALCYFPVSFVGYWAFGDSVDGDILVTLNRPRWLIALANMMVVIHVIGSYQIYAMPVFDMIETVLVKKLRFPPGLTLRLIARTVYVAFTMFIAITFPFFDGLLSFFGGFAFAPTTYFLPCIMWLAIYKPKRFSLSWFTNWICIILGVLLMVLAPIGGLRQIIISAKTYKFYQ

SEQ ID NO: 84933 - DNA, 790 bp, Zea mays
  misc_feature: Ceres CLONE 1571119
  misc_feature: Encodes the peptide sequence at SEQ ID NO. 84934
ctcaccgcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcagccaccgccgtctctccgttccaggggctcaagtccaccgccagcctccccatcgaccgccgctcctccagaagcctcggcaacgtcagcaacggcggaaggatccggtgcatgcacgtgtggccggcctactgcaacaagaagttcgagacgctgtcgtacctgccgccgctgtcaacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgcctcccaggtgtacaaggagctgcacgaggccatcaaatcctaccctgacgccttccaccgagtcatcggcttcgactacatctagcagacgcagtgcgtcagcttcatcgcctacaagcccccgggcagcgaattgaaccgtgccctgcagacaccccccggcggctagctattaactcctgcctgaactaatagcttaactagggacatggcgccgtctccagccggtaggtttttgccttcaggggccaccgttaccctttacccttgctagagttt

SEQ ID NO: 84934 - protein, 153 aa, Zea mays
  misc_feature: Ceres CLONE 1571119
  misc_feature (58)..(154): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVSPFQGLKSTASLPIDRRSSRSLGNVSNGGRIRCMHVWPAYCNKKFETLSYLPPLSTDDLLKQVDYLLRNGWIPCLEFSKVGFVYRENSTSPCYYDGRYWTMWKLPMFGCNDASQVYKELHEAIKSYPDAFHRVIGFDYI

SEQ ID NO: 84935 - DNA, 855 bp, Zea mays
  misc_feature: Ceres CLONE 1571120
  misc_feature: Encodes the peptide sequence at SEQ ID NO. 84936
  misc_feature (525)..(525): n is a, c, t, g, unknown, or other
  misc_feature (548)..(548): n is a, c, t, g, unknown, or other
  misc_feature (553)..(553): n is a, c, t, g, unknown, or other
  misc_feature (650)..(650): n is a, c, t, g, unknown, or other
tccccgcggtggcggccgctctagaactagtggatcccccgggctgcaggaattcgtctcacccctagaaaaacccttctgctttgccttttccccttcctctctcccctgtcccccctccgtcccagccgagcgagaaagcgaaggggccaaaaaagccgcaccggcttccttcccccacccgaagagatggaactgttctacgaactgctcctcacggcggcggtcaccctcctcgctgccctcctgctcgccacgctcttcgcagccaatgattcccatcgccggaccgatcgcgccgcagccgcgatcgccgaggaggtggcggaggaggagaggatcatcgaggtcgacgaggtgatgcgtagcgaagggatggcggcggtggcgccgtccgaggcggatgggtgggttgaggcggagaaggcgccggcggtggtcgtcgcggaggtgaaggagccggagagcttgcccgaggaggagggggttcccgtgtaagctgttcaggaggtgcgcctgctgccngtaagtggaggagggggatgacngtcgntggcggccttgaaaccgcctgatttcgacctccgcaactggttgtgccgctgggggttgctaaatcctacccatctgggtgtcgggctcttaaagcnataccttaagaaaggttccgggccctgcaaaggttgggaagtaacctaaccgtgcccggattgtttttggggaaaccccatttggttccggggggctggaggattggccaattgtcccccgggtaaaaaattctttaaaaccatgtaccggggactaaaggtgggaaaccaaaaaaatatgggttggaaatattccccccagttg

SEQ ID NO: 84936 - protein, 102 aa, Zea mays
  misc_feature: Ceres CLONE 1571120
MELFYELLLTAAVTLLAALLLATLFAANDSHRRTDRAAAAIAEEVAEEERIIEVDEVMRSEGMAAVAPSEADGWVEAEKAPAVVVAEVKEPESLPEEEGVPV

SEQ ID NO: 84937 - DNA, 849 bp, Zea mays
  misc_feature: Ceres CLONE 1571121
  misc_feature: Encodes the peptide sequence at SEQ ID NO. 84938
ctccccgcggtggcggccgctctagaactagtggatcccccgggctgcaggaattcgtctcacccctagaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccatcgggcccggacgccggctcgccggccttctcggagcgcgtgcgccgccgcctgccggacttcctgcagtcggtgaacctcaagtacgtgcgcctcgggtaccactacctcatcaggcacggcgtgtacctgggcaccatccccgtcatcgtgctggtgtgcggcgccgagctgggcagcctcagccgcgacgagctgtggcgcaaggtgtggggggaggccacctacgacctcgccaccgtgctcgccttcctcgccgacctcaccttcaccatctccgtctacatcatgtacaggcccaggcccgtgtacctcatcgacttcgcatgctacaagccggtcgacgagctcaaggtgtccaacgcggagttcatcgacgtggcgcgcaagtccggcaagttcgacgaggacagcctggtgttccagtcgcgtctgctggacaagtccggcatcgacgacgagtcgtacatgctgcgctgcgtgttcgagcccaacgccagctgcgtcaccatgcaagacggccgcgccgaagctgtcacagacatggttcgcgcgcctggacgagatgttcgacaagtgcctcgtccggcctaaggacgtgggcgtt

SEQ ID NO: 84938 - protein, 217 aa, Zea mays
  misc_feature: Ceres CLONE 1571121
  misc_feature (115)..(217): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREEQALLSTEIVNRGVEPSGPDAGSPAFSERVRRRLPDFLQSVNLKYVRLGYHYLIRHGVYLGTIPVIVLVCGAELGSLSRDELWRKVWGEATYDLATVLAFLADLTFTISVYIMYRPRPVYLIDFACYKPVDELKVSNAEFIDVARKSGKFDEDSLVFQSRLLDKSGIDDESYMLRCVFEPNASCVTMQDGRAEAVTDMVRAPGRDVRQVPRPA

SEQ ID NO: 84939 - DNA, 1007 bp, Zea mays
  misc_feature: Ceres CLONE 1571123
ggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctgggctgccgagcaaagcggggggcaacagcagcgggatcccccgtgctggtcgacgaagacgacccgctcgcggctcgaaatcgtttctaaacatcactctgggtgaacaaaggcaggggcgctccctaaggcttgaaggatgggatgtttcccagaacccaccttccgggggtttacttaggaaggggaagcgtctccgtccctccctcaaaaaaaaaggggccgcaagtttctcgtccgggaaattttgtttcttaccggggccccgtgggggaaaaaaattttcggggctccctgggggtaacagcaaaccggggtgccaacctccaagggggaaaattaacccttgcttgttttccggggaaaaagggaaagggaagaaaatccctggtggcccccggcctttggcaaaactaaataatctccacaagaggccacttctcgccgttgattcctggttcccccaggggaaacccttcccaaaaataaaatttaaagggggggggcccccccctcgagaaaattttggtggggaagaggggggaaattctcccttattctaagggcgaattaaaccccccctttgtgaaataaacaaggtgggccaaaaccccgctcgg

SEQ ID NO: 84940 - DNA, 945 bp, Zea mays
  misc_feature: Ceres CLONE 1571128
  misc_feature (325)..(325): n is a, c, t, g, unknown, or other
  misc_feature (798)..(798): n is a, c, t, g, unknown, or other
  misc_feature (800)..(800): n is a, c, t, g, unknown, or other
ctccccgcggtggcggccgctctagaactagtggatcccccgggctgcaggaattcgtctcacccctagaaaaaaaaggggacggcagccaggaaggaagaggaggcttcgagatttttgcggaacccccacgccacccccctctgcacaccaccacaaccttctcctcatagcctgcctctcgcgtagggtttgcgcgcgccaccgtctccactccaatcccagcaccacccgtcctaccgccgccgcattcggagctctgcatctgcctgcagcccgattcgccaatcgccaccgagcctcgagaagctcgccgtaccggttngggatttctggtttccctttctcactggtactgttgctgggatctgaggagtgtttgtattggtgcctaatgtttctgccaattttgggcggaatatccacgctgaatgggaatggggatggccgccgattaaattgggggggttgggaaaagggggattcctttttttttaaaaggggggaaaactggaaaaccccaccctcttctcattaaaaagggggccccgaaaaaaaaaaccccccgaaaattttttgccccagaagaatggtttttttttttctcgcccccccacacaaaaaaaagagggtttccctttctaaaaaaaaatatgggggccgggtggtcttatcggtggggttgtttttatacctcaaaaacaaaaaaaaaaaaaaaatgttgtgggggggaaaataaaaaacagacccccctacttttacatcctttctaggggatcggggtgttatcgtttttgncnctatataacctctctccctctcctcccgtcttccgaatgatgtattactctactattgtttctgggtggtggttcggggcatataaaaacgctcccttttttcaatccgtggcggttttatatttcgtgattttacgaccaccag

SEQ ID NO: 84941 - DNA, 1009 bp, Zea mays
  misc_feature: Ceres CLONE 1571130
  misc_feature: Encodes the peptide sequence at SEQ ID NO. 84942
  misc_feature (7)..(7): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (62)..(62): n is a, c, t, g, unknown, or other
  misc_feature (63)..(63): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (583)..(583): n is a, c, t, g, unknown, or other
  misc_feature (791)..(791): n is a, c, t, g, unknown, or other
  misc_feature (826)..(826): n is a, c, t, g, unknown, or other
  misc_feature (912)..(912): n is a, c, t, g, unknown, or other
  misc_feature (913)..(913): n is a, c, t, g, unknown, or other
  misc_feature (1009)..(1009): n is a, c, t, g, unknown, or other
agggggngaggggnnnnggagggagagggagggggaagaggaaatcagagaagggcgcgggnnaaataccnnnnttaaaaaactgggactccccgcggtggcggccgctctagaactagtggatcccccgggctgcaggaattcgtctcacccctagaaaaaaaaaaccgcgccagcaggcccagctccaaccaccgctcgtctcgtctccttcctcccgtctcgtctccgacgacctcgtctttcccccccagccagcctcgcctcaccgactccccgatccggtccctcccttcgccagctatgcacccctcctccggcgcgggggactacgccccttactacccaccttacccctccccggccgcgccgcctcccgccgcctacccgtcggtgtccgccccggcttccgcgcccccgtactcgtcgtaccccgcggacttcgcccccgcgccttcgtaccccgcgtacccgcccgccgacctcccccactatgcgccgaccgccggctagcgccctcgcccgccgcagccggtactaccccctaactaatccggagcccgggcgcccgccggctggccgnccgtccccccccacaaaccccggggtggccctttctcccggtacccccgttcagctgggaattcggggcgggggggaaacctacccgggcttaaccggaaaatccggggcccccctggggcctttcccggggggttacccgggccccaaagaaaaacctttgtaaacccccggcccccaaaacccccagaacaagagaaaaaggattngggcccccaaaaccaaaccgggaagcccgcttccnccttttaaaaaaaggcccggggcaaaacccccccccgggaaaaccccgtatagggggttcccagggggggccacacccaattctcnnaggggcccgggggccccggggatatccccccccctttgtttttttatgaaacccaccggggaaggatcccaatttggcctccaaccgccccccaan

SEQ ID NO: 84942 - protein, 69 aa, Zea mays
  misc_feature: Ceres CLONE 1571130
MHPSSGAGDYAPYYPPYPSPAAPPPAAYPSVSAPASAPPYSSYPADFAPAPSYPAYPPADLPHYAPTAG

SEQ ID NO: 84943 - DNA, 908 bp, Zea mays
  misc_feature: Ceres CLONE 1571132
  misc_feature: Translation starting site: 259
  misc_feature: SWISSPROT Homolog: EC 6.4.1.4 Methylcrotonoyl-CoA carboxylase
  misc_feature (443)..(443): n is a, c, t, g, unknown, or other
ccccgcggtggcggccgctctagaactagtggatcccccgggctgcaggaattcgtctcacccctagaaaaaggcgtctagtcatcagatcattatccgcaccgacttgcgtgcacgagcttcgcggcgagggcagcaccggggctgggaatgggaagacactgcagcccagctccagcagcactacagcagtagcgccaccgaacctgaaaactccgaccccccacgaaatcgcggaacctacccacgagccgagccatgctcagccgactcgccgcggcgaggcgacagctactgctatccccggccgtcgcgtaccgctcctcctcggcagcggcgacggcgtcggcggtccacgagagagcagcgcccgcctcggcctccgtgctcccggacaccctcgaaaggggctccgacgcgtaccagcgcaacacggccgccgntcggcgggttgctctccgacctgcgcgcccgcgtctcccaggtgctgcgcgggggaagcgccccaagcggtgaggcggaaacgcgcgcgggggaagctgctcccgcgggaccgcatcgaccgactgctcgaccccgggcgcgtccttcctcgagctctcgcagcttgcaagctcagatgtttatgatgaagcataccatcagcaggtataataactggcataggacctgttcatggacggtttatgtatggttgttggccatgaccaaccacctaaggtggcacatactatcctcttactgtcaaaagcatctgcgagcacaggaataacttccgaatgcaactgcctggcattatctcgttgaaagcgaagtgctatctcccaaggcagctgacgttttcctgaccggataatttgggcggaattcaccatcagctaaatgtctcgatggatcccccgaatgga

SEQ ID NO: 84944 - DNA, 843 bp, Zea mays
  misc_feature: Ceres CLONE 1571134
  misc_feature: Encodes the peptide sequence at SEQ ID NO. 84945
ctggagctccccgcggtggcggccgctctagaactagtggatcccccgggctgcaggaattcgtctcacccctagaaaaacttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaagttgctatctatagagaggagccctcccattgaagaagttatcaaatcaggtgtagttccaagatttgtgcagttgctcacaagagaggatttgccccagctgcagttcgaagcagcatgggctctcacaaatattgcttctggcacttcagaaaatacaaaggttgttattgatcatggggctgttcctatatttgtgaagcttcttgggtctggaagtgatgatgttcgtgagcaagctgtgtgggctttgggcaatgttgctggcgaattctcccaagtggcgtggaccttgtttcttggcaatgggtgcatttgatgcctcctgctagccccatttgaatgaagcatgccaaagctctcca

SEQ ID NO: 84945 - protein, 200 aa, Zea mays
  misc_feature: Ceres CLONE 1571134
  misc_feature (4)..(92): Pfam Name: IBB Pfam Description: Importin beta binding domain
  misc_feature (101)..(142): Pfam Name: Arm Pfam Description: Armadillo/beta-catenin-like repeat
  misc_feature (144)..(184): Pfam Name: Arm Pfam Description: Armadillo/beta-catenin-like repeat
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKSGVVPRFVQLLTREDLPQLQFEAAWALTNIASGTSENTKVVIDHGAVPIFVKLLGSGSDDVREQAVWALGNVAGEFSQVAWTLFLGNGCI

SEQ ID NO: 84946 - DNA, 1236 bp, Zea mays
  misc_feature: Ceres CLONE 1571135
  misc_feature: Encodes the peptide sequence at SEQ ID NO. 84947
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (388)..(388): n is a, c, t, g, unknown, or other
ttaaaannttttnntttttatccttgcttaccggcttgccgattgcgcccccgcaccgtgaggaattttttttaatattgaactacccgcggtggcggccgctctagaatagtggatcccccgggctgcaggaatgcgtctcacccctagaaaaaattcgataaccaagaacaacacattgcttggacgcgttcccctcctgtacgcaacctcatttcgtcctccagatccaggatgggcgtcctccttgagaccttgcctacccaagtgctctcggtgagctactttgtttcgatttatcaagaaatccgtttgcttcatgttgtggcggctcatatcttgattgctggattctgtttaacccgcgttggatcctgtctcggcttcncccttgcctgccaggtcgcttggcgtattagattccgtgggccaacgatcgcctgggtcctgttttctttcatccacgaacgaaagaaatcgccaaagtctttccccccttttggggttggggtaatggggatatgaacgcgcgacttatcagattggcaaggtgagtctggtaaccttactagatcgagcaggttcttatgtcaattctaagaaatcgaatgatatatattgtttggcgcccggatttacttttcttgcgagccctatttttccccaaggagccctaactactgtacaaactcccgtggacaaataataggccggtcccgttgacaacaacacgaccgaggctggtgtcttataacctccaatgggtcaacaacagaaaagttagtatacttagaaacctgttgagccactctccctcaatcagacgcgacggttacgtgcctcctcttttctacccctgcctatgacagtatcccccctccctcgccacgatgcagagcatctagcgctacacgctgccacgtatctcgatctgaacaatcggtgttagtgctctctctatcgctgccatccacctcccatgggagtaggtttggcaatacctcttccactcttgtgggattcacaatgcatacaccatccgctacgacggaccccctcgacgacatttatctaccctgggatcgaatcactaataatactatagttgtgtcccacgatcgctagcactatgaggattagagtcgcaacgagccacgtcatgagtgtctgcgacgctctagggtgactgatcgccacgatgtgataacaacatgttgctaaataactgcatatatt

SEQ ID NO: 84947 - protein, 96 aa, Zea mays
  misc_feature: Ceres CLONE 1571135
  misc_feature (52)..(52): Xaa is any aa, unknown, or other
MGVLLETLPTQVLSVSYFVSIYQEIRLLHVVAAHILIAGFCLTRVGSCLGFXLACQVAWRIRFRGPTIAWVLFSFIHERKKSPKSFPPFGVGVMGI

SEQ ID NO: 84948 - DNA, 840 bp, Zea mays
  misc_feature: Ceres CLONE 1571136
  misc_feature: Translation starting site: 608
  misc_feature (792)..(792): n is a, c, t, g, unknown, or other
ctggagctccccgcggtggcggccgctctagaactagtggatcccccgggctgcaggaattcgtctcacccctagaaaaaagcgccagcggcagagagtcgagaccttctagctaggccgctgccacgtcaaaactagctcctccagacaaccaatcagctagccgaagccggtccattagcatgcagcagcgctagtagacgtcgtctccgggtctccactctccacacagaaacccatacaaaatccgcatccagaatcaccggagatacgagtccgcgcgtacgttgcagttgaattgtgaagagaggctgtgcgcactgctgctgctgctgcttcttcttcttcgacgcgtgcgtacgtgcacatggatgctgctgacctcccgtgatcttcgatctccacacggcggcaagcgatcgagaggcgtggttcccgtggcgtcaaccgacacctagcagctgctagctcatctgcttgatctctagctgagactccgagcaaaatgcagcagccaggaacaacaagctaagctaagccccctcacgcagaccgcacgaccgagcgcgcggcattgaccgacccatcgccgccgcctcgatcgaccatgacgcttgcgagcacggacaaggtggtgctgggatgcatcgcgttcagcatcttctgggtgctggccgtcttcccctcggtgccgttcatgccggtgggccgcaccgcgggctccctcctgggcgccatgctcatggtggctcttccgcgtgatgacccccggaggaggctacaaggccatcngactcccgatcctgggcctgctcttcggcaccatggtggtcagcatct

SEQ ID NO: 84949 - DNA, 840 bp, Zea mays
  misc_feature: Ceres CLONE 1571137
  misc_feature (310)..(310): n is a, c, t, g, unknown, or other
  misc_feature (312)..(312): n is a, c, t, g, unknown, or other
  misc_feature (318)..(318): n is a, c, t, g, unknown, or other
  misc_feature (565)..(565): n is a, c, t, g, unknown, or other
  misc_feature (648)..(648): n is a, c, t, g, unknown, or other
  misc_feature (649)..(649): n is a, c, t, g, unknown, or other
  misc_feature (651)..(651): n is a, c, t, g, unknown, or other
  misc_feature (675)..(675): n is a, c, t, g, unknown, or other
  misc_feature (703)..(703): n is a, c, t, g, unknown, or other
  misc_feature (747)..(747): n is a, c, t, g, unknown, or other
  misc_feature (749)..(749): n is a, c, t, g, unknown, or other
  misc_feature (763)..(763): n is a, c, t, g, unknown, or other
  misc_feature (782)..(782): n is a, c, t, g, unknown, or other
  misc_feature (787)..(787): n is a, c, t, g, unknown, or other
ctcaccgcggtggcggccgctctagaactagtggatcccccgggctgcaggaattcgtctcacccctagaaaaaacgcgctgctggtagcccgcagctacctgcctcccttcttgcacccaccgctgccgtcctgcccagatcccgctcgccggtggtgctcccctccccccgcgccgctggcgccgccggagcgagggggactgcccaaaccctagtgggagttggagactaggaggaagggcgcgagatccggcggcggccaccccgatgggggacttcaacgtcgcgctggtagaatcggtgggggncngggggnccgggggggttggggggggttttcccaaaaggggcccggggtttttgggcccccctttggggggggggtttttttggggcccccttttgtggggccccttttttcccccgggggtgttttccccaagaggggcgcccgcgggttttttcccctttataaaccccccccttttgggggggccccccttttggggggggtttctccaaaaaaaaccttttattcccccaagggggccacaccccccccncccgggagaaacccacgaatacaccgcgtcgttttctcccacaaaccccccccccggggggggggccccccttcttttaatanntnttttttttttcccccccccccccncccaaaaaaaaaaagaaattcccccttncttttagctcccacactaccctcccctcggggggggggcgccgncntctccctcggcggnaggggagcccccgaccttntcttncactcccacccaccccgaccggtacttgattatttggtccgcggacccacccc

SEQ ID NO: 84950 - DNA, 900 bp, Zea mays
  misc_feature: Ceres CLONE 1571139
  misc_feature: Encodes the peptide sequence at SEQ ID NO. 84951
ctggagctccccgcggtggcggccgctctagaactagtggatcccccgggctgcaggaattcgtctcacccctagaaaaaggcggctcccccactgttaaaaaacaatcgcctccgcttcgggctcccacgtatgctgtaccttcacacgcgacccgcacgccatgaatggcaacacccgcgtgacgagatcccgcctgaattgcctcaaggcgcactttcgctgccccttgctccggccaccgcgagatcttgtccacagcgctatcggatggagctccgccacatctacaatgtgggttccatccctatccgcaaggacgacgaggtgcaggtcgtgcgcagcacctacgagggccatgagggcaaagtggtgcatgtgtaccgccttaactgggtcatccacactgagcggatcaccctcgagaaggcgaacggctccacaatgtacgtggggatcctcccttccaatgtcatggttacaaagctgagacttgactaggaccgcaaggcgctcctcgaccgcgagcccggggccgcgccgccgactatgctaatggcaagttgactgccgactacttatactccactgctggtggcgccttcgccactggcgcgtctctccatgagatcgactaagcgcttcccgaggatctgatggtggtcctaccgcctactactgcttatcgctctactgtctgctatcaacgattatgagcgaggagatatacgccacgtaatcactgcctctgacctacctgggattggagctcatcgtggactgtatctgagatacgacgactcgtcacatagcgaaaaaaaaaagaaacctgattctagcaccctggtgctcgaagcgtctaggcagcagtcggactaagccggcatcctaagactaagg

SEQ ID NO: 84951 - protein, 76 aa, Zea mays
  misc_feature: Ceres CLONE 1571139
MELRHIYNVGSIPIRKDDEVQVVRSTYEGHEGKVVHVYRLNWVIHTERITLEKANGSTMYVGILPSNVMVTKLRLD

SEQ ID NO: 84952 - DNA, 2191 bp, Zea mays
  misc_feature: Ceres CLONE 1571140
  misc_feature: Encodes the peptide sequence at SEQ ID NO. 84953
acccaccccactccccctctccgtggtttgtccgctcgcatccttccctcccttccgccctttcctcccacttgctcgccgaacccagagccccgcccacctcttttcggttttttctcgccggcgtttgtgccaggatcgggctttgggctccgtgcatcgacgcgccgccgcctcctgatcgcaaagggtgtttcccccaggctttcgtgctccggaagtggcgagattcgccgagaaaggtcagatccggtggcctggttcgagcaacagtgtgttggcgtatcgatctgcattggatcgtcgggcgattcgtgtgacggagacgacgtcctctgtggtggctccggtttgctcctcagctctagatctggaaggactgggtgatctgctgcctcaagcagcttgaggtgcattggaaagtgaccatctttcccagacatcggcacaacgtaactggacatggaggctcttgtggttttcccggagcagcacagccaccaccatcaccgccaccctggtacccgcagcaagtcatcgggtccatacttttcatcaccgcctaactctcgtggcttccgtggaatgaactgccggtctttccactctggtcgttgcgtcggtgctattccattcccagcacctcctgctcgcacctactcatccccagagcccaagacacccaagcagcaaccacgccatggtggcaagcgaagccggccaatttccataagcctctccacatcccctccctcccattctgagctctgggcaggtccagcattctccaactctccaccacctagttcgcttcccatccccaaattctcgctccgccagaagcgcagcatctctctcgagctgccaccggttgaacgccctgatgatgtggtggtcaggctgcattctaaatcagcaccttcatccccagttgagggatatgggtatgacttcttcaatgacgatgcaatcgctagtgcgatagcaacggagaatctgaggaggattctccagctggatatcgcagatcattgaataatgggaggatggaagggtggttcttgtgtacataggttatctttcactgacagctttctacttgcattggttgtgtatagggtaatggtgatagatacttggtggttgtaagatatggtcaggatcatgggagaggtgtaggttgtaggtgaagcatcttcagaagcttagacggttgaaggtgatagtgccctgttaggtgttattaaggtggggtctgggtcgaggatggggttgcacggcagttggtagtattcacctatatgcttccttcatctcttaggtgtaggatttaaacctttttaaaaacagcatcatttgcatccacagtacctgttctgagctggcggtgggcactctgacatagcagtaacatacgtcctaaccccaaaccagatgtcaaatatttgtagggtaccatgcatcttacatacccttgcatacttatttccttctgtcctctagccaactgtctctaactatcctcgcttcctggtgctctgcaaagaacaccattatctcctcagcagctcttctgttttttttggtaaggaagaagctgcgtggaagatggaagaaattctgctctctccgtcttgttcgaaactaactttcctatcccgcccctttgttgcatatctggcatataccatagtccatatccgtcgcatatctccaggcttttatgttcatctagcgctcctgcattgcatctagtgcccttagtcagttagcatgctcattcgttcccacttcaagttcacgaaccagtttgagggttctgattttcttaaaagcgtcgaaagagagtctggattctggatcccttcgtgcaggcaaaccctgatgaggttgctctgtaatgacataacgcttaagctagctcgtgccggtgttacacgcttctgtagccctgcgcagttttagcactagcagtgaagcagcagtactgctggatctagattagtagtcatcggaaatgccgaggtttggtcagttatcttgtgctctggtgttaaatcagcagttgcattgtgtcgttgttacttcagtaacgtgatataacggtcctatgtcgtgaaactagctcatggtgttagaactagaaaccatgttgcccagagctactatgttgatgttgcacctgctgagc

SEQ ID NO: 84953 - protein, 190 aa, Zea mays
  misc_feature: Ceres CLONE 1571140
MEALVVFPEQHSHHHHRHPGTRSKSSGPYFSSPPNSRGFRGMNCRSFHSGRCVGAIPFPAPPARTYSSPEPKTPKQQPRHGGKRSRPISISLSTSPPSHSELWAGPAFSNSPPPSSLPIPKFSLRQKRSISLELPPVERPDDVVVRLHSKSAPSSPVEGYGYDFFNDDAIASAIATENLRRILQLDIADH

SEQ ID NO: 84954 - DNA, 803 bp, Zea mays
  misc_feature: Ceres CLONE 1571141
  misc_feature: Encodes the peptide sequence at SEQ ID NO. 84955
  misc_feature (597)..(597): n is a, c, t, g, unknown, or other
ccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgaccctgggcctgcagcccggcgaggccttcaccgtccgcaacatcgcctccatggtcccaccctacgacaagatcaagtacgccggcacagggtccgccatcgagtacgccgtgtgcgcgctcaaggtgcaggtcatcgtggtcattggccacagctgctgcggtggcatcagggcgctcctctccctcaaggacggcgcngccgacaacttccacttcgtggaggatggggtcaggatcggcagccctggccagaacaaggtgaaagaaagagcacgccgtcgtgcccgttcgaatgaccagtggctccatcctgaagaaagaaggccctaaacctggcccctccgaaacctcaagagcctccccctttcctcaaagaaaagggctgggcccggcgggaaccccca

SEQ ID NO: 84955 - protein, 162 aa, Zea mays
  misc_feature: Ceres CLONE 1571141
  misc_feature (31)..(155): Pfam Name: Pro_CA Pfam Description: Carbonic anhydrase
  misc_feature: SWISSPROT Homolog: EC 4.2.1.1 Carbonate dehydratase
MDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAADNFHFVEDGVRIGSPGQNKVKERARRRARSNDQWLHPEERRP

SEQ ID NO: 84956 - DNA, 827 bp, Zea mays
  misc_feature: Ceres CLONE 1571143
  misc_feature: Encodes the peptide sequence at SEQ ID NO. 84957
  misc_feature (354)..(354): n is a, c, t, g, unknown, or other
ctccccgcggtggcggccgctctagaatagtggatcccccgggctgcaggaattcgtctcacccctagaaaaaaaaggtttctctcccagtgtgcgcgctgcccttcttctcaggccgccgactcctgctcgtcgaatcccctctactcaccagggcgcttggcttcctccttccctgccgcaccgtgctcctctgctcctccctgctgccagctcggccgtgccctggccatgctccctgcgctgcagccgtgcgctctcctcttgacgccgccgcgtctgcccgcgacccgcgtggactctcgagctcgcccatgcgccggcgactcctctgtctgctctgcttgcgtcaantttctacactcgcggtctctcccgagcttgcctagcccttgtatccccatggcgggagctctccagctccagctcggtccctctcccatgggtcctgcacgccatttatctccttgcggagctcccaaggggggcgccccgttccccccttggtttgttgaaaaccccgttttcccatggggggctgggggaaacccctttttttttttgtctcccccccgccccgggggggaaaattttctcttgtctcgggcaatggggccccccgctttcggtttttcccgggggcgggggtcccccccccccaaaaatcccccccccaaaagttcccccccccgggtgtgtctgtttccccgggggagtgacccccccaaacccctggaaaaaccccaaaaaaatttttttgggggggcgggtggtataataaaaaaaaattttttcccacaaagagggccccccgaagaaggaaagat

SEQ ID NO: 84957 - protein, 62 aa, Zea mays
  misc_feature: Ceres CLONE 1571143
MGGWGKPLFFFVSPPPRGGKFSLVSGNGAPRFRFFPGAGVPPPQKSPPQKFPPPGVSVSPGE

SEQ ID NO: 84958 - DNA, 848 bp, Zea mays
  misc_feature: Ceres CLONE 1571151
  misc_feature: Encodes the peptide sequence at SEQ ID NO. 84959
ctccccgcggtggcggccgctctagaactagtggatcccccgggctgcaggaattcgtctcacccctagaaaaaaaaagtgtcctagacgccgctaccgccgccaaccaaccactcttctcctacgccgccgccgccgccgatcccgtcgcgatgagccacgacaccggcgccggcgtggagtccctctcgctggacctgctggcccacgcgctggcggccgtgcgcgacccgcgggaccgcaagtcgtgccgcctcgccagccgcgccttcgcgcgcgccgaggccgcgtcccgccgcgccgcgcgggtgctgcgccgggacgcgctgccgcgggcgctgcgcgccttcccggcgctgtcctcgctcgacctctccgcgtgcgcggggctcgacgacgcctccctcgccgccgcgctgcccgaggagccgctgcccgtccgccgggtgcgcctcgcgcgggccagcggcgtcggctggcgcggcctcgacgcgctcgtggcggcgtgcccgagcctcgaggccgtcgacctctcgcactgcgtcgccgccggcgacagggagatggccgcgctcgccgccgccgccgggttcagggacctcgttatggacaaatgcctcggcgtcaccgacgtcggggtcgccaagggtccccgtcggatgcccggggctccagaagcctcagcctcaagtggggcccgcgaaaatctccgaacttcatccttcaaacctgcatcgcccaagaaatggccccccaaattggcggaaggcctcaaatattctccccctaccttccaggggtgcaccccaatggaagagccgcctttaagaatccacgtttgttgccgg

SEQ ID NO: 84959 - protein, 232 aa, Zea mays
  misc_feature: Ceres CLONE 1571151
MSHDTGAGVESLSLDLLAHALAAVRDPRDRKSCRLASRAFARAEAASRRAARVLRRDALPRALRAFPALSSLDLSACAGLDDASLAAALPEEPLPVRRVRLARASGVGWRGLDALVAACPSLEAVDLSHCVAAGDREMAALAAAAGFRDLVMDKCLGVTDVGVAKGPRRMPGAPEASASSGARENLRTSSFKPASPKKWPPKLAEGLKYSPPTFQGCTPMEEPPLRIHVCCR

SEQ ID NO: 84960 - DNA, 967 bp, Zea mays
  misc_feature: Ceres CLONE 1571152
  misc_feature: Translation starting site: 479
agctccccgcggtggcggccgctctagaactagtggatcccccgggctgcaggaattcgtctcacccctagaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcccggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgccctctccaattcttcatttaggtgactgttttgggatcgagagatcgtattggcgggcgcattcatactgataactcgtttgaatgcccaattgatatgggagcctcatggctacacggcgtgtgcaatgagaatcactggcaccattgataagctatcttggggctgaggttttaccgcacaaggcgatgataactcagttctggttgaatccatgatttagaaacctatgctctctttgaaaaggatggttaatccggtccccaaaggaagaacgtccattagagtgggaaaacccttccaaaagaattcttgtaaaaaacggggaaaaatgcgcccatttagcagggaaccccaccttgccccg

SEQ ID NO: 84961 - DNA, 773 bp, Zea mays
  misc_feature: Ceres CLONE 1571154
  misc_feature: Encodes the peptide sequence at SEQ ID NO. 84962
tccccgcggtggcggccgctctagaactagtggatcccccgggctgcaggaattcgtctcacccctagaaaaaaccccattctccctcttcctccagagtccagacggcgtgcttccgcctgccgccgccggcgagctgcttgcccgcagcatgactccgcatcctggccgcctcgtcctacctccggcggctccttctccctgaaccccgccgcgcgccaggccccacgcctccttccgcagtcacacgagcacgcgggcgtcctctgccgcaccgcgccgcctccagacgcctcgctcgtcaggccactccacctccgcctgcgaacgtccggcccggctccggcgagttcctccgcaattccggatctgctggagcgccagcaaggcggcctctccaactctccggagtccggaacagcaagggttctgatctcccatgccacagttttataacgttgaaggattcaaaaatctacagaactagatgatacttgcataatgcagccctcagatatttggaaggcgcatgctggttcatcacagtcagagggttcgggtctggatatggagaggaacggatgcaatcataattattgtccatctcctctccaaccatttgctcagctggtcagcactctgaaagcagcgctgcatacttttcttggcctacatctactctaatgcacgggtcagctgaaagccgtggctaattactttggggaacctacagaagggtgtactaccaggacatcttgggtcgcttgcaaagg

SEQ ID NO: 84962 - protein, 60 aa, Zea mays
  misc_feature: Ceres CLONE 1571154
MQPSDIWKAHAGSSQSEGSGLDMERNGCNHNYCPSPLQPFAQLVSTLKAALHTFLGLHLL

SEQ ID NO: 84963 - DNA, 821 bp, Zea mays
  misc_feature: Ceres CLONE 1571155
  misc_feature: Encodes the peptide sequence at SEQ ID NO. 84964
ctccccgcggtggcggccgctctagaactagtggatcccccgggctgcaggaattcgtctcacccctagaaaaaataccctgggcgactgacgccaagcgaactggagcatgctctagaccatcaccgcgccccgtggtatggcctgcagcgctgctgctggtagctggtccggccggtccggtcctgtctcctggtgttccccgagctccactccgatgttcgggtacgactctccccatggggtcagaccatggcgccattcacctagcgccaattgaagtgtcggtggaggctatgatgctcttcgccttcgttacctgctaatgggccgctctgctctctcattgctgccgcagaggggaaccggaccccgcgcagtcgcaaatgcacatgcatggacgccgtgcgctcccacctccgtggcgccaaggtcgccttatgctgcgccatccagtactgcaatctcgtcggcgtcgccgtcggctgcaccagtcactcctccatcggcatgcaggccgctcgcggggccgggtgcttatccgagcgtggggacgccgctcccctgcaagagctccagcgaaccctgcgtgatcctcttctgagaccgtgagaatactcttctctcacatactggtactccaccagatttggtggctctccatcctcgcggaattcctgtcctttcatctagtccgtcatgggcttggccctcggcgtcgcgcaaactgtgtcataacgcggggttcaaggaaaccttcaccggatcagaaccggggccgaagttccctaacggcataaatgtggggacggccgcaagcc

SEQ ID NO: 84964 - protein, 71 aa, Zea mays
  misc_feature: Ceres CLONE 1571155
MDAVRSHLRGAKVALCCAIQYCNLVGVAVGCTSHSSIGMQAARGAGCLSERGDAAPLQELQRTLRDPLLRP

SEQ ID NO: 84965 - DNA, 850 bp, Zea mays
  misc_feature: Ceres CLONE 1571158
  misc_feature: Translation starting site: 103
  misc_feature: Pfam Name: NIR_SIR_ferr Pfam Description: Nitrite/Sulfite reductase ferredoxin-like half domain
  misc_feature: SWISSPROT Homolog: EC 1.8.7.1 Sulfite reductase (ferredoxin)
  misc_feature (619)..(619): n is a, c, t, g, unknown, or other
  misc_feature (635)..(635): n is a, c, t, g, unknown, or other
ctccccgcggtggcggccgctctagaactagtggatcccccgggctgcaggaattcgtctcacccctgattgtaggtttcccccctagaaaaatagaaaaagatgtcgggggcgatcgggggcgccgaggtccacggcttccggggcgcagcggcgcagctcccgcggtcgcgggtgctcgggaggccgatccgggtggcgccacccgccgcggcccggccgggcggtgcgtccgcgggcagcatacgcgccgtctccgcgcctgcgaagaaggatgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtgggcagaagaattactcgtttatgctccggacaaagaacccttgtgggaaagtccaaaccaactttatttagctatggatacactagccgatgagtttggcatcggaacactccgcctgacgaccaggcagacattccagttgcacggtgtttcttagaagaaaactgagactgntctaagcactgtcatnaagatatgggctccacattgggtgcttgtgggcgatctcacaggaatgtacttgctcctgcagcgcctatgtcaaaaagatattctttttgctcacaacagcagagaacatgcagcgctccttaaccacaatcggggcttattagaccggtggggggatggcaaaaaaaaatgtcccttaagagcttcctggggacaaaaaccgcaagtgacctc

SEQ ID NO: 84966 - DNA, 770 bp, Zea mays
  misc_feature: Ceres CLONE 1571162
  misc_feature: Encodes the peptide sequence at SEQ ID NO. 84967
  misc_feature (551)..(551): n is a, c, t, g, unknown, or other
  misc_feature (559)..(559): n is a, c, t, g, unknown, or other
  misc_feature (560)..(560): n is a, c, t, g, unknown, or other
  misc_feature (628)..(628): n is a, c, t, g, unknown, or other
ctggagctcaccgcggtggcggccgctctagaactagtggatcccccgggctgcaggaattcgtctcacccctagaaaaagtttaagcttagcatgcgaaactatatcctgtctttatcgaaacaattcattactgattacatctcatcgcctgaagtgaacttcctcaccagtatatctggaagagttagcaagaagacaaagcttgtgttccgctttcttgacgaaggctctattgagccatcgacaaaccagacatatgggtccatgttgaaaaatctaacatttgtcaagacttttgcctctggaatacttgttcccaaaagctatatctggcctgttacaccagataattacctactgccttatacatcagttgttgatgatgctcacaaagcggggctagaaatctatgctgctgattttgcaaatgactttactatcagctataactacagctttgatccattagcggaatatctttccttcattggtaacagtgccttctctgtcgatgggtgtgttgactgatttcccgatactccttcgangcagtggnntgctttagtaactgaacacaagcagatcgacatgctaaacctcgggtatctctcatatggtgctagcngtgactacccagactgcaccgactaggctattaaaaggcagttgctgatggggcaaatgtcattgactgtccttgtttcagtgaccaaagaatggatactgaaaatgccttgaattccttttgacctaaagggaggcccccc

SEQ ID NO: 84967 - protein, 145 aa, Zea mays
  misc_feature: Ceres CLONE 1571162
MRNYILSLSKQFITDYISSPEVNFLTSISGRVSKKTKLVFRFLDEGSIEPSTNQTYGSMLKNLTFVKTFASGILVPKSYIWPVTPDNYLLPYTSVVDDAHKAGLEIYAADFANDFTISYNYSFDPLAEYLSFIGNSAFSVDGCVD

SEQ ID NO: 84968 - DNA, 820 bp, Zea mays
  misc_feature: Ceres CLONE 1571163
  misc_feature: Encodes the peptide sequence at SEQ ID NO. 84969
ccccgcggtggcggccgctctagaactagtggatcccccgggctgcaggaattcgtctcacccctagaaaaaatctcgacccaaccgacgccccgcctcttaaaacggcgaccttcctccatggccaaatcgttgtcctcctccgcttccctccaaatccaccctggatccaaccccgattttccccagcagaagcaaacccgagcaaattgagcgcttgcagcttcacccggcgaagcagaatcgaatcggagccgctcgccactccgcgatggggatcctcctccggtccctcctcgtcgcctcgctcgtcctcagttcgctcgtcttgcacgtcgcagcggctaaaactatagatccttacaaggttctaggagttgacaagaatgctagccaacgggatattcagaaagcctttcacaaactttctctaaaataccaccctgacaagaataaagggaagggcgcacaggaaaaatttgaagaaataaacaatgcatatgagattctatctgatgaagagaagaggaaaaactatgacctctacggggatgagaagggtaaccctgaatttggtggtggaaattttggaaatcatgggggttctacatacttcactggtggtggccctaagtccagtcaattcacatctggtaatggatggcagacgatgggtggtcaaggaaatacaaaaacgttttcattttcatttggtggtaaacctggggccagtggtgggaaaccgtttggtgggtggttttgatcttgggtgatggtttctcgaacctttttgggggtgggaccaatgggtgataagcct

SEQ ID NO: 84969 - protein, 163 aa, Zea mays
  misc_feature: Ceres CLONE 1571163
  misc_feature (29)..(90): Pfam Name: DnaJ Pfam Description: DnaJ domain
MGILLRSLLVASLVLSSLVLHVAAAKTIDPYKVLGVDKNASQRDIQKAFHKLSLKYHPDKNKGKGAQEKFEEINNAYEILSDEEKRKNYDLYGDEKGNPEFGGGNFGNHGGSTYFTGGGPKSSQFTSGNGWQTMGGQGNTKTFSFSFGGKPGASGGKPFGGWF

SEQ ID NO: 84970 - DNA, 832 bp, Zea mays
  misc_feature: Ceres CLONE 1571164
  misc_feature (319)..(319): n is a, c, t, g, unknown, or other
  misc_feature (586)..(586): n is a, c, t, g, unknown, or other
  misc_feature (613)..(613): n is a, c, t, g, unknown, or other
  misc_feature (614)..(614): n is a, c, t, g, unknown, or other
tggagctccccgcggtggcggccgctctagaactagtggatcccccgggctgcaggaattcgtctcacccctagaaaaatctctgagcgtgtgtctgtctgtcagtgagtaataaatggcagcgagcagcgtgcgtggctgaaggctgctgagcagagcagggcgagcgctcgctagtcggctagtgctgtgctgtgctgtgctgtgcagcggttgctcctcctggtcctgctactgctccgctctcctcgtcgcttgctcgtcttttttccacactgggcggatttctttccgcaaggagcaggaggaggaggagggnggaaaggtttgtccgtttcttgcgagagcccgttgcagagatccagccaggcagcaggattcaagaacctgacctttttgtgctctactccccgagagattttcacccaaagtttggtccttggagccgattcgatccctggaaacaaccaagtgaaggtgccgcaaatccgttgtgactgcacaaaatcccaaaacgcctctgccacctatctatttgatcgttgggaacctagctccatccatctgagccaagaaacacacccgncagggcggaggggaggggagaggatannggaaaaagggcgtcctctttccgagcagcccgcattgccgcctgtcgatgagtgagcgctgcctccgatgccgtcgggggtgctcggtgtccagtctcgcggcgcggttcgccttcttcccgccggaaccggcgacgtacgcccgtccggaaggacgaagccaccgggccgcctcgtcgccctccggggtgccgccggaacaacgccatgggacgtcc

SEQ ID NO: 84971 - DNA, 866 bp, Zea mays
  misc_feature: Ceres CLONE 1571165
  misc_feature: Translation starting site: 256
acccgcggtggcggccgctctagaactagtggatcccccgggctgcaggaattcgtctcacccctagaaaaagcacccctttcctccttccgccctccgccgcgcctggctttctcccttcccgagaggccacgctccatccccgcccgcgctgcctcccctggcgatcggcagcgaccgcggcccaacgaaagcgtcgtggtcggccgctgtcacgcttcttgcagacgctgggcggactgggaacaagcgccaatggggatcgcggtggtggctctacacaccatgccgggggcgttcaccacccactccccggcatccattctgtcccttcggccagactttacgaggataaacagccgcaccaattcggtgccaaacgccaggacactgcaaggcgtcctaaggatcccgaggctgaggtcggtcaggcggctgtgccagcggatcgatgaccgggttacagaggggaacggtccttgggtcaaggatgccatgaataacgctagccaggttcttggcgacatcagcgtgcttggtcaagctgtaagtggcaatggtggtctaaatgggagtgctgccaagactccacctcagaggcggaagtcctcttcggttgaggatgaggcctgggaacttctgcaggagtcaatggtttactattggtggcagtccctgttgggacgattggctgcaacgatccaaatgacagtgatccggtgaactacgatcaggtgtttattcgggacttcataccatccggcattgcttttctactttaggggggaataattgaaatgtgccgtaatttcattctacaaacacttcagcctcagagctggggaaaaacatgggactgccataga

SEQ ID NO: 84972 - DNA, 744 bp, Zea mays
  misc_feature: Ceres CLONE 1571168
  misc_feature: Encodes the peptide sequence at SEQ ID NO. 84973
gcggtggcggccgctctagaactagtggatcccccgggctgcaggaattcgtctcacccctagaaaaaaacctcctctcccaccaccgcccccgccgtcgcctgctgttccatgaaggactaatccgtcggtccacttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgaggaggcgggggatgaacagaagcagccggcgagctcgtccccgtcgctgcagctgcgcatgaagcaccggtccgcggaggggggcaggacacggaaagagtcgttcttagattcggccgagaaggatgccgtccgcatcgagacgatgcaccggagggcggcgcgctccggcgtggcccggatgccggcgtcttcgtctccgcgggcggcgctgtcggagcggatggttgcgacggtgggagtccggcgtggcggtcgggtcccgcaaatacctgatggacgtctacgtcggcaccccaccgcggcggtttccgaagaatcatgggacaccggcagcggacctccaactggctgcaagggcgccgcccgggcctggaacggctttcaagaaacgggggcccgggggttccaacccccacccgt

SEQ ID NO: 84973 - protein, 199 aa, Zea mays
  misc_feature: Ceres CLONE 1571168
MAQLAVRSLLLSLLLVSPVVASPGIVKLNSSSTLFGIEFPPFNTAVAATGCDSKLVAAEEAGDEQKQPASSSPSLQLRMKHRSAEGGRTRKESFLDSAEKDAVRIETMHRRAARSGVARMPASSSPRAALSERMVATVGVRRGGRVPQIPDGRLRRHPTAAVSEESWDTGSGPPTGCKGAARAWNGFQETGARGFQPPP

SEQ ID NO: 84974 - DNA, 760 bp, Zea mays
  misc_feature: Ceres CLONE 1571171
  misc_feature: Encodes the peptide sequence at SEQ ID NO. 84975
  misc_feature (534)..(534): n is a, c, t, g, unknown, or other
ccccgcggtggcggccgctctagaactagtggatcccccgggctgcaggaattcgtctcacccctagaaaaaagctctccaccaagagcttgtaccccacaccactaggcactagtccactacctaacgctacctgccttttcaccgcgtcgtgcgctaccgccacgttgagctcgcgtccgtcccagatccgccgtgctcctccatcgctcgcgcaagatgaagatcacggtgcgggggtcggagatggtgtacccggcggcggagacgccgcgccgccgcctctggaactcgggccccgacctggtggtgccgcggttccacacgcccagcgtctacttcttccgccgcgaggacgcggacgggaacgacctggcgggcgcggacgggagcttcttcgacggggcgcggatgcggcgcgcgctggccgaggcgctggtgcccttctacccgatggccggccggctggcgcgcgacgaggacggccgcgtcgagatcgactgcaaacgcggcggggtgctgttcccagaggcnggacgcgccgacgccaccatcgactacttttgcgacttcgcggccaccatggaagctcaagcggctcattcccaccgtcgacttcacgggacgaaatcttcctccttccccgctggtcggggttcaaggggacccaccttcaaagggcgggggggcggggctattcggggttggggttgccaacaccccgttaaccaaagggtttttccggggctggattttaaaa

SEQ ID NO: 84975 - protein, 180 aa, Zea mays
  misc_feature: Ceres CLONE 1571171
  misc_feature: SWISSPROT Homolog: EC 2.3.1.144 Anthranilate N-benzoyltransferase
MKITVRGSEMVYPAAETPRRRLWNSGPDLVVPRFHTPSVYFFRREDADGNDLAGADGSFFDGARMRRALAEALVPFYPMAGRLARDEDGRVEIDCKRGGVLFPEAGRADATIDYFCDFAATMEAQAAHSHRRLHGTKSSSFPAGRGSRGPTFKGRGGGAIRGWGCQHPVNQRVFPGLDFK

SEQ ID NO: 84976 - DNA, 939 bp, Zea mays
  misc_feature: Ceres CLONE 1571173
  misc_feature: Encodes the peptide sequence at SEQ ID NO. 84977
  misc_feature (771)..(771): n is a, c, t, g, unknown, or other
  misc_feature (841)..(841): n is a, c, t, g, unknown, or other
acccgcggtggcggccgctctagaactagtggatcccccgggctgcaggaattcgtctcacccctagaaaaaccgcttggtctcgctctcgctgcattcgtcttccccgcccgtccgtccgcccgctgatctcagatccaaaccaaacgaactccacactaccctctgctcagcccgcgcacgcatgaaaccctagtgaccccgtccagatctccgcgtccggatcactgcgcggcgccgccatggcgccccccgcgctggactccctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccttacttcaactaccgcaccacgctcttcctcaccgagaacggcttcagcgagttctggaactggttcgacttcgagagctggtacccgctcgggcgcgttgtcggggggacgctcttcccgggtctcatggtgaccgccgcgctgctccaccgcctcctccgcgcgctctacctcaccgtccacatccgcgaggtctgcgtcctcaccgcgcccttcttcgctgccaacaccacgctcgtcgcctacgccttcggccgcgagatatgggactccggggcggggctcgtcgccgctgcgctgatcgccatcgtccttggctacatctcccgctccgtcgcggggtcctacgacnacgatgtcggtcgcatcttcgcgctgctgctcactttctacctcttcgtgcgcgccgtttacattgggtncgctcgcctgggcgctcgcctcggcgttcggtttccttctatatgtgtccgcatggggaagctacgtgttcatcatcaatctcgtcccgcctttgggg

SEQ ID NO: 84977 - protein, 232 aa, Zea mays
  misc_feature: Ceres CLONE 1571173
  misc_feature: SWISSPROT Homolog: EC 2.4.1.119 Dolichyl-diphosphooligosaccharide--protein glycotransferase
  misc_feature (177)..(177): Xaa is any aa, unknown, or other
  misc_feature (200)..(200): Xaa is any aa, unknown, or other
MAPPALDSLPAPLRSLRLKTKQQELLLRVSALALIYVLAFAVRLFSVLRYESMIHEFDPYFNYRTTLFLTENGFSEFWNWFDFESWYPLGRVVGGTLFPGLMVTAALLHRLLRALYLTVHIREVCVLTAPFFAANTTLVAYAFGREIWDSGAGLVAAALIAIVLGYISRSVAGSYDXDVGRIFALLLTFYLFVRAVYIGXARLGARLGVRFPSICVRMGKLRVHHQSRPAFG

SEQ ID NO: 84978 - DNA, 927 bp, Zea mays
  misc_feature: Ceres CLONE 1571174
  misc_feature: Encodes the peptide sequence at SEQ ID NO. 84979
  misc_feature (397)..(397): n is a, c, t, g, unknown, or other
  misc_feature (834)..(834): n is a, c, t, g, unknown, or other
ctccccgcggtggcggccgctctagaactagtggatcccccgggctgcaggaattcgtctcacccctagaaaaaatcgtctgcaactgcatcgctcgctctctcctttcactgggaacatctatcagctcgcgctcattggccatctttggcttccatggagaggctcattgccggcctacttggcttcctattggttgcatcggtaggaagccatgcagctcgtgctccggatcagtactggaagtctgctcttcccaacactcccatgccgacctccctctcccaactcctcgacgccgctccagccggcggcggcacgaccgtcaacgtcggctggggcggtgttcacgtcgatgctgggcacggtaagcccgggggtacgacggttgacgtangcaagggcggcgtcggcgtcaacgttaaccctggcaggagcgggcagcccgggcgcacgacggttggcgtcgggaaaggcggagtcggcgtttaacgtcaaaccggggaaacggaaaaccccggcgggcacaaccgttgggcttcggaaaagggtgggctttggccttaaaagtcaaaccccgggaaagcccgggtggcacaaacgttcggccttccggaaaaggggcgaaaatggggcttcaaagttaaatccccggaaaaaccgggcgggggggggccggaaaaaaccctttggggttgggacaaaagcccccttggggctttgggttcaaaaccccggggaaaaaaaaaccgggggggaacacccatttgtgttttttaaaagggggggggggtgtttttctttgaccccccggggaaaaaaaacgcccccccnaaaatccccccctttttttattaaagaaatccccccggaaaaaaaaattttttaaacaaaccccccgggggggctctttttttatagaaagga

SEQ ID NO: 84979 - protein, 111 aa, Zea mays
  misc_feature: Ceres CLONE 1571174
  misc_feature (81)..(81): Xaa is any aa, unknown, or other
MERLIAGLLGFLLVASVGSHAARAPDQYWKSALPNTPMPTSLSQLLDAAPAGGGTTVNVGWGGVHVDAGHGKPGGTTVDVXKGGVGVNVNPGRSGQPGRTTVGVGKGGVGV

SEQ ID NO: 84980 - DNA, 837 bp, Zea mays
  misc_feature: Ceres CLONE 1571176
  misc_feature: Translation starting site: 237
  misc_feature (571)..(571): n is a, c, t, g, unknown, or other
  misc_feature (795)..(795): n is a, c, t, g, unknown, or other
ccgcggtggcggccgctctagaactagtggatcccccgggctgcaggaattcgtctcacccctagaaaaacttgaagggtggaattggatctggattcaagaagctcatagaagaaaagggtgcgacgggtgagacttatactactgaaggcatagctctaattcgagtatctgggacatctatccacaacaacaagactcttcaagtcgatacggtggcaacgtctttaagctcaatggagtgtttcatactgcaatctggaaatgctatgtttacatggtttggcaattctagcacatatgagcaacagcagtgggcagcaaaagttgctgaatttttgaagcctggcgttgcagtgaagcactgcaaggaggggacagagagttcagctttctggtttgctcttggaggaaaacagagttatacaaataaaaatgctccccaggatattattactagagagcctcacttgtatgcattctcattcaagaacgggagactggaggtaactgagatcttcaacttttcccaagatgatttgttaactgaagacatgatgatacttgacancacatggtgaggttttcatttggattggtcagtgcgtggaatcaaaagagaaacagaaggcatttgatattggccagaaatacgtggagcatgcaaattctattggatgatctttctccatatgcaccactatataaagttattggaagggaatgagccatgcttctttcagacatactttctctgggataaccaaaaatcttgggttcaatgaaaattccttncagaagaaactctcactggcttttttgaatggccgtcctgaa

SEQ ID NO: 84981 - DNA, 840 bp, Zea mays
  misc_feature: Ceres CLONE 1571177
  misc_feature: Encodes the peptide sequence at SEQ ID NO. 84982
  misc_feature (840)..(840): n is a, c, t, g, unknown, or other
ctccccgcggtggcggccgctctagaactagtggatcccccgggctgcaggaattcgtctcacccctagaaaaaaccgcttccaccaccaccaccaccaccaccggacagggacacggacggcactagctcgaggagggtcggcaagccagagtcacagcagaaggtgaaagggagcggatatgggggcggatcgtttcctgagcgtggcggagggcggcctcggcggcgaggcgctctacttcgcggtcatcctgtggctgtccgtcatgtcgtggatcatcttcacctgggtcggcgacggcggggaggacgggaggcgggggaggaagcgccggggcagccgcggcagcccggtgttcgtcggcgcgtcggggatctgcgacggcaccgggcccgagtgcagcggcgggtacggcatctgcggcacctgcctcgactagcctgctctgctactagtaagtttgtgtgagcgtcaaaagcgcggccatggttgtagctgtagcgtctacatgtcgtcgtcgatgcgtgggcctcaatggagaagctggcgttggctctggtggatatgatgaagagcaaaccccctcccctgtggggaaaacaataagaagggagggagccttattcttcagcctaacttccatcctggctttttagggctgccccaacacgaatttgtcccttaacccctttttttttaatttcccccctcccctttaaagttttggaaccccccatcccctccggtaaatttttaaacccgggccaaagaaaccccaaatttccctgttgtctccgaaaattttataccccgggctgtgtctttctgttccctctn

SEQ ID NO: 84982 - protein, 86 aa, Zea mays
  misc_feature: Ceres CLONE 1571177
MGADRFLSVAEGGLGGEALYFAVILWLSVMSWIIFTWVGDGGEDGRRGRKRRGSRGSPVFVGASGICDGTGPECSGGYGICGTCLD

SEQ ID NO: 84983 - DNA, 785 bp, Zea mays
  misc_feature: Ceres CLONE 1571182
  misc_feature: Encodes the peptide sequence at SEQ ID NO. 84984
ctccccgcggtggcggccgctctagaactagtggatcccccgggctgcaggaattcgtctcacccctagaaaaaaactctctctctcgagttcatagtttttgctcttcctctctcatggtcacaatgcttgcagctagttctctagtgaacagcaacctcgcttgctcatcaaggatatcatcctgttcagacttcacatatagccactcctggcgtcccatacatgctatgaaactccatcagatgcgtgctgtgagctcaatacgtataagttgtgctgccactaaacctgcaaagactcctgctgaagaagaatggaaagttaagcggcaactgctatcagaaaagcgggtacgaagtgtcgatgtgaaggaagcactgcgccttcaaaaggaaaacaactttgtcattcttgatgtcaggccagaagcagagtttaaagaggctcatccacctggcgccatcaatgtacaaatgcaaacaacacacgaacaccgcaccgcaacgtagccggctaggggaagagctctttccttcagctgtgccgtgcacaacgcacggcacgctggtttggtttgcatcgcccccgactagaaagacgctgccgtgatcgggctgaacgggcggtaagcagcatcaggcgggcgacatgccgagcggcagcacgttctccgggtcggtgtaacctcagcacgtcaagctgggggtacaggtacctgggtgaccacttcctgaccctgctgctggtgacagtgatggcccccaacggcgctggagctggcc

SEQ ID NO: 84984 - protein, 131 aa, Zea mays
  misc_feature: Ceres CLONE 1571182
MVTMLAASSLVNSNLACSSRISSCSDFTYSHSWRPIHAMKLHQMRAVSSIRISCAATKPAKTPAEEEWKVKRQLLSEKRVRSVDVKEALRLQKENNFVILDVRPEAEFKEAHPPGAINVQMQTTHEHRTAT

SEQ ID NO: 84985 - DNA, 1087 bp, Zea mays
  misc_feature: Ceres CLONE 1571183
  misc_feature (1087)..(1087): n is a, c, t, g, unknown, or other
ctggagctccccgcggtggcggccgctctagaactagtggatcccccgggctgcaggaattcgtctcacccctagaaaaaagcagcgcccgcgctcgtcccttttgtatgtatgtgctccctctctccctgcctcgctttgccatttgccgattggggcagcagctatgacacttccctgcgccggcggctgctagatccaaggcagcggcattaactaccgcatcgccgtctccacccgacctctcaaggtgtggagcatatcagacgacgacgtccattcccaagagcaccacagcgtcctccgccaaatgctcagggacgtctcctgccgcgcgcgctacggcgagctgctcgccatggtcggccccatcggcgccggcaagtccaccctagctcgagatcctcacgggggcgcctctcctcgtccccgcccccccaccctgctatgcattggacggcgccgtccccccaaagacgccggacctccggacgagttttcggcattcttcgcccaaaagggaccttcgtctttccgacttgctcaaccagggccagaaatagtctgctactttaaacggacggcccccctccctaagggggggccgccttggccctcataaggaacttgcaaacccccgtgggtcaaggggtcctccttcgaaaggaaactttcgccctggtgggcgcggattcccccagctctcccgatgaatgtctgaggaacgctcctccccgggaagaaaaaaatgccagaggggcctttctttcccatcgggccatttaaagaaacttgggcgtttgaccctgaccgtttggttctatccggcagtatggaagcccaccctaccgggagttgtgtaagggcggttatcggggtgctcaaaatattgtcagggggggcttctctgcaccaatggggcaaaagctgctgggaaaacacacgttgttgttcgttctctcacaacatcctaggtgcaggccatataagaaataatgtcgacaaccaggatcttgttatagacggtggggacgttggtcaacatggagactgtggaattatcgccggccccggttggagaagtcgn

SEQ ID NO: 84986 - DNA, 772 bp, Zea mays
  misc_feature: Ceres CLONE 1571184
  misc_feature: Encodes the peptide sequence at SEQ ID NO. 84987
  misc_feature (761)..(761): n is a, c, t, g, unknown, or other
acccgcggtggcggccgctctagaactagtggatcccccgggctgcaggaattcgtctcacccctagaaaaaaatacagcgccggccgggccgttgcgtccgtccatcctcatccccatccgccacccaccccgcgcccctccttctcactccagtgctggctgccggccagctccgcccccggggtccttgagctggaggtgggtggcgacgtaaaggcgcccgcttgctttgccactgccggcgctcgtcatctccttacttattcatccctgcggccctgctacacatcggtgccgtgctgtgcgtgcttgattccgtcctgtcctgtgcttgccgtttctttggcttgtattgtaggtggcggtggatgaccagctctcggagttttctgaggcgaggatcggagggcgttgcgttaggtccgcggttggtgagcggcggtcggagcggtctcgcgcgcggcggggtcgttcgatgacgcaggaatcgcgctctgggagggtgggaatacctcgcgctcgcgctcaaggtgctcgattaatttactgcctgaggctgagggagggcgcgcctgtgagctgaaccgttcccgctgcactgactcctgagctcgggaaatggttgggagcgtgcacatcaatggatcggtccacggcggcaatggcacggccacggaggagcggctggacgagctgcgccggctgctcggcaagtcggagggggaccttctcaagatcgtcagcgtcggcgccggcgcngtggggcagct

SEQ ID NO: 84987 - protein, 50 aa, Zea mays
  misc_feature: Ceres CLONE 1571184
MVGSVHINGSVHGGNGTATEERLDELRRLLGKSEGDLLKIVSVGAGAVGQ

SEQ ID NO: 84988 - DNA, 825 bp, Zea mays
  misc_feature: Ceres CLONE 1571185
  misc_feature: Encodes the peptide sequence at SEQ ID NO. 84989
  misc_feature (768)..(768): n is a, c, t, g, unknown, or other
ctggagctccccgcggtggcggccgctctagaactagtggatcccccgggctgcaggaattcgtctcacccctagaaaaagctctccttccccttccgctgagccgtgctgccgcggccccggcacgccatggcgtccacggcgtactcgcggtcgtcgtccaacaagctgccgggcggcgagcggcggctgcccccgcgcctcatgcggggcctcacgtccaaattcgagcccaagaagctgggcgtcggcctcgtcgccggctgctgcctggcgctcctcacctacgtctccctcgccaagctcttcgcggtctactcccctgtattcgccagcacggccaacacgtccgcgctgatgcagcagaacgcgccgctggcctcgtccaagccgtccgtgccggagacggagaccatccctccggaagagacgctggacgacggcgacggcgcggataccggcgatctgcgtgggacggagcccggcttgccggaagctgccgtcatgaggaacgacatggcagcggggtccgacgagcccggcttgcccaccaggaaggacggcggcgggaatgcggaggccgagcccaccaacaagccatctgaggatggcaacggcggccaacaaagaggcaagatgacgtgcgacgagaacagcgtggacgagcggttcccgtacgccccgcccgacgtgtgcgagctgtccggcgacgtgcgcgtgagcccgagcagaagacggtgtacctggtgaacccgtccggcggctgcnggctggggggttcaaacaaagcgtcgagaaagcggctccgaaccgtacgcccgccaa

SEQ ID NO: 84989 - protein, 206 aa, Zea mays
  misc_feature: Ceres CLONE 1571185
MASTAYSRSSSNKLPGGERRLPPRLMRGLTSKFEPKKLGVGLVAGCCLALLTYVSLAKLFAVYSPVFASTANTSALMQQNAPLASSKPSVPETETIPPEETLDDGDGADTGDLRGTEPGLPEAAVMRNDMAAGSDEPGLPTRKDGGGNAEAEPTNKPSEDGNGGQQRGKMTCDENSVDERFPYAPPDVCELSGDVRVSPSRRRCTW

SEQ ID NO: 84990 - DNA, 933 bp, Zea mays
  misc_feature: Ceres CLONE 1571186
  misc_feature: Encodes the peptide sequence at SEQ ID NO. 84991
gcggtggcggccgctctagaactagtggatcccccgggctgcaggaattcgtctcacccctagaaaaaagctcctgccagtcgcaactcgcgtcctctccaaaaacagcccacagctgaagcgagaacacgaatgctcagtgatatttctctcgaggtctgcacactcgtctcctaccgagaccgtcggcggccatcgtcgcacacgctgtgctcatgctaagtgtcgaggctcacacgtactactactacccgaccgcgaggccgagacggaagctatgcgcctgcagaaacgtcttgcaggaaaccgccccgcgtgacgcagaggcaaatccctgccgtcacggcgagaggaagagcaggagaaggggcgacggtgcttattacatcgacaaggacggcggcggcgtagccaggaccttcgaccggaagaaaatatccagaaagagggggggtgctatcaaagggcgcggatggaagtacggctccgggttcgtcgacggagtgttcccagtgctgagtccgatggcgcaggatgtgctagaactcgtgcagacgagggggaccgacgcggccagcggtctgggagtcactgggcaaaatcccctcaagcgcacgatttttggggacgacatcgtcaacgtcccccgtccagcttccgcctgaaccgggaattgggaaccgaatcttcacagtctgcgaagtgggtccctgcgccggaaactcgttccccccccgaaattttttggttaaaaccgggtcattttaacccttcgggccaaaaactctccctttaccaaggcggagggggctttaatggggccttcaggaagggctccttcgtgccccccgagaggaaccctagctttgtgtttggggccgttaagtgggtccggggaaatttccagtaaccaaggggttatttctagataac

SEQ ID NO: 84991 - protein, 149 aa, Zea mays
  misc_feature: Ceres CLONE 1571186
MLSVEAHTYYYYPTARPRRKLCACRNVLQETAPRDAEANPCRHGERKSRRRGDGAYYIDKDGGGVARTFDRKKISRKRGGAIKGRGWKYGSGFVDGVFPVLSPMAQDVLELVQTRGTDAASGLGVTGQNPLKRTIFGDDIVNVPRPASA

SEQ ID NO: 84992 - DNA, 761 bp, Zea mays
  misc_feature: Ceres CLONE 1571188
  misc_feature: Encodes the peptide sequence at SEQ ID NO. 84993
acccgcggtggcggccgctctagaactagtggatcccccgggctgcaggaattcgtctcacccctagaaaaatgactcgctgccctcggcgctgctcctggacccggcacctatgttcgcacgtcgccacctcgacgccggagggtggagtggggcaggaccagacgctctcctctgttacccccctaacccgctataaagaaaaagaaaaactcaccgagagagagagcgagcgaccggtggctcgttcagccatggggcacggcagtcatgctgcacccgttccggcgactagcactactacttccgcgcatgacaggtcgggaacctcgaggccgtggacgctctcgtcgacgccgaaccctctacttcccggcgtgcctcgctctacaaccgcatctccgctctcgagatgaccgccgctaatgggcggatcgatgtgctgtctatggccttggataacaggatgccgacgaacgtgatgaatcagaacttgcagacgccgctgatactcgccgcgaatgacgtgcagacagaatgcatgctgaaactactgaacgtcagctgcgacttactcatgttccatgccagaactgacagtactgcgtgcacacatgtcctatttcggaacgtttgctgcactctggacatcctgacgaagcgcggaacaagcagatggctactgagggggttccggccagtttcacaacgttagggaagtacgaagcgcaaaactgatcaagctccccggcaagtatggc

SEQ ID NO: 84993 - protein, 100 aa, Zea mays
  misc_feature: Ceres CLONE 1571188
MTAANGRIDVLSMALDNRMPTNVMNQNLQTPLILAANDVQTECMLKLLNVSCDLLMFHARTDSTACTHVLFRNVCCTLDILTKRGTSRWLLRGFRPVSQR

SEQ ID NO: 84994 - DNA, 793 bp, Zea mays
  misc_feature: Ceres CLONE 1571193
  misc_feature: Encodes the peptide sequence at SEQ ID NO. 84995
  misc_feature (178)..(178): n is a, c, t, g, unknown, or other
aaagctggagctccccgcggtggcggccgctctagaactagtggatcccccgggctgcaggaattcgtctcacccctagaaaaaaccgttggcacgccatctaatcagcgaagaggagacgacgactgctctgcctttcttccctacaggaacaggacgaatcaatcaatcattcccnctctgcagccgccggccctcagcaagcaagcaagggacagacgcggcggggatgggcagcggggtccgggcgctgatgcgccggaacaggtagactccgagcggacgcgcgccgccggcagcgcccaccagctccgcaaggagctctccgtcacccagctcgtcgccatcggtgttgggtcgacgattggagctggcgtctacgtcctttgttgggacagttgcgcggggagcattcccgggccggcaatggacgcctttcattttcttgataagcccggaatagccagcttgcgccttttcaagccctttctggcttatggcgggaagctggggctaagccccgtttgccccctttccgggcaagggaaagccccccctatccaatttttgtgcggtacccatcccggccgttttgggccaaaaagggaaacttgccccatggggttgagaattgggggccttggggggcttttggaaaaaccctgggaaaaaacaacccaaaatgggggggggggaaatactaaacccccgtttgggccccccgtggaggaatatttttccctccccctaaaataccagagaccctctttttattttttttttggggaaaaga

SEQ ID NO: 84995 - protein, 264 aa, Zea mays
  misc_feature: Ceres CLONE 1571193
  misc_feature (60)..(60): Xaa is any aa, unknown, or other
KAGAPRGGGRSRTSGSPGLQEFVSPLEKTVGTPSNQRRGDDDCSAFLPYRNRTNQSIIPXLQPPALSKQARDRRGGDGQRGPGADAPEQVDSERTRAAGSAHQLRKELSVTQLVAIGVGSTIGAGVYVLCWDSCAGSIPGPAMDAFHFLDKPGIASLRLFKPFLAYGGKLGLSPVCPLSGQGKAPPIQFLCGTHPGRFGPKRETCPMGLRIGGLGGLLEKPWEKTTQNGGGGNTKPPFGPPVEEYFSLPLKYQRPSFYFFFGEK

SEQ ID NO: 84996 - DNA, 895 bp, Zea mays
  misc_feature: Ceres CLONE 1571196
  misc_feature: Encodes the peptide sequence at SEQ ID NO. 84997
ctccccgcggtggcggccgctctagaactagtggatcccccgggctgcaggaattcgtctcacccctggaaaaaaaaaaaaaaaaaaaaaaaaaaaaaaaaaaaaattgaaggagcactcgtcgtccacctcaccactctctctgtctctcctctctctctccttcagttgctctggtttctgaccagccttgacgcggttgctactttttttttctttctttacgggacacggcacggttattttttgaagcggaggggtagatctgaatcggtgggttcgcgggacggggtatttaaggactcgtggcctcgcccctcctctgcacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggtgcaggaaccctcttctcagcactgatgttgagaacacgtcgctgaagctgacattatctttgtctcggtggacacccccaccaagacccgtgggcttgtaactggcaagctgcccacctcacctactgggaagcgctgcccgcttgattgcggatgtctccaatctgaaaagattgttgttgagaagccacggtcctgtcaaaacgctttagctat

SEQ ID NO: 84997 - protein, 95 aa, Zea mays
  misc_feature: Ceres CLONE 1571196
  misc_feature (2)..(88): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRCRNPLLSTDVENTSLKLTLSLSRWTPPPRPVGL

SEQ ID NO: 84998 - DNA, 1248 bp, Zea mays
  misc_feature: Ceres CLONE 1571198
  misc_feature: Encodes the peptide sequence at SEQ ID NO. 84999
  misc_feature (60)..(60): n is a, c, t, g, unknown, or other
  misc_feature (1248)..(1248): n is a, c, t, g, unknown, or other
acaaaaaataatgaagcggagttaatcgttgggcctcctcccttatataacaaatatccnaataattggggggcatactggaactccccgcggtggcggccgctctagaatagtggatcccccgggctgcaggaattcgtctcacccctagaaaaacttggccactcttcttcctcctcatcaatccgctctccagcacttgttcggaagaaaaagaagctagaacacgctaacaagacaacaaggatcatggggcgcgggcgcagccacctcctgctgccggcagcagccgcctgcctgtgggcgctgacgtgcgcgctgctgcttcacgcgtcccctcaccgctctggcgtccggctccggctggctgctgagggtcaggctcaagcatgcgcttcggcgggctctaccaacgcgcgctggcagcagccaaggccgctagacaacaagatgcaagccaactcagggcctctggcggccgcgacgtcccatctcgtctaacaccctaatcacccccctcctatgggtgtatctctggcaaacgagaaaaaccggccgcaataaactgcaatcttgtcattttttcgcaccatcggaagaagctttaaaaccaatcaagaagagtccccacatctattccctggaagtgttaccctcgtaaccaacaatagtgacaatggcactacacctcgtcccaccctacccatgcattcacctgatgttctccctggccctcatcaatgaactctaagggcgactctgattgtctcacagaccctcttcagtgagaaaccgcgcgatcctttagaaaccgaatatctctcccctcaactcataatattttgcaaccaaccgacaaacgtgtgattcttaaatcaaagggaaaataccaaacatattactacgaatgacaactatctcactcctatatccaggatctcgttacacataatgctagaagcttgctatattatattgattcgactataaggaataccacatgttacacccctttttataataaaccagaagagagtcaaggatatagacattttcgttatataatataaacaccgctattcttgtaataatagcctatcttccgtaatcccgaacccaacatatatatgtcggctataaaaaagtgcgagcggaggacagggcaaccggcgcgagtaagggccggcccggagttcgccaaccccgatagacactttttataattaatagcgcaataagaatatctan

SEQ ID NO: 84999 - protein, 83 aa, Zea mays
  misc_feature: Ceres CLONE 1571198
MGRGRSHLLLPAAAACLWALTCALLLHASPHRSGVRLRLAAEGQAQACASAGSTNARWQQPRPLDNKMQANSGPLAAATSHLV

SEQ ID NO: 85000 - DNA, 857 bp, Zea mays
  misc_feature: Ceres CLONE 1571200
  misc_feature: Encodes the peptide sequence at SEQ ID NO. 85001
  misc_feature (682)..(682): n is a, c, t, g, unknown, or other
  misc_feature (730)..(730): n is a, c, t, g, unknown, or other
  misc_feature (839)..(839): n is a, c, t, g, unknown, or other
acccgcggtggcggccgctctagaactagtggatcccccgggctgcaggaattcgtctcacccctagaaaaagcccggccgtccgtgccgaaggaagtatctgctgacccagcccatgcccatccacctcgctccctcgaccgacccacccagcccagcgcgcgctcgcatggcgatgctgctccgcaaggtgtggggctccgtgctggcgcgcgccgcagcgccgggggccgacccgcgggcccgccgcgcgcaggcgcatcgcgcggagcagtaccagtaccacggctcgctatcgctgggcgcgctcgacgccgtccccaccgacgtgctcgcccagatcctgcgcctgctgggcccgctcgacgccgcgcgctccagcgccgtctgccgcgcctggcgcgtcctcgcctccgacaacggcctctgggctttcttcctccgcctcggccccgagccctgggacctcgtcgtcttcgccgagacgcacctcgccgccggccccgcctcgcacccgtggctgtactacgatagctcgccgcagctctcgttcaaacagatttacggcctccgagcgctggtcccgggtactctcatcgtggatggtggatctggttattgcaagtatggctggagcaagtatgctgctccttccggggcgtgtgctacattcttggaattncggtacattgaagcacctatgtatgcaaggcttcgtcacttcttctcntacatatatacgaggatgcaaataaagccttcgactcagccagttatttgtgtccttccactgtgtcactctggatgataccgagtctgctagggcctcaagaaacatncaaagagacactgtactt

SEQ ID NO: 85001 - protein, 212 aa, Zea mays
  misc_feature: Ceres CLONE 1571200
  misc_feature (45)..(92): Pfam Name: F-box Pfam Description: F-box domain
  misc_feature (171)..(171): Xaa is any aa, unknown, or other
MAMLLRKVWGSVLARAAAPGADPRARRAQAHRAEQYQYHGSLSLGALDAVPTDVLAQILRLLGPLDAARSSAVCRAWRVLASDNGLWAFFLRLGPEPWDLVVFAETHLAAGPASHPWLYYDSSPQLSFKQIYGLRALVPGTLIVDGGSGYCKYGWSKYAAPSGACATFLEXRYIEAPMYARLRHFFSYIYTRMQIKPSTQPVICVLPLCHSG

SEQ ID NO: 85002 - DNA, 1315 bp, Zea mays
  misc_feature: Ceres CLONE 1571201
  misc_feature: Encodes the peptide sequence at SEQ ID NO. 85003
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
cttttgttatctacctctttttattttttcccccctgttcaccctgacgatntnnnnattttttttttttaagctggagctccccgcggtggcggccgctctagaactagtggatcccccgggctgcaggaattcgtctcacccctagaaaatgctttttcactgcatgctgtagcattgacagcctttaccgtttttcaagtattcatatatgagcgaggaacacagaaagtctccaaagtttgcatatcaatttctgctattgtctggatcgccgctcttgtttgcctcattattgcttggccaaaaagtgactggctttggcttattgatgtattcaattcaatacaagttggcatgacagcaatcaagtacatccctcaggccatcatgaacttcaggcggaagagcacaattggttggagcgttggcaatatattacttgatctcacaggaggggtgctgaattcttgtcaaatgggtgtgcagtctatagatcaacatactttggtgaattcctatggaaacatggggaaaaacccttcttttcattggagaacggtttcctttgaatgtcccggttcatttatccaacaactaccttggtttgtacccctggcccagaaaaggaacgagaatgggttaaaggccaatcctttttcttgaaaaaggggtaaacccccccccttaatcaaagcgccttttggaaaacaaacccctgaaaaaaaaaaaataaaccgttaaggatctctaacccctggtagagtttttaatatttggcccccacgccttttgtggatattttaaacgcaccctcttttttgtttgctacacaaatagggggcacacactataaacccgcactatttgtcagaaataatatatattcttgaggtttcaaaaatgaagagagaataatttgtctggtcgcgcgcccgccccccttgggaaattaataatttatactagtgcgccttattaataaaccctctttttatatactaaactggggggggcgcacacatctggcgaagagacaaataaactgtctctcccaaaaataaccaaaaatatgttgcgcgggtattctaacagaggtgggcgccccggctttttttatatcctctcccctactatattttcttcaaaaagtgtttttttaataaaatattcgatctctggctccaacattctttataaccaaataagcgccccgcgtatatataaattggggggcgcgctaactacattttatgattggggccgtcacatatcacgatctttctttgttctcgcacagagtttatatcatata

SEQ ID NO: 85003 - protein, 102 aa, Zea mays
  misc_feature: Ceres CLONE 1571201
  misc_feature (1)..(53): Pfam Name: PQ-loop Pfam Description: PQ loop repeat
MTAIKYIPQAIMNFRRKSTIGWSVGNILLDLTGGVLNSCQMGVQSIDQHTLVNSYGNMGKNPSFHWRTVSFECPGSFIQQLPWFVPLAQKRNENGLKANPFS

SEQ ID NO: 85004 - DNA, 849 bp, Zea mays
  misc_feature: Ceres CLONE 1571202
  misc_feature: Encodes the peptide sequence at SEQ ID NO. 85005
tggcggccgctctagaactagtggatcccccgggctgcaggaattcgtctcacccctagaaaaactcccacccgcgcccgcgcccacgcccacggccgcaccaaccaccagccccgatttcctcctaatcaatcacacccccaaaccaaaacccaaacagcacttctcctgcaatcgccgacgtcgccggaggcttcgccggccggagcagcgccgacggttgttttgccccttcctcgtccggcccagcagcccaggcgagcatgccttcgcttgcgccaccgtcttcctccgtcgctgcgctcacccgccaaccggtgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggttatccagctggcggtgtctcttggaaggaccacactctattgccaaaaagcacaaccattcgtggccaggaacatccggttgctgaccccgtactcccaatggattccatgattacgccagaaatcctctctgctaatgtggaacgtgttatagacatgtttgcagatgatgaaactgatacttgaacctgatttggatagccccgacagagggcttcggcatcaattgcagaaacccattgagggacttacaaccaagaaaaacttggtgaatggttgttgatgaatgaaaccagggggaaaatggaaggagaatcggataaatggctgcccttccttgggttaccccccagaaggccaatgggctttttataagtaaaaggcatgggggaaa

SEQ ID NO: 85005 - protein, 125 aa, Zea mays
  misc_feature: Ceres CLONE 1571202
MPSLAPPSSSVAALTRQPVQFFKGCSVSKETKGPVRSFFTANSKSTKVKSAGLKVASSFKNDGGYPAGGVSWKDHTLLPKSTTIRGQEHPVADPVLPMDSMITPEILSANVERVIDMFADDETDT

SEQ ID NO: 85006 - DNA, 773 bp, Zea mays
  misc_feature: Ceres CLONE 1571203
  misc_feature: Encodes the peptide sequence at SEQ ID NO. 85007
  misc_feature (705)..(705): n is a, c, t, g, unknown, or other
  misc_feature (715)..(715): n is a, c, t, g, unknown, or other
  misc_feature (733)..(733): n is a, c, t, g, unknown, or other
ggagctccccgcggtggcggccgctctagaatagtggatcccccgggctgcaggaattcgtctcacccctagaaaacatcagcaaggcggagctgctcgagttctgggaccaaatctccgacaccagcttcgacggccggctgcagacgttcttcgacatggtggacaaggacgccgacggaaggatcaccgaggaggaggtcaaagagatcatcacgctgagcgcgtcggcgaacaagctttcgaagatcacggatcaggcggaggagtacgcccggctgatcatggaggagctggacccgggcaacctgggctacatcgagctgtacaacctggagatgctgctcctgcaggcgccgagccagtcggtgcgcatcggcacgaccaacagccggaacctgagccagatgctgagccagagcctccgtcccacggcggagccgaaccctctccggcggtggtaccggcgcgcgcagtacttcctggaggacaactggcggcgcgtgtgggtgatgcttctgtggctgtgcatctgcgcggggctgttcgcctggaagttcatccagtaccggcagcgctacgtgttccaggtgatggggtactgcgtgtgcgtggccaagggcggcgcggagacgctcaagttcaacatggcgctgatcctgctcccggtgtgccggaacacatcacctggatccgcaccgcacngccggcgtgnggcgcgtggtgcccttcnacgacaccctcacttcacaagggggtgcggtgggcatcgc

SEQ ID NO: 85007 - protein, 205 aa, Zea mays
  misc_feature: Ceres CLONE 1571203
  misc_feature: SWISSPROT Homolog: EC 1.6.3.1 NAD(P)H oxidase
  misc_feature (183)..(183): Xaa is any aa, unknown, or other
  misc_feature (186)..(186): Xaa is any aa, unknown, or other
  misc_feature (192)..(192): Xaa is any aa, unknown, or other
MVDKDADGRITEEEVKEIITLSASANKLSKITDQAEEYARLIMEELDPGNLGYIELYNLEMLLLQAPSQSVRIGTTNSRNLSQMLSQSLRPTAEPNPLRRWYRRAQYFLEDNWRRVWVMLLWLCICAGLFAWKFIQYRQRYVFQVMGYCVCVAKGGAETLKFNMALILLPVCRNTSPGSAPHXRRXARGALXRHPHFTRGCGGHR

SEQ ID NO: 85008 - DNA, 770 bp, Zea mays
  misc_feature: Ceres CLONE 1571206
  misc_feature: Encodes the peptide sequence at SEQ ID NO. 85009
ctcaccgcggtggcggccgctctagaactagtggatcccccgggctgcaggaattcgtctcacccctagaaaaatcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtgggggggaggccactacgtactcgccaccgtgctcgccttcctcgccgtcctcgccttcaccatctccgtctacatcatgtgcaggcccaggccccgtgtacctcatcgacttcgcatgctacaagccgggcggaccagctcaaagtggtccaaggcggagttcatcgaacctggcgcgcaagtcccgcaagttccacgaggacaagcttggggttcaagtcgcgtctgctgggccaagtccgggattccggggacaaatcctacatgccccgccttggttgtttaaaaccaaaagccaggtggccccacctt

SEQ ID NO: 85009 - protein, 185 aa, Zea mays
  misc_feature: Ceres CLONE 1571206
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGGGHYVLATVLAFLAVLAFTISVYIMCRPRPRVPHRLRMLQAGRTSSKWSKAEFIEPGAQVPQVPRGQAWGSSRVCWAKSGIPGTNPTCPALVV

SEQ ID NO: 85010 - DNA, 820 bp, Zea mays
  misc_feature: Ceres CLONE 1571210
  misc_feature: Encodes the peptide sequence at SEQ ID NO. 85011
ctccccgcggtggcggccgctctagaactagtggatcccccgggctgcaggaattcgtctcacccctagaaaaaacggatccaaattccaaaccgcgcgaacttctgccgctcaaaattccaaatcgtcctgacttcccgcgcttcccataatcctatcccgcccgcggcccctctcgggattcaaacgccagccgtttgtcctctcaaacccgatcggatctgaccgccctcccaggccgtaacaggatcccgtcggtcatggccgtgataaacgggcgctcgaagcgtgttcgggtgacggcggtgccgcgccctctggagctgcggtcgttcccggccgccggagaggggccgcgcccgctggtcctgctgtcgttgccggccgccggagaggggctgccgccgcgtggcgcgtttcacgactgtgtacggtcgttcctggctggatccgcggtgccggcggacggcgcgtggcaggtagcctttggagtcgggaacggggtggtcgggtgaggaagtgggtggaaagagggcgtcgctaaaactgggatcgagcggatctactgcgatcactgtaccgtcgccgatgccattcggctggagtagacaccctgtttgtgggaaggaaggaccatttcataattcgggatgaatacaaaacctgcaagcattgtgaccattgggggcttatgggcccaatcgtttggaacacggggcccgacatgccaaatattgtgatctcccctgatgaatccgaaagattgggaatattagcaattggaaaaacccacgtcccttggctggctgggtattggaaa

SEQ ID NO: 85011 - protein, 84 aa, Zea mays
  misc_feature: Ceres CLONE 1571210
MAVINGRSKRVRVTAVPRPLELRSFPAAGEGPRPLVLLSLPAAGEGLPPRGAFHDCVRSFLAGSAVPADGAWQVAFGVGNGVVG

SEQ ID NO: 85012 - DNA, 1217 bp, Zea mays
  misc_feature: Ceres CLONE 1571213
  misc_feature: Encodes the peptide sequence at SEQ ID NO. 85013
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (56)..(56): n is a, c, t, g, unknown, or other
nnnnttttnnnnnnggtgttccgagtgttcccaaacaactaaacttttctgttggnagtggaaacaaacaatccacttagtactacccgcggtggcggccgctctagaatagtggatcccccgggctgcaggaattcgtctcacccctagaaaaagtctgtgtgagctaagcgtccattgattggcgagaaaggggactaatgcattcgctgttgtgtgcgcaaggagcaatgagtaacgtccccgctatccttcaccttgccctgctccgcatgccgccgcccgaagcgcagcaaccagccccgcaagatgcggatccgtctccgtctccgtctccgtccgtgcgtgctacagcgcaaacacggtgactttgctggactaccgcccggggaacgtacgcaagatgcgctacacaattcgctacctaggcttcgtgatccgcaacgcgaagaggccgcgagagatcatggccggggaaccccccccccctatcccggttggtcagccccgttccggttcacacctgtggatgtcctgaaaaacgaacggggggatggccaaacgtcacttcccgtgtaaacccctcccaaaaggcgaacccgggcccccctttacttaggggattctggccgtgaggttcctcccaaactggcgaccttcgtagttctcagagcgaaagggaaaaaaacgggccccccggtgggaaacccggcaccctccgggtggttggataaacccaatggggcgcttgagtctcctggcgcccaaaatgttgcgagactttctcctaccccacaagtggggggggcgctcccaatttaaatattttccccaccaataattaatttggggggagttgggggaatacacggaatcaccttctctcagaaaatccctcccaatgggcgggacactactcaccccaccctttgatgtcgaacaagggaaaagccctgttaaaatggatccaaaaccagtggtagggaactcccttttatgggggcaacaacggctctaacacgacagttatgagatcctccatctgtcctagagttggccaaaagtggagagataaactggggattatcttccccccgccgcgatactgtcgcacaaaaaattgtggagcgagccactgctcctataaaaatattaacactacagccgcgcgcgagtggaggaacgacactgtattgagggtgagatttgttttgtgg

SEQ ID NO: 85013 - protein, 44 aa, Zea mays
  misc_feature: Ceres CLONE 1571213
MRYTIRYLGFVIRNAKRPREIMAGEPPPPIPVGQPRSGSHLWMS

SEQ ID NO: 85014 - DNA, 800 bp, Zea mays
  misc_feature: Ceres CLONE 1571214
  misc_feature: Encodes the peptide sequence at SEQ ID NO. 85015
ctggagctccccgcggtggcggccgctctagaactagtggatcccccgggctgcaggaattcgtctcacccctagaaaaagtccctccctcgtcacatttgccgcccgtcgccatggggtgttcgtgtcctccgctcgccgacgccgcgtgcctggccctgcttcttctggcctcgtcgctggcgtgtcgccaccacgggtgcgcggcggccacgctgtcgacggcgtcgcggtgggtagtggacgagagcgggagccgggtgaagctggcgtgcgtgaactggccgtcgcacctggagccggtgctggcggaggggctgggcaagcggcccgtcggcgccatcgcggcggacgtggccgccatggggttcaactgcgtcaggttcacgtgggccacgttccctggtcacgacgccctcctactccgacctcaccgtcgcgcagtccctccagcggctcaccctcaaccgagtcgctcggcgggcatcagggtcaacaacccccggggtcgtcgaacttcaagctcatcgaagcccttaaaggccctggtgaacaacctgggcgagcaccaaccctgaatggccattcctggaaaaaccaccctgaacaaaaaccccggggggggctttaaaaaaaaaccgaaagggggcggggtttcttttgggggaaaccttacattttaaacccgaaaatttttggggtcaaaaggcgcccccccaaaaaatggcccccactgttttcccccgggggtcccccccaaatgttttccgggatttaaacacctctcgaaaaaaaaaaac

SEQ ID NO: 85015 - protein, 154 aa, Zea mays
  misc_feature: Ceres CLONE 1571214
MGCSCPPLADAACLALLLLASSLACRHHGCAAATLSTASRWVVDESGSRVKLACVNWPSHLEPVLAEGLGKRPVGAIAADVAAMGFNCVRFTWATFPGHDALLLRPHRRAVPPAAHPQPSRSAGIRVNNPRGRRTSSSSKPLKALVNNLGEHQP

SEQ ID NO: 85016 - DNA, 931 bp, Zea mays
  misc_feature: Ceres CLONE 1571215
  misc_feature: Encodes the peptide sequence at SEQ ID NO. 85017
tggaagctccccgcggtggcggccgctctagaactagtggatcccccgggctgcaggaattcgtctcacccctagaaaaagagagaaaaaaaactgcggagaggtagcggtggatcgaaaccctaggcgcggtcggcggcgatggcggcggcggcagcagcggcagctgcagcgcctgagtcgtacatcgggagcttgataagcctcatgtcgaagagcgagatccggtacgagggcgtcctgtacaccatcaacaccgaggagtccagcatcgggctaaaaaacgttcgctcatttggaactgaaggtcgtaagaaggatggccaacagattcctgccagcgacaagatatatgagtacatactctccccaggaagcgatataaaggatttgcaagtcaaatcatctccaccatctcagtcggcaactttacacaatgatcccgctattaattcagtcacattattcctcatcccagcttcccttttctaacatttttggccttctggctgcaagccccattagggagcccaaccctactttcacagaaatgctcgcattcttttaaattccaaaagcccacccccccatttttcaggggaaattttggccccccctttacccaattattgggaacccaaccctttcaaggtcatgtggaaaatcataccaaccttatggcccataattttagtcaaaaaaggactaccgtggcccgttacaaaatcccacccaccattttatggaggctggggtgaaaatatatagacaccccccccccagcgggggggtttttctcataacgtagaaaccacccccactcttttcttttgtggggcgcccccccccagttgtgtgtgggttgtcccacagaaagccccttcagccactcccctgggaaaaattcccccggaaactgcttgtttactac

SEQ ID NO: 85017 - protein, 116 aa, Zea mays
  misc_feature: Ceres CLONE 1571215
MAAAAAAAAAAPESYIGSLISLMSKSEIRYEGVLYTINTEESSIGLKNVRSFGTEGRKKDGQQIPASDKIYEYILSPGSDIKDLQVKSSPPSQSATLHNDPAINSVTLFLIPASLF

SEQ ID NO: 85018 - DNA, 856 bp, Zea mays
  misc_feature: Ceres CLONE 1571218
  misc_feature: Encodes the peptide sequence at SEQ ID NO. 85019
tccccgcggtggcggccgctctagaatagtggatcccccgggctgcaggaattcgtctcacccctagaaaaacaccaatcctgttaacagtgcctttggtctctggatgacatcagttatatgtgagatctggtttggtttctcctggatattggatcaattcccgaagtggtatcctatcaatcgtgagacttatgttgataggctgattgcacgatatggagatggtgaagaatctgggttagcacctgtagatttctttgtcagtacagtggatccattgaaagagcctccactaatcactgcaaacactgtgctgtctattcttgctgtggactatcccgttgagaagatctcatgctatgtatctgatgatggttctgctatgctcacatttgaatcgctcgcagagactgcagaatatgctagaaagtgggtgccgttttgcaagaagtacgccattgagccacgagctcctgagttctacttctcacagaaaattgactacttgaaggacaagatacacccatcttttgtcaaggagcgtagggctatgaagagagactatgaagagtacaaggtgaggataaatgcttttggttgccaaggctcaaaaagacacctgatgaaggctggaacatggcagaacggtacaccatgggcccggggaaacaatcctccgtggaccaccctggggcattgatccagggtttttccctgggggtgaagactgggttgccacggggaaactttggaatgggaaaatggaaaccttcccttccggggttaagtggtattggtgttccccagtaaggagtgaaaaaagatccccgtggcgtttatcccaaaaccaccg

SEQ ID NO: 85019 - protein, 198 aa, Zea mays
  misc_feature: Ceres CLONE 1571218
  misc_feature: SWISSPROT Homolog: EC 2.4.1.12 Cellulose synthase (UDP-forming)
MTSVICEIWFGFSWILDQFPKWYPINRETYVDRLIARYGDGEESGLAPVDFFVSTVDPLKEPPLITANTVLSILAVDYPVEKISCYVSDDGSAMLTFESLAETAEYARKWVPFCKKYAIEPRAPEFYFSQKIDYLKDKIHPSFVKERRAMKRDYEEYKVRINAFGCQGSKRHLMKAGTWQNGTPWARGNNPPWTTLGH

SEQ ID NO: 85020 - DNA, 847 bp, Zea mays
  misc_feature: Ceres CLONE 1571219
  misc_feature: Translation starting site: 169
  misc_feature: Pfam Name: PEPCK_ATP Pfam Description: Phosphoenolpyruvate carboxykinase
  misc_feature: SWISSPROT Homolog: EC 4.1.1.49 Phosphoenolpyruvate carboxykinase (ATP)
ctggagctccccgcggtggcggccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcatggcgcgccatcgacgccgagggcgcatcaggagtaccgtcatcccggccgccccgccatcgccgtcagcgacagctccctcaaggtcactcatgtgctcaacacctctcgcctgctgagctgtacaagcaggccatcaagtacgagaaagggggcgtcatcacgtccaccggggccctgggaaacccttccgggggcaaaaccggggggggccccaagggaaaagcgcggccttcagggaacaaggtccccccccaagaacctgggggggggcaaggggcccccccccaacccggagggggaaagaagaacctctccggatcaaagggggaagg

SEQ ID NO: 85021 - DNA, 1333 bp, Zea mays
  misc_feature: Ceres CLONE 1571223
  misc_feature (65)..(65): n is a, c, t, g, unknown, or other
  misc_feature (960)..(960): n is a, c, t, g, unknown, or other
  misc_feature (1128)..(1128): n is a, c, t, g, unknown, or other
  misc_feature (1240)..(1240): n is a, c, t, g, unknown, or other
cttgctatcaatcttctctctgtcccggccccttctcgccttttttattaataatcgggatttcncctcttttggagctcaccgcggtggcggccgctctagaatagtggatcccccgggctgcaggaattcgtctcacccctagaaaaatccccgttcttgcactcgagttcttcagttcttatgaatagtcagacggaacaactcgagtttgccatggtggtgatctggaaccggggtgtgctgccccctctttgattcgctgattggtatcgctccagttcgacgcatgatttggaccggaccggcggaagttgtgaaaggaaaacggcctgcatgtttgggtccacggttcaggaagaggtggataattagaagaagccctaagaaataggaatttttccgaacgagtagaactaaattgaatctaagctacttggatcatagtagagtggggttgaaagatttttggggcaaaccccccccttatcctgaaaaaatcttggccaaaccttaaaagggtttaatatgtaaaagcaacaaaactcgttggccatctattgtttttttcttggtctctgttaaaataaactttttggctcacggaatattgtaaatcgggggtggtaacctcttgtttggcacggtgtcatgttttagtggcctctcacttgtgataatatagcgcgtttttcttgttaggtcaccccttgttctgtttgcgagtctactactccgatagttggtgccagaggtggaagacccttctacatgacgcgttttttgtctttagagtgactatcgcttgtgtggtggtagattgcttactcgaagtatatcgtatattagtctcccctgcatcatagacacgcacgcgttggtgttgtaatgcgtctggcggctccagagaagcgctcttgattaagttcatttcctcaagcggcatgacttattgctgtntgttcttatccgacaagccgtgtccatttcgctctatgtgtagagacctgcgtctagaagagcgtccactattatgtatgtatcatcgtgtctcgataaacagggcgagaaagtattgttctctatagtgtaaagttatgatatgacccagcatatgacacatatacntttcgctgcgagaaagcaatgatgtatgaacatattgtgagttatcatcacgggcgattgtcatgtttagaggttttagagactacacatagcgatgtcatgtacggcactnatgtgcgcttctacgcgcgatctatatacttgtgtggcgtgctgctcgccgagggcggtgcggagtatgacttcagccttttcgtttgcgctc

SEQ ID NO: 85022 - DNA, 838 bp, Zea mays
  misc_feature: Ceres CLONE 1571225
  misc_feature: Encodes the peptide sequence at SEQ ID NO. 85023
ctccccgcggtggcggccgctctagaactagtggatcccccgggctgcaggaattcgtctcacccctagaaaaaggaactcccgaaagggctgccgtccgatgggtacacgaaagtgacgaagttgctttgactactgaaccatgcctggatcgtcggagcgaattggatgatcgggccgagggctgccccctcttcccctcgctctcctttccttaatattcaccgtcgagtcatcaaagccgtcaactaattcggaggggctcggctggcccggtcgccctacgctactggcgcttccaaaggcgaagctctcgtctttggcgaccagcaaagcaaacggagggagggctaaaacctttcgttttgaagcaagggatgagcgcgaaagccgttgcgcttccgtacacgcgcatactcttgctccgtcgcgcgttaggttaggttagtacttagtacttaacttagtacaataacgcgcagccgttttgggcggacacggttctctaaaggcgaagactctgaagtgggcgaacactcggcccagcgggcgaacatgccggctccggctccgcgcacctgctgacacttttcgaagcactttcacgtgtgaaccgaagtcgtcttgtcctttccttctcatttcagtcctcgcccttttcattctccgtaaggggcctttagccttttgattaaagtagaggccgcgagaagaacagaccgtaccgcctggccatagtccgcgaggatcttaaatagtcggggcgcgaactggttgtcataagtccaacgaccgggtttaaaacttcccggggaaaaaaacttgcaaattggggagg

SEQ ID NO: 85023 - protein, 71 aa, Zea mays
  misc_feature: Ceres CLONE 1571225
PRGGGRSRTSGSPGLQEFVSPLEKGTPERAAVRWVHESDEVALTTEPCLDRRSELDDRAEGCPLFPSLSFP

SEQ ID NO: 85024 - DNA, 823 bp, Zea mays
  misc_feature: Ceres CLONE 1571226
  misc_feature: Encodes the peptide sequence at SEQ ID NO. 85025
  misc_feature (710)..(710): n is a, c, t, g, unknown, or other
ggagctcaccgcggtggcggccgctctagaactagtggatcccccgggctgcaggaattcgtctcacccctagaaaaacctcgcaggtgaccttgcgtacgtacgtcgtagcggctcgtccagctcgctcgccaccgccatggacccgtacaagcaccgcccgtcgagcgccttcaacgccccgtactggaccaccaactccggcgcccccgtgtggaacaacgacagctccctcaccgtaggcgcacgaggtcccatcctgctggaggactaccacctggtggagaagctagccaacttcgaccgcgagcgcatcccggagcgcgtggtgcacgcgcgtggcgccagcgccaagggcttcttcgaggtgacccacgacatcacccacctgacgtgcgccgacttcctgcgcgcgcccggggtgcagacgcccgtcatcgtccgcttctccacggtgatccacgagcgcgggagccccgagacgctgcgcgacccgcgcgggttcgccgtcaagttctacacccgggagggcaactgggacctggtgggaaaacaacttcccgtcttcttcatccgcgacggcatcaagtttcccgacatggtgcacgcgctcaagcccaacccggggacgcacatccagaacaactggggcatcctcgaatttcttttcggaccacccggaaaacctccacaatgttctcctttcttcntttgaaaaaggtggggatccccgcccgaatatccgccaattggacgggatccgggggtggaaaattaaacactttgttaacccggggcgggaacccgttaccctaaggtaagt

SEQ ID NO: 85025 - protein, 190 aa, Zea mays
  misc_feature: Ceres CLONE 1571226
  misc_feature (18)..(185): Pfam Name: Catalase Pfam Description: Catalase
  misc_feature: SWISSPROT Homolog: EC 1.11.1.6 Catalase
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGKQLPVFFIRDGIKFPDMVHALKPNPGTHIQNNWGILEFLFGPPGKPPQCSPFF

SEQ ID NO: 85026 - DNA, 854 bp, Zea mays
  misc_feature: Ceres CLONE 1571227
  misc_feature: Encodes the peptide sequence at SEQ ID NO. 85027
cgcggtggcggccgctctagaactagtggatcccccgggctgcaggaattcgtctcacccctagaaaaaaagccaagcaaaaccctaagaaacccaccctccctccagtctcctcgacccccgccgccgccgccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctggccgcaggtgccgcgcgtgccggggaccgcgtcgtggtcggtgggtgggtccggacgggccgggagcaggggaagggctctttcgccttcctggagctcagcgacgggtcctgcgctgccacgcttcaggccatcgttgacgccgccgtgcacccgctagcgcgcctcaccgccaccggcacctccgtcctcgtcgagggcgtgatcaaggagccgcccgaggggaccaagcagaacgtcgagctgaaggtcagccgcgtgcttgaggtcggcgaggtcgatgccgccgtctacccgctgcccaagggcaaggtcaaactcacgctcgagaagctcagggacgtcgttcatctccgttcgcgcaccaacacgatttggagcgggttgctaggattaggcacccagttagcctatgcctcacacaggttcttttgatggagaaagggattttctctatggtacattcacccaataattaacctaccagtggactgttgaaaggtgcgcgggttgaaaatgttttccaggtggacaaaccttttttttaggccaaggcctggagaaaaacctggaaagaaa

SEQ ID NO: 85027 - protein, 176 aa, Zea mays
  misc_feature: Ceres CLONE 1571227
  misc_feature (43)..(122): Pfam Name: tRNA_anti Pfam Description: OB-fold nucleic acid binding domain
  misc_feature: SWISSPROT Homolog: EC 6.1.1.22 Asparagine--tRNA ligase
MAADAAAAAMSATSLCDDLEPATVRTRIRDVLAAGAARAGDRVVVGGWVRTGREQGKGSFAFLELSDGSCAATLQAIVDAAVHPLARLTATGTSVLVEGVIKEPPEGTKQNVELKVSRVLEVGEVDAAVYPLPKGKVKLTLEKLRDVVHLRSRTNTIWSGLLGLGTQLAYASHRFF

SEQ ID NO: 85028 - DNA, 852 bp, Zea mays
  misc_feature: Ceres CLONE 1571228
  misc_feature: Encodes the peptide sequence at SEQ ID NO. 85029
  misc_feature (1)..(1): n is a, c, t, g, unknown, or other
  misc_feature (2)..(2): n is a, c, t, g, unknown, or other
nnaaaaagctggagctccccgcggtggcggccgctctagaactagtggatcccccgggctgcaggaattcgtctcacccctagaaaaatgccccgcagccccggcccctaccttttccttccgcttccctcccacccaccccacaccgcaagcccaaacaaaacgcaacgcgaaccagccacacgaatccaccagcgcacgcgcaccgtcacgcgaggggcccttctcgccccgtccggacccccgcccgtcgccgtctctcccgtcgcgcgcgccacgcgaacggcacctaggcgaagcggcgcacgatgaggccgggcgggccgccgaactcgcgggcgctgcagccgccgggcacgccggggcggtcgcgccggcgcccggaccctcacctgccgctgccgcaacgggatctgaactccctcggcgtgcctctgccccctcctcccccgccgtcgtcggggtcgctgtcgggcgccggcgtcgctcggcgcgccgaaacccgcgacctcgggcgggggccgcggcgccaacccgcccgcgctgtgcaagcttggagcgcgtgccgcgcctcgggagcggcccgggcgggacggtgtggatggggccccaacgccccacgggggcgggccaacccgcccaaggggctctacggggaacacgaacaacgcgtgggggggggagaatacgcgcgaaaatagccatcctccggaccggcgaggaaccccggcctggggggggccgcccccggaatgtaccaaacaagccgggggagccccagaatcccggctgggagtaactgggacccagggggccgctccgagaagcccccgcaatcgcccaaaaaagagg

SEQ ID NO: 85029 - protein, 130 aa, Zea mays
  misc_feature: Ceres CLONE 1571228
MRPGGPPNSRALQPPGTPGRSRRRPDPHLPLPQRDLNSLGVPLPPPPPPSSGSLSGAGVARRAETRDLGRGPRRQPARAVQAWSACRASGAARAGRCGWGPNAPRGRANPPKGLYGEHEQRVGGGEYARK

SEQ ID NO: 85030 - DNA, 973 bp, Zea mays
  misc_feature: Ceres CLONE 1571230
  misc_feature: Encodes the peptide sequence at SEQ ID NO. 85031
ctccccgcggtggcggccgctctagaactagtggatcccccgggctgcaggaattcgtctcacccctagaaaaaaaaaccctagtcgctactccaccgcggcgccaaccacctcgatcgggctccgattccgatggacttcgcggagctggaggccgtggagggcctccggtggccgtggcactcgtggccgccgactgctcccgccgccgcgtccctcgtcgtgcccacggccgtcctctgctcgccgctgcagcaccccacggagcccgacctcctcccgctgctcccctacgcgccgctccgctgcgcctccccgggttgcggcgccgcgctcaacccgttctcgcgcgtgcaccacggctccgcgcgctggtcctgccccttctgcggcgccaccagcaacccgttcccgcgcctcctggcccccgacgcgctccccgccgagctcttccccacccactccagcgtcgagtactcgctgcctccggaccccgcctaggccgggggcccggggccacctgcgctcgtgttcgcgatctatgcggccaccgcggccgaggagctcgccgtgctgaaggacgaggtacgcacggtcgtgcaatggctgcccgaggggatcagggtggcgctcgtcactttcgctgcgtgcctatgggtgcaccatcatgcattttagggtcgcgctctcttggttgtgctccaaggccagcgttgagctcgatcctcacaagatacaaaaccttctaggtgtttccccgttcccccttacagtaagttggcttttgccaaaggtcccctgaatcccagcgaatttttgggccgcccggttttctgaaatgtggaatttatacctcccctcccgtccaatggaaggaacctggagcctcctcttgttttgctggtgcccaccttgggccccctcccccctttttattaagcaacctggggcgccacgcagtttttctctctct

SEQ ID NO: 85031 - protein, 122 aa, Zea mays
  misc_feature: Ceres CLONE 1571230
  misc_feature (55)..(97): Pfam Name: zf-Sec23_Sec24 Pfam Description: Sec23/Sec24 zinc finger
MDFAELEAVEGLRWPWHSWPPTAPAAASLVVPTAVLCSPLQHPTEPDLLPLLPYAPLRCASPGCGAALNPFSRVHHGSARWSCPFCGATSNPFPRLLAPDALPAELFPTHSSVEYSLPPDPA

SEQ ID NO: 85032 - DNA, 766 bp, Zea mays
  misc_feature: Ceres CLONE 1571232
  misc_feature: Encodes the peptide sequence at SEQ ID NO. 85033
  misc_feature (586)..(586): n is a, c, t, g, unknown, or other
acccgcggtggcggccgctctagaactagtggatcccccgggctgcaggaattcgtctcacccctagaaaaatctccgtccatcgtgcagatcttgcttcttcttcttcttcttcttctcctcctcctcctcctcctgaccaccctcctgctcagctcgtcgtacgtagacatcgcgatcgccgtcgtcgatcggtctcgccaagctcttgcttccgttcttttctggttggtttgttcggtgctctccctctacgcgagctgcgtctatatatatgctgtgttggcgcccgctgcataaatggcgtactcctcgcggacttgtggtcggtgcaacaaccacgagaggagatccggtttcatgaagtggctctgcaatttcctcaaggggccgaagcccggggagccgaaccgccggcggccccaggtgacggccggagaggaggaggacgcgctttggcatcaacgaccagttcgaccgaagaatgatccacctagaaatgacaacgaagaagtggaccgtgcaattgcagagtctctcacagaggacgtcagaacccccaaagagaaaaccccgcagggagacnaggacgacgaagatcttgcgagggccatacaggacagccttcacatgaacccttacacgccttacaacccctatgctccctctcacgccccaactaaaggggacaggctgtgcgcaggctgcaagcatgagatagggcatggccattacttgagctgcagggggatttactgccacccta

SEQ ID NO: 85033 - protein, 155 aa, Zea mays
  misc_feature: Ceres CLONE 1571232
  misc_feature (96)..(96): Xaa is any aa, unknown, or other
MAYSSRTCGRCNNHERRSGFMKWLCNFLKGPKPGEPNRRRPQVTAGEEEDALWHQRPVRPKNDPPRNDNEEVDRAIAESLTEDVRTPKEKTPQGDXDDEDLARAIQDSLHMNPYTPYNPYAPSHAPTKGDRLCAGCKHEIGHGHYLSCRGIYCHP

SEQ ID NO: 85034 - DNA, 781 bp, Zea mays
  misc_feature: Ceres CLONE 1571233
  misc_feature: Encodes the peptide sequence at SEQ ID NO. 85035
ctccccgcggtggcggccgctctagaactagtggatcccccgggctgcaggaattcgtctcacccctagaaaaagccccacaaaccctcgtctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatcttcctcagggagctcatctccaactcctccgatgccttggacaagatcaggtttgagagtttgacggacaagaccaagctggatgcacagccagagctgttcatccacattgtccccgacaaggccaacaacacgctgacaatcatcgacagcggcattggtatgaccaagtcagaccttgtgaacaaccttggtaccattgcgcggtcaggcacgaaggaattcatggaggcacttgctgctggtgctgatgtgtccatgattggccagttttggtgtcggtttctactctggcctacttgtgcagagaagggttgtcgtgaccactaagcacatgatgatgagcagtaccgtgtgggagtctcaggctgggtggctccttccctgtcgcacgtgatacctctgggggagcacctttgcaggggtacaaagatgaccctctacctcaaggatgaatccagttggagtaccttgaggagcgcccgcccccaaggatctggatcagaaaagcactcccag

SEQ ID NO: 85035 - protein, 140 aa, Zea mays
  misc_feature: Ceres CLONE 1571233
MASETETFAFQAEINQLLSLIINTFYSNKEIFLRELISNSSDALDKIRFESLTDKTKLDAQPELFIHIVPDKANNTLTIIDSGIGMTKSDLVNNLGTIARSGTKEFMEALAAGADVSMIGQFWCRFLLWPTCAEKGCRDH

SEQ ID NO: 85036 - DNA, 945 bp, Zea mays
  misc_feature: Ceres CLONE 1571238
  misc_feature: Translation starting site: 186
ctccccgcggtggcggccgctctagaactagtggatcccccgggctgcaggaattcgtctcacccctagaaaaaagtaatcagtgctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggtgctgtacctgacgctccggccgcgcgcggtgtacctggtggactacgcgtgcttccgcaccatcccaactgccgcgtcccgttcgcgacgttcctggagcactcccgcgtgtggcggggcttcacgagcgcaacgttccgttcatgacgcgcctgctggagcggtcggggctggggggaggagaattgcctgccgtacgcgcagcactacatcccgccgtcgcgcgaactgtgatccttcccgggccaaggccaagctcgttatcttttcgggccttgaagaaccgggtgggcaaaaaggggttggcccccccagggaattgaaacccccggggggggaaacgggaacctgtttccgcccaaaaccctcttttccggaaaatggttaggcccccggtacgggcctcccgggggaaatggccacgggccccctccccgggtggggcttcacccgggggttctcccctgggaggtgggcccaaaactctttcagggggcgcccccgggggcccccccccttgggggtttcccaaaaaaatcttccccaactttatt

SEQ ID NO: 85037 - DNA, 890 bp, Zea mays
  misc_feature: Ceres CLONE 1571239
  misc_feature (733)..(733): n is a, c, t, g, unknown, or other
acccgcggtggcggccgctctagaactagtggatcccccgggctgcaggaattcgtctcacccctagaaaaaagagcctgcagaggcttttcttccccccaccacacccatcgcgtgtgagtccacggtgtgatgtcacggagcggtggcggctttcccgattcactgtgcgggagaaatccccgtgcagccttcttccacctcctcctactctccgctattcgtcttcgctgatttctgccgctccaattccatcgcttccctgctttagaaccttctctgctagcttctccccgtcacagcttttgctgcctcgtcatcggcgaccaaaccgccggcgaccggataaactaagccagctccttcgctccgaaaagcgtctctcgtagagagcacttgctcacctgctccccgccccccctctactggcgctggacttgctcggagtggagatccatccggacctcacctggtttcgatttctttcttttcgggttccaattcggttttttctttccctgaaacgaaaagatccattatccccccggacccaacaataaacgattttccttggaagacccgaaggtttgctttctcctggctcagtgggggggggaataactggggattgggggaaatttttgcctcaaccaaccatggctcggggttttttccaaccccaattcccttttggtggaaaaccctagggatagagaacccacccagaggcccnttttttggtatgggctccctttcccctaaggggaagcctggggcgaagattacctctcggccagtgggccaacgaatgcgcctaggttttcccaaggggaaatggagcaccccccctccgaactcgtgtttttttagaaacactgcgcggtgataat

SEQ ID NO: 85038 - DNA, 873 bp, Zea mays
  misc_feature: Ceres CLONE 1571242
  misc_feature: Encodes the peptide sequence at SEQ ID NO. 85039
ctggagctcaccgcggtggcggccgctctagaactagtggatcccccgggctgcaggaattcgtctcacccctagaaaaagcccgctagggttttagtgttttagcctcctgcgtccctcccctgttccctcaacgcttctctcctccacctcttctcgacagccgctgccacccggaaccttctcgcagcgacgctatgtgggctctccgccgagctggtaaccccctcaggttccatgcccaaaaagttgtgagtccccgtggttgtgcgagccttgaggtgctgctaactgctgatgcaaaaaatgttgaagaacaccatgaggcagactgtcagaaagtgtgctactgtcataagccaaagccaccatccttcttattgtcattttcatctggccaatttgcttggagtaggggtttctcctctcagccaggtgcaaattctagtgacaaggatgatgagttagaggatgtattttctgatctcaatgttccaccagaagctggtaaaaaggatgctgggttgacatctgaagatacttctgatgaggatgccactgatgaaattggcttgcctagtatggatgctgatgtaaaaactgagacggagcacattaaaaggaacttttggttccacccttcctcaagactggggttggaagctccaaggcatcaaggtcccttccaaccgcttgagaaatggggcaaaagaatgggcaatgccctttgataagggccgaaacctctattaaggggctcccttaaatcttcccaaaagcggaaagttggtacccccaaagcccttgggagccttgtgttgaaataatgttcaaaaatatccaacaactgggctcaaaaactccggagaaaaa

SEQ ID NO: 85039 - protein, 177 aa, Zea mays
  misc_feature: Ceres CLONE 1571242
MWALRRAGNPLRFHAQKVVSPRGCASLEVLLTADAKNVEEHHEADCQKVCYCHKPKPPSFLLSFSSGQFAWSRGFSSQPGANSSDKDDELEDVFSDLNVPPEAGKKDAGLTSEDTSDEDATDEIGLPSMDADVKTETEHIKRNFWFHPSSRLGLEAPRHQGPFQPLEKWGKRMGNAL

SEQ ID NO: 85040 - DNA, 845 bp, Zea mays
  misc_feature: Ceres CLONE 1571245
  misc_feature: Encodes the peptide sequence at SEQ ID NO. 85041
  misc_feature (241)..(241): n is a, c, t, g, unknown, or other
  misc_feature (244)..(244): n is a, c, t, g, unknown, or other
ctccccgcggtggcggccgctctagaactagtggatcccccgggctgcaggaattcgtctcacccctagaaaaaccattctcctctccgaattcaataattcctccgccgcaccacgcttcctcctcctctgctccgcctcttcatccagcgagcgtcctccgattgctgacggatccctcctcgccgccgccgcgggccgaccgtggggagaggaggggaggcgggagtgatggaggccnccnaccacgggaagctctttgtcggcggcatctcgtgggagacgagcgaggaccgcctccgcgagtacttcggccgcttcggcgaggtcaccgaggccgtcatcatgcgggaccgcagcacggggcgtgcccgcgggttcggctttgccccccaccccgatgctgctgtcgccgagcgcgtcactacggaaaaacatatgatctacggacgaatggtggaagcaaagaaggctgttcccagggacgaccacagtattgtgaccaagagcaacgccagcagcatagggtcacctggaccgggacgcaccaggaagatctttgttggaggcctgccctcggacgttacggaggctgacttcagaaaggactttgagcagtttggcgtcatcactgatgtggttgtgatgtacgaccacaacacgcagaggccgaggggctttggattcatcacctacaattcggaagacgccgtggacaaagccctgcacaaaagcttccatgagcctaatgggaaaaaagggtgaggtcaaaagggctgtttcaaaaggagcagtctccctggaactggcccaaagcttaactggggggaaagtggggaagaaat

SEQ ID NO: 85041 - protein, 177 aa, Zea mays
  misc_feature: Ceres CLONE 1571245
  misc_feature (109)..(178): Pfam Name: RRM_1 Pfam Description: RNA recognition motif. (a.k.a. RRM, RBD, or RNP domain)
  misc_feature (9)..(78): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (4)..(4): Xaa is any aa, unknown, or other
  misc_feature (5)..(5): Xaa is any aa, unknown, or other
MEAXXHGKLFVGGISWETSEDRLREYFGRFGEVTEAVIMRDRSTGRARGFGFAPHPDAAVAERVTTEKHMIYGRMVEAKKAVPRDDHSIVTKSNASSIGSPGPGRTRKIFVGGLPSDVTEADFRKDFEQFGVITDVVVMYDHNTQRPRGFGFITYNSEDAVDKALHKSFHEPNGKKG

SEQ ID NO: 85042 - DNA, 935 bp, Zea mays
  misc_feature: Ceres CLONE 1571251
  misc_feature: Encodes the peptide sequence at SEQ ID NO. 85043
ggagctcaccgcggtggcggccgctctagaactagtggatcccccgggctgcaggaattcgtctcacccctagaaaaactccacaaggtctcaccctccctgtatccctctgaccctctcggcggcgactgggcgacagccgctgtctcactacgcctggtgcccaggtatctctgccggcgacgagcacctgccaggggtatgggaatggaggtcgttggtgctgaagcagcaccagcagagatcaaagtatctgatgatgtgaatctattccaagagaaggaaagcaaagcaactgctaaagaacgtgaggaggcagctgtttttggttcagagacaactaccaatgtcactgatctggcacctccaacggatgttgaaggatgagtgggctgaaactaaccaaaatttatgccgttctacttcatcaagggccgcttcattttgaggatcctaaaactgagggcaaaaactcgagcaaggttgacaaaagaattccaggaagaaaaattccaaggctcgcttctcaaacttttttttagggcctgttagaaacccaagaaaggccgggaagccgcctcccagttattttccccccggaagctctgaaagcccttttgaagccggctggaagaaacaaggcacattaattgatgggaagtttgcctgaaattggggaaaatatttaaggggggagtggggaggcctctctgttcggaaacaacctttgggggccaaatttttctgtgggaggagaaaacaaatggcctttgtaacaaagcacccaaaattgtccgggtttttttggctcccctttattccgggagaaaccctgtgatcgtctaacgggttttaagaaatccctctagatggaagcctgcccttgaattccgggaaggggccttacaccttcttatccggtaagggaagaaagg

SEQ ID NO: 85043 - protein, 61 aa, Zea mays
  misc_feature: Ceres CLONE 1571251
MGMEVVGAEAAPAEIKVSDDVNLFQEKESKATAKEREEAAVFGSETTTNVTDLAPPTDVEG

SEQ ID NO: 85044 - DNA, 922 bp, Zea mays
  misc_feature: Ceres CLONE 1571252
  misc_feature: Encodes the peptide sequence at SEQ ID NO. 85045
  misc_feature (624)..(624): n is a, c, t, g, unknown, or other
  misc_feature (830)..(830): n is a, c, t, g, unknown, or other
ctccccgcggtggcggccgctctagaactagtggatcccccgggctgcaggaattcgtctcacccctagaaaaaaggctttcagccgctctcctagtctcctactctcctctcagccgtcgccgtcgctctccacaccgctctcctctctcctccgagccgcagctcttctctctccctctcccctgcgtgccgccactgcgggcaccctgcacgccgccgctgcgtggccctacacgccaccgctacgggtgccctacgcgccgccgtcactgctccagctctcctctgtttcccagccaatgccgccgctctaactccccaaggcatcgccccgacgacggctcaacgaagccccgtcgacgcctcgcggacgccctgcgccgcagcgggcgctttacgctccatggcaaggcgcgttagatgcctcaagttccacaggcgccttagcgcctaagcgacgctaaggcggcgcttcagataagcatgcttttgaataagatgtgaaggattaaagctcatgtgaaagattctaagaactacattggtatcaagcggttgctttcttatttctcatacgctcaaccatgctcctgcatgctaaggattcagttaggaagatgcnatcagttgctaagaactactttgtgtctgatcttactcatccctcaagatccttgaacagagcttccagacatggtgttccatttcagaaccgtttctttacgcattgctcactttgagagccgtcagttgaccaagagattgtgaatgctatggggaacaatgttagcgatagagtcagtacattcacagggcatgcagctgagnaaagctctgactgaacatcactagcatgcctgtctctatgaaccgccctgcctattgactgatcagcgccgtttcctaccctgccatcgggg

SEQ ID NO: 85045 - protein, 51 aa, Zea mays
  misc_feature: Ceres CLONE 1571252
  misc_feature (13)..(13): Xaa is any aa, unknown, or other
MLLHAKDSVRKMXSVAKNYFVSDLTHPSRSLNRASRHGVPFQNRFFTHCSL

SEQ ID NO: 85046 - DNA, 802 bp, Zea mays
  misc_feature: Ceres CLONE 1571254
gcggtggcggccgctctagaactagtggatcccccgggctgcaggaattcgtctcacccctagaaaaagtcaatattcctgtactaccccttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaagggtacctgtacccgaaaccgacacaggtgggtaggtagagaatacctaggggcgcgagacaactctctctaaggaactcggcaaaatagccccgtaacttcgggagaaggggtgcccaccttttcccctctccacctcccgcaagcaaactcacggtcacggcaccgcccccgcacccactgccctctagcttcttcctccccgctttcatggcaggaaaggctgaagcgatgatgcccataggccatccagtttgatccatgccatcctgaaactctatacatactgccccagccccgggactcgcgatctctacttctctaaccgcgctgtgcctgtgctagctcctctctccgcttcggcttctggttttgcctcactcagcctggcgcaagctttttgctttgggtttagggggccttcttttgccatccctttacccgg

SEQ ID NO: 85047 - DNA, 830 bp, Zea mays
  misc_feature: Ceres CLONE 1571255
  misc_feature: Encodes the peptide sequence at SEQ ID NO. 85048
  misc_feature (754)..(754): n is a, c, t, g, unknown, or other
ctccccgcggtggcggccgctctagaactagtggatcccccgggctgcaggaattcgtctcacccctagaaaaagtcaagtcctccccctacctctaccagctgcccgtcgcacacaaaaccccaggctgcccgccgccgccgcgacccgccacgccgccatgtccgctgccgcggcgctccggccgatcgagccacttcccctcccgatcgggctctccctctcgccgcgcctcaagcttctgctcaccttctttcgcgccgacctcaccgtccggcccctggacgagtggcagctcaagtccgccctcctcgcgtttctccgcgacccacctctccccctcccgctcctccccgactcagacttctccgtgagccgcctccctgacctccagaagcgccgtcgcgaggagcccgtagcctctggggtcctccacgtccgcgacctctccttcctccgcccccgcaagggagacggtgaggccgaggagatgaccggggagcaggagaagtacttcgagtggcggagcaccctggttcagaagctcgaaggcatcgagctcaacctcgagggagtgaagttccggatgaccgtcgagatcccatcgtctgacgacttcagaacgatgaagaagtcatggggaggatttctactcctccgagctactcaatagcaggaatcttgtgagaaagatagctaaaaggccagacacaatttgttgttccgtggcggtgccttccaggtgggttggcanaagacaagaagtatccatccaaaccctttccaggcctgggtaacccccaaactggtttttttttatggggggggca

SEQ ID NO: 85048 - protein, 170 aa, Zea mays
  misc_feature: Ceres CLONE 1571255
MSAAAALRPIEPLPLPIGLSLSPRLKLLLTFFRADLTVRPLDEWQLKSALLAFLRDPPLPLPLLPDSDFSVSRLPDLQKRRREEPVASGVLHVRDLSFLRPRKGDGEAEEMTGEQEKYFEWRSTLVQKLEGIELNLEGVKFRMTVEIPSSDDFRTMKKSWGGFLLLRATQ

SEQ ID NO: 85049 - DNA, 865 bp, Zea mays
  misc_feature: Ceres CLONE 1571256
  misc_feature: Translation starting site: 166
  misc_feature (604)..(604): n is a, c, t, g, unknown, or other
  misc_feature (797)..(797): n is a, c, t, g, unknown, or other
  misc_feature (816)..(816): n is a, c, t, g, unknown, or other
  misc_feature (821)..(821): n is a, c, t, g, unknown, or other
tccccgcggtggcggccgctctacaatagtggatcccccgggctgcaggaattcgtctcacccctagaaaaaacctcacctcactcataccgagcgccagttgccagcacgaagagtaggagtagggatcgaagagtgagtgaaactgaaacacgaggaggagtcatggcgaccccggatgaccgcggcagctggttgctgtacctgtccctagccgccaaatgcgccggcgaccagccttaccgcctcgcgggcttcctggccgtctgcgccgtggccttcgtcgtgacctgcctcctgcactggtgcttcccgggaggcccggcgtgggggaggtggtggtggacgcggcggctcggtgccggtggcggcgcgacggcggcggcggcggcggccctgccggggccgaggggcctgcccgtggtcgggagcatgtggctcatgacgggcctggcgcaccgcaagctcgcggcggcggcggagagcctcggcgccaggcgcctgatggccttctccctcgggggcacgaggggtggtggtggcctcgcacccggacgtggcgcgcgagatcctcagcagcccggcgttcgcggaccggcccatncaggagtccgcgtacgggctcctgttcccacgcgccatcggcttcgcgccctacggggcctacttggcgcgcgctgcgccgcgtggcgtccacgcaccctctcttccccgcgcagggtcgcgcgttggccgcgcagcgcgccgtcatcgcgcgccagaatggtcggccccctgaaggaactgtcggcgcctcncccggcggggcggcccggncggcnttaaggtcccccccgttcctgggccgggtttccttaaaaggtaa

SEQ ID NO: 85050 - DNA, 944 bp, Zea mays
  misc_feature: Ceres CLONE 1571258
  misc_feature: Encodes the peptide sequence at SEQ ID NO. 85051
  misc_feature (630)..(630): n is a, c, t, g, unknown, or other
  misc_feature (766)..(766): n is a, c, t, g, unknown, or other
  misc_feature (768)..(768): n is a, c, t, g, unknown, or other
  misc_feature (778)..(778): n is a, c, t, g, unknown, or other
  misc_feature (822)..(822): n is a, c, t, g, unknown, or other
  misc_feature (846)..(846): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (889)..(889): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (906)..(906): n is a, c, t, g, unknown, or other
  misc_feature (909)..(909): n is a, c, t, g, unknown, or other
  misc_feature (912)..(912): n is a, c, t, g, unknown, or other
  misc_feature (921)..(921): n is a, c, t, g, unknown, or other
  misc_feature (922)..(922): n is a, c, t, g, unknown, or other
  misc_feature (927)..(927): n is a, c, t, g, unknown, or other
  misc_feature (942)..(942): n is a, c, t, g, unknown, or other
acccgcggtggcggccgctctagaactagtggatcccccgggctgcaggaattcgtctcacccctagaaaaaaaacaacgcctcctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcgggctaccgcgtcctgctcgtacctgggacccctccgagcccccccacaccaaggtgaaagcagctgcgtcttctcccctcctgctctcccgcaaaggacgacgtggatccccacccttccngctccaaactttctcctcgctccctcgccacccgtgggaagcggaagctggccaaagggggggcaaggcccaagttcaacaaggtcaacgaacgtcccccccttccaacctcatcggggaggccctacttcggggngncgccccccgnccaaccagccctcggcagggcgggcccaacaatcgcgcccaaanagctcacttggcacctcccccccngtgcaccccccgcccccccttgggcccggagagaccnnnnccnccccgctcccnnnnncnccnccnctcccaagnncaccnccgccgtccccaagntt

SEQ ID NO: 85051 - protein, 251 aa, Zea mays
  misc_feature: Ceres CLONE 1571258
  misc_feature: SWISSPROT Homolog: EC 4.2.1.92 Hydroperoxide dehydratase
  misc_feature (148)..(148): Xaa is any aa, unknown, or other
  misc_feature (194)..(194): Xaa is any aa, unknown, or other
  misc_feature (212)..(212): Xaa is any aa, unknown, or other
  misc_feature (220)..(220): Xaa is any aa, unknown, or other
  misc_feature (233)..(233): Xaa is any aa, unknown, or other
  misc_feature (238)..(238): Xaa is any aa, unknown, or other
  misc_feature (239)..(239): Xaa is any aa, unknown, or other
  misc_feature (240)..(240): Xaa is any aa, unknown, or other
  misc_feature (241)..(241): Xaa is any aa, unknown, or other
  misc_feature (242)..(242): Xaa is any aa, unknown, or other
  misc_feature (245)..(245): Xaa is any aa, unknown, or other
  misc_feature (247)..(247): Xaa is any aa, unknown, or other
MASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGLPRPARTWDPSEPPHTKVKAAASSPLLLSRKGRRGSPPFXLQTFSSLPRHPWEAEAGQRGGKAQVQQGQRTSPPSNLIGEALLRGXAPRPTSPRQGGPNNRAQXAHLAPPPXCTPRPPLGPERPXPPRSXXXXXSQXHXRRPQ

SEQ ID NO: 85052 - DNA, 751 bp, Zea mays
  misc_feature: Ceres CLONE 1571259
  misc_feature: Encodes the peptide sequence at SEQ ID NO. 85053
acccgcggtggcggccgctctagaactagtggatcccccgggctgcaggaattcgtctcacccctagaaaaaaaaaaaaaagcaccagcagttcctccaccaccagcccagccctcgccccgtccgttcgtccgcccgcgcccgctgctgcttgcctgcttcccacgcacgcgagctctgttccgtgctgcagcaaccgcaaccgcatccgcatccgaatccgcacacgatccccgcgccacttgccccgtcaccccccacgcggcccgcgcctccgcccgctcgtcggccaatgcccggcgcaggccagctcggcgagatgagatgacgccgccgcgcggcggtgcccggcctcccgtcgctcacgcgcgccagcaccagcaccacccggccccatcgggattcttcatcccgtcctccacctagcgcggtagcgccgcatttattccctccccagcacaacggtcacgtttccatcgccccgtcttctctccctcgtcgcatccggcgctcctcctcgtctcctatttaaagcgcgccgggctgggagccagcgatcatgctattctctaggaggcctctcgccgccgctttccacctcgcgcccctttcgcctccgctgctcctcttcttcgcatccgcgtcctcgtcctgctcgcccggcgcctccgccgccgccgcgtcggtcttcggctccagaagttgcactgctgcaaggatggacagcggtgcggtggagacagcgtccacg

SEQ ID NO: 85053 - protein, 64 aa, Zea mays
  misc_feature: Ceres CLONE 1571259
MLFSRRPLAAAFHLAPLSPPLLLFFASASSSCSPGASAAAASVFGSRSCTAARMDSGAVETAST

SEQ ID NO: 85054 - DNA, 826 bp, Zea mays
  misc_feature: Ceres CLONE 1571260
  misc_feature: Encodes the peptide sequence at SEQ ID NO. 85055
agctccccgcggtggcggccgctctagaactagtggatcccccgggctgcaggaattcgtctcacccctagaaaaaactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccctcggaaatccctcgaagggactggttcccctctgacttcatctttggtgccgccacttcagcgtaccaaattgaaggtgcatggaacgaagatggaaagggggaaagcaattgggatcacttctgccacaattttccggaaaggataatggacgggagcaatgcagacattggagcgaattcgtaccatatgtacaaaacggatgtcagattgctgaaggaaatgggcatggacgcatataggttctctatctcttggcctagaatactgcctaagggaacggtcgaaggaggtatcaaccaggatggcatcgattactacaaaaggctcatcaacttgttgctagagaatggcatagagccatatgtaacaattttccactgggatggtccctcagcactaagagagaagtacggcggattctttagatagactcataagaggattgttaatgaattacaaaactttcgctaaggtgtgcttcggacaactttggtgaacaggtga

SEQ ID NO: 85055 - protein, 201 aa, Zea mays
  misc_feature: Ceres CLONE 1571260
  misc_feature (63)..(202): Pfam Name: Glyco_hydro_1 Pfam Description: Glycosyl hydrolase family 1
  misc_feature: SWISSPROT Homolog: EC 3.2.1.21 Beta-glucosidase
MNHAAHPVLRSHLGPNNESFSRHHLSSSPQSSKRRFNLSFTPRSARVGNQNGVQLLSPSEIPRRDWFPSDFIFGAATSAYQIEGAWNEDGKGESNWDHFCHNFPERIMDGSNADIGANSYHMYKTDVRLLKEMGMDAYRFSISWPRILPKGTVEGGINQDGIDYYKRLINLLLENGIEPYVTIFHWDGPSALREKYGGFFR

SEQ ID NO: 85056 - DNA, 945 bp, Zea mays
  misc_feature: Ceres CLONE 1571262
ggagctccccgcggtggcggccgctctagaactagtggatcccccgggctgcaggaattcgtctcacccctagaaaaaggttcctccattgctcctcgcgtgcgctccctctcccgtctgcccctccctctctctcgtggagacgactgggccgggggccgccgtcgttgctgccctacgcggctacacccacgtcttcttcgggcccttagccgcgacgagcaccaccagggagtagaagaggttaaccttctggttggaaacgatgtacttcgaaggctatggcttccgtggaagtactttcgagcagacatatcgctgctatcctgcgtctttcatcgacaaggtttgtaaatcctaatcagatgagatgccatgttttctatttgaatatgttgtgttccatgtcatggcttcatgctgtgcccagcttcatggcacatatgactatatgtcttagttcgttatgaggtactataatcaactcttttattccatatgcacatctttcatcatatatctgcatatgaatcatgttgcataggttggattcaaatgcctattttcatttgattgtgaatgaggaacttctattttattatcaaaatgacttgcgaattgaacaagtaaaatgtttacattatcagtagctaagctgtagtgcgacttattggcatgtttatgttgactctggcccttctaaagatgtcaccaaattacttttaacctctaatggtatggtacaattgcatcctgcagcaaattctgtacatctaatgctagaatatcactacagccctgttccaaataatagtcagtatagcctttttcctaaatcaaaatctctagctgtaaagttgtaggaaaattgggatcacatctacacatcaaaaattctccatgaaatgcttgatatgcattcatttgagctgtaaatgttatgta

SEQ ID NO: 85057 - DNA, 2786 bp, Zea mays
  misc_feature: Ceres CLONE 1571264
  misc_feature: Encodes the peptide sequence at SEQ ID NO. 85058
agaatggaggcggtcgtcgtcgtggccgcggccgtcgccgtcgccgtccacccgctccgcgccccgccctcgcgtccccgcctccaatgccattaaccctacgcgcacggcggctagtgtttcgttccctcgtcctcctcccacccctggccgtgacgatgccgtcctggtggaagcgctccaagtccgcgttccaccgctcgcccgtcaccccgttctcctccgcatccacgccgtcctctcccgcgcgggcgtccacctcgtgcgtccagcccggaggccgcgccgggagaagggacctcctcgcgccgcccaagctcacccgccagcgaaagctgcgccacgtcgacgacctctacgtcgcgctcggggacctccgcgtcgacgtctccgacaggtcgtcctcctcctctccgccgcagcagaggcgcctcgccaccgcctccgaggccatcgagatcccggtccccaccctcgtctccaggtccgccagcgccagggagggcggcgcgccgccgcccaggtccgcgtcctcgcccgtcctccacccgctgccgctgccctcgcccaggccaccggatccgtccggggccggggccgccgatgggtggtgcgacaggacgacgcacgcgcccagggtgacaagccagattgcacaaaagtttcctgagcacaatgaattattaccaaatggaataaaacgggctacctttagtcaccacaggaatgcattccgtgagaagttccaggataagagttcggcagaaattattaactttcagttgaacattcctgctaaaagcgctccgagcagtggcttttcgagtcctgtgtgcagccctcgaagatttagcaatgctgacttctcatctactgtggcacctgctcaaggaccccttgcgtggtcctctccatctatccaatcgacagattttatgggagtttcatcctgtcctgaaaaatacacgggggttccagaccaaacttctttctctagcggattgagaagtcctattcttatgccaaggattaccagtgctcctccatcacctatgcactctaaattgtacccagataacaatatttcacgcattgaaggaaatgggagtgtcagctttcacccattaccgctcccccctggtgctttaagtccaatgcaaacaggttttaccactcaatctgctccaaaagttgaaatgccctcagtggctggtcagtggcaaaaaggaaaacttctaggtagcggcacatttggttgtgtgtatgaagctaccaataggcacactggagctctctgtgcaatgaaagaagttaacataattcctgatgatgctaaatctgctgagtccttgaagcaattagagcaggaagtaaagttcctaagccaatttaagcatgaaaacatagtgcagtattatggcagtgatattattgaagatcgtttttacatttacctggaatacgttcacccaggttcaattaataagtatgtcaaacaacattatggagcaatgacagaatcagttattcgcaacttcacccgccacattctaaggggtctagcatttttgcatggccaaaagattatgcatagggatatcaaaggagcaaatctgctagttgatgttcagggtgtagtcaaattggctgactttggaatggcaaagcatttaagtactgcagcccctaatctttcactgaagggaacgccatactggatggccccagagatggttcaagctacactaatgaaagatgtaggctatgatctcgctgttgacatatggagtcttggctgcaccatcatagagatgttcgatggaaagcctccttggagtgatcttgaagggccagctgcgatgtttaaggtgttacataaagacccaccaattcctgaaaatttgtccaatgagggcaaagaatttttacagtgctgtttcaagaggactcctgcagagaggccaaccgcaagcgagctgttggaccatccattcatccgcaattcaagtcactacaacaaacatggttccatacattcatttgcagggattaaagtcaatgatacaacttacagttcaagagacaactggccagcttcgaagagtgactcaaacatgaaaggaaaaaataccaatgttgaaccaagcagagctgctaggtcatccgaatcaactttccgattggctccactaacaatccaggaagctactcctaacttctcacctcggccttttgtgaacagcatgcagtttacaagcgtaaaccctcagcctagtccattgccaaggcctaacgggaaggaagttttgttctgaccgtggatgctgcatgccatgtagagtgtcatttctatcaggcgcagttcggcctcaatgtgccttgcagagtcctgcgcagttaaaggatgttgggttttataagatcatctgtgtgaccacgccacattgtgactgctcatggagcactgcacatgcagcttttgaccttaacttctaaccattttttagtaaggatacaaacatatgaattgtacagtttaccaggatttgcacgagagatccttgaaagcacaagcacggatgtaaattgtctccagaaattgttggtgtcatttttttggaagcatagaactaggactagctttatgtaaaactgaaagttcctttcagtcaacaggaattaggcgtagctctgtgttgcttttgctgctcaccaatgtaaaaatcattcttttgctgtatcactgattattcatttttttggcaaaaaaaaaaaaaaaaacgaga

SEQ ID NO: 85058 - protein, 742 aa, Zea mays
  misc_feature: Ceres CLONE 1571264
  misc_feature (378)..(637): Pfam Name: Pkinase Pfam Description: Protein kinase domain
  misc_feature: SWISSPROT Homolog: EC 2.7.11.25 Mitogen-activated protein kinase kinase kinase
MPLTLRARRLVFRSLVLLPPLAVTMPSWWKRSKSAFHRSPVTPFSSASTPSSPARASTSCVQPGGRAGRRDLLAPPKLTRQRKLRHVDDLYVALGDLRVDVSDRSSSSSPPQQRRLATASEAIEIPVPTLVSRSASAREGGAPPPRSASSPVLHPLPLPSPRPPDPSGAGAADGWCDRTTHAPRVTSQIAQKFPEHNELLPNGIKRATFSHHRNAFREKFQDKSSAEIINFQLNIPAKSAPSSGFSSPVCSPRRFSNADFSSTVAPAQGPLAWSSPSIQSTDFMGVSSCPEKYTGVPDQTSFSSGLRSPILMPRITSAPPSPMHSKLYPDNNISRIEGNGSVSFHPLPLPPGALSPMQTGFTTQSAPKVEMPSVAGQWQKGKLLGSGTFGCVYEATNRHTGALCAMKEVNIIPDDAKSAESLKQLEQEVKFLSQFKHENIVQYYGSDIIEDRFYIYLEYVHPGSINKYVKQHYGAMTESVIRNFTRHILRGLAFLHGQKIMHRDIKGANLLVDVQGVVKLADFGMAKHLSTAAPNLSLKGTPYWMAPEMVQATLMKDVGYDLAVDIWSLGCTIIEMFDGKPPWSDLEGPAAMFKVLHKDPPIPENLSNEGKEFLQCCFKRTPAERPTASELLDHPFIRNSSHYNKHGSIHSFAGIKVNDTTYSSRDNWPASKSDSNMKGKNTNVEPSRAARSSESTFRLAPLTIQEATPNFSPRPFVNSMQFTSVNPQPSPLPRPNGKEVLF

SEQ ID NO: 85059 - DNA, 833 bp, Zea mays
  misc_feature: Ceres CLONE 1571265
  misc_feature: Encodes the peptide sequence at SEQ ID NO. 85060
  misc_feature (705)..(705): n is a, c, t, g, unknown, or other
  misc_feature (729)..(729): n is a, c, t, g, unknown, or other
tggagctccccgcggtggcggccgctctagaactagtggatcccccgggctgcaggaattcgtctcacccctagaaaaagtcaatttaaccggcccggcccataatcccttgtaagagaggattttgctaggtttttgcccccaaccgcccaactgcgcgtgctcctgccgacctcccacccctccactccccggcggttggcggctgtctcgccgaagcgacccagccggcgcagccgatatggcgaagggcgacgacgcgctggcgcggaagcgcaaccgtgtgcgccgcaagcgcctccgtagcagcgagaacgctgtttccgcgcgtgtcgcggcgatcatcgcctccaagcaccgccgcaagtcggggaagcgccgcgcctgcgagggcatgtgcttctcgctccccacgcccgacgacccgttcaacgagcgccatggcaggaagcacaagctcgatgacgagccggccgacgacacagccgccgacgccgctgaggacagcggcaaccccaagaagaagggcgcgaacaccaaaaagcagcagccggtggcaaagtatggcgccgaggcgaagtcgaaggcggttcgcgagagggagacgggtgcggaggtggtccgcgggggacttcgaccggccgtccaagttcctggtggtctgtctcaacgctatccgggatgcggtggcgcccgaagaaggcngtggcagcatccacggcgccggcnaatggggcgtggagctcttgcggtgctgctccgccacagcgcccgtcgacgtgctcgacgctagcggcgcgtgcgccacggttggcccaaaccgccgtggctcc

SEQ ID NO: 85060 - protein, 183 aa, Zea mays
  misc_feature: Ceres CLONE 1571265
  misc_feature (155)..(155): Xaa is any aa, unknown, or other
  misc_feature (163)..(163): Xaa is any aa, unknown, or other
MAKGDDALARKRNRVRRKRLRSSENAVSARVAAIIASKHRRKSGKRRACEGMCFSLPTPDDPFNERHGRKHKLDDEPADDTAADAAEDSGNPKKKGANTKKQQPVAKYGAEAKSKAVRERETGAEVVRGGLRPAVQVPGGLSQRYPGCGGARRRXWQHPRRRXMGRGALAVLLRHSARRRARR

SEQ ID NO: 85061 - DNA, 925 bp, Zea mays
  misc_feature: Ceres CLONE 1571266
  misc_feature: Encodes the peptide sequence at SEQ ID NO. 85062
  misc_feature (685)..(685): n is a, c, t, g, unknown, or other
  misc_feature (688)..(688): n is a, c, t, g, unknown, or other
  misc_feature (813)..(813): n is a, c, t, g, unknown, or other
ctccccgcggtggcggccgctctagaactagtggatcccccgggctgcaggaattcgtctcacccctagaaaaaatagccaccattggtgtctcggactctcggctcggtggaacgcaacgcattgcgaccgacccgatccatcctcttcggcagccgcccactctctccacgactccatcgctagactagagagagaaacccttgtacccgtgttccttttcatcccccattttctccgagtttccggcccatcgccgagcatcgagtccaaggaagcggagccggcggagaaggggagatttgactttcccgtcgggtgcctagggagcaggagggatgcagcggcggcggggccacacgtgggcaggggtggggaagacggcccaggcggcggcggcgcacgccgcgctcttctgcttcactctcctcctcgcgctcagggtcgacggacgcaccgcatactcctggtggataatattcagtccactatggctctttcatggtattgttgcacgcggaaggttttcaatgcctgccccttctttgcctcatggccgtcattgggcaccatgtcattcgattgttgcggcgcctttactaattgcgttcgagctgcttctttgtatatatcttgaaagcataagagttagaaatcatccatctgttgatctgaagattgtgtnccntcccctgttggcctttgaagcaatatcctttatgacattttagaatgtgtagaggcttaatgcctggggatgaagaaacatgagtgatgaagctattgggaagacactcctcatttgtggggttncatattcatggtgtttctatagctgctacaacatcaccttctcaagctgtctggggagttggtgctttgggaaggtggggattgttttaaattttggggatgccaaaagcta

SEQ ID NO: 85062 - protein, 130 aa, Zea mays
  misc_feature: Ceres CLONE 1571266
  misc_feature (116)..(116): Xaa is any aa, unknown, or other
  misc_feature (117)..(117): Xaa is any aa, unknown, or other
MQRRRGHTWAGVGKTAQAAAAHAALFCFTLLLALRVDGRTAYSWWIIFSPLWLFHGIVARGRFSMPAPSLPHGRHWAPCHSIVAAPLLIAFELLLCIYLESIRVRNHPSVDLKIVXXPLLAFEAISFMTF

SEQ ID NO: 85063 - DNA, 841 bp, Zea mays
  misc_feature: Ceres CLONE 1571267
tcctcgcggtggcggccgctctagaactagtggatcccccgggctgcaggaattcgtctcacccctagaaaaaccttgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagcccgcggtaattccagctcccaatagcggtatattttaagtttgttgcagtttaaaaaggtcggtagttgggacctttgggggccggggccgggccgggttccgccctcacggggggaaaaacccgaaccggttttcgaaccccttttttggccgggggaaatggggcccccctgggggcccttaaaaatggggcccgggggttttgggccccccccggggggccccccttttttttttttgtggagaaaaaaatattttggggggggggcccccaaaaaagaagggacccccccccccccccctttgggggggatacaccccttttttccccgcgcggggggggaaaaaaaaacaatcctcccctcttggggggagtttttttcccggagtggggccccaaaataagattggggggagggggaggggcgccccctccccccctctgtagga

SEQ ID NO: 85064 - DNA, 942 bp, Zea mays
  misc_feature: Ceres CLONE 1571271
  misc_feature: Translation starting site: 182
  misc_feature: SWISSPROT Homolog: EC 1.4.1.2 Glutamate dehydrogenase
ctccccgcggtggcggccgctctagaactagtggatcccccgggctgcaggaattcgtctcacccctagaaaaaaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcattgtgctgcgtatcatcaatgaagcaaccgctgctgctattgcctatggtcttgacagaaggcaaccagcgtcggtgaagaggatgtcctcatctttggacttgggagtgggtacttcgatgtctccctcttactattgaggaaagatcttttgagtcagggcacagctggcgaccccaatctggggggggagactttgacacagaaggggcaaccctttgtcccggaattcaaagaaaaacagaag

SEQ ID NO: 85065 - DNA, 769 bp, Zea mays
  misc_feature: Ceres CLONE 1571272
  misc_feature: Encodes the peptide sequence at SEQ ID NO. 85066
ccccgcggtggcggccgctctagaactagtggatcccccgggctgcaggaattcgtctcacccctagaaaaagaccgcttcttcgcaaacctccccctctcccatcgacttcctccgtcgtccgtcgcactgccacggatcaccctcttccttcgtcttcctccacaaaacctacagcgctggtgcgccgaggagctagctagctagcccggccggccggccggcgccatgcctcccgtgaaggccgaggacctggttgtgcacgccgtcaaggagcagttcgccggcctcgactactgcatcaccagccccccgccatggatcacgacggtgctcgttggcttccagcactacctggtcatgctcggcaccaccgtcctcatcgccaccatcatcgtcccgctcatgggcggcggccatgccgagaaggcgatcgtgatccagaccatcctgttcctctccgggatcaacacgctgctgcaggtccacttcggcacgcggctccccgccgtgatgagcggctcctacacctacatctacccggccgtggccatcatcctgagcccgcgatacgcgctcctcatcgaccctctcgagagattcgtgttcacgatgaagtcgctccagggcgcgctcatcatcgccggcgtcttccaggccgtcgtcgggctctttcggaatatggagagtctttattaagttcctgaacccccttcggggggggtcccctttggtaaggctaacggggcctgggaaccttctttcttcg

SEQ ID NO: 85066 - protein, 156 aa, Zea mays
  misc_feature: Ceres CLONE 1571272
MPPVKAEDLVVHAVKEQFAGLDYCITSPPPWITTVLVGFQHYLVMLGTTVLIATIIVPLMGGGHAEKAIVIQTILFLSGINTLLQVHFGTRLPAVMSGSYTYIYPAVAIILSPRYALLIDPLERFVFTMKSLQGALIIAGVFQAVVGLFRNMESLY

SEQ ID NO: 85067 - DNA, 844 bp, Zea mays
  misc_feature: Ceres CLONE 1571274
  misc_feature: Encodes the peptide sequence at SEQ ID NO. 85068
ggagctccccgcggtggcggccgctctagaactagtggatcccccgggctgcaggaattcgtctcacccctagaaaaagttcggcccagcaccttcctcttccttcttccccagccgagcgcgcttctccacttccacggagacaaaaactcgatctcccgggccccacctccccgcccgcgcgccagcgacacggagaagcttccggtttccagccggcctgcctccaccgactcttcctttcccaccggccgtcgaggcgtccaggcggattagcggagagcgtcggggcggcgagatgtgggtgttctacctgatatcactgccgcttacgctgggcatggtcgtcgtcacgctccgctacttcgccggccccgccgtgccgcgttacgttgtcgtcaccgtcggatatgcttggttctgctccctctccatcatcatcctcgtccccgccgacatctggcagacattaactggcagtgcgaagggtggcattggattcttttggagctggtcttattggagcacatttatcctaacatgggctgtagttcctactatccagggctatgaggacgcaggagacttcactgtttaagaaaggctgaaaactagcattcatatggaactactttttttatcaattgtggggagccaatgggccttattggtctcaatactactccttaatcatgcctaaagcttgggaagggtggaatttggggggaatttgcaaatggcatggccccaaataaccttttggaatggggggaaccgggggcctttttcctcccttgggttttgggggtaaaaccaaaatatccccaaggaaacatttttggac

SEQ ID NO: 85068 - protein, 99 aa, Zea mays
  misc_feature: Ceres CLONE 1571274
MWVFYLISLPLTLGMVVVTLRYFAGPAVPRYVVVTVGYAWFCSLSIIILVPADIWQTLTGSAKGGIGFFWSWSYWSTFILTWAVVPTIQGYEDAGDFTV

SEQ ID NO: 85069 - DNA, 725 bp, Zea mays
  misc_feature: Ceres CLONE 1571277
  misc_feature: Encodes the peptide sequence at SEQ ID NO. 85070
  misc_feature (609)..(609): n is a, c, t, g, unknown, or other
  misc_feature (612)..(612): n is a, c, t, g, unknown, or other
  misc_feature (632)..(632): n is a, c, t, g, unknown, or other
  misc_feature (643)..(643): n is a, c, t, g, unknown, or other
ccccgcggtggcggccgctctagaatagtggatcccccgggctgcaggaattcgtctcacccctagaaaaaatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcggtgtccgcgtccgcgtcgtccacgctggcgggcgccttcttcgcggcgctggcgtcgtcgcccgacgctgcgctggcggacgtcgtggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgctggcctgggcctcggcgccgccgccgccgggatggcggccccgcccgaagcctccgcccgcgtggtgcaggacctcgnagnaaatcgcgccggcgcgcccngcgacgacagnccgcggcctcctcctgctcatcgtcgtcgcgcccgccatcggctggggtgctcttcaacatcctccagccggcgctgaaaca

SEQ ID NO: 85070 - protein, 182 aa, Zea mays
  misc_feature: Ceres CLONE 1571277
  misc_feature (80)..(114): Pfam Name: PsbY Pfam Description: Photosystem II protein Y (PsbY)
  misc_feature (146)..(146): Xaa is any aa, unknown, or other
  misc_feature (147)..(147): Xaa is any aa, unknown, or other
  misc_feature (154)..(154): Xaa is any aa, unknown, or other
  misc_feature (157)..(157): Xaa is any aa, unknown, or other
MATIATMALLKPAAKAAARSAPSTSSGSVSLRVRTGQAAKKAAVSASASSTLAGAFFAALASSPDAALADVVAAADAGGDSRGQLLLVVVAPAIGWVLYNILQPALNQLNRMRSSQAVAAGLGLGAAAAGMAAPPEASARVVQDLXXNRAGAPXDDXPRPPPAHRRRARHRLGCSSTSSSRR

SEQ ID NO: 85071 - DNA, 842 bp, Zea mays
  misc_feature: Ceres CLONE 1571279
  misc_feature: Encodes the peptide sequence at SEQ ID NO. 85072
  misc_feature (746)..(746): n is a, c, t, g, unknown, or other
  misc_feature (747)..(747): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
ggagctccccgcggtggcggccgctctagaactagtggatcccccgggctgcaggaattcgtctcacccctagaaaaaaaccgaggccacaggccaccaccattccttccttgttccttccccagctccgcaggctgctcatcgccctccctccgcgcccccgatccagatccagatccaggggcttgtcatggcatccaaacgtatcctcaaggaattaaaggacttgcaaaaggaccctccaacatcatgcagtgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcatatgtcttgacattcttaaggagcagtggagccctgctttgacaatctctaagtacgaggcgacagcccgcagctggacccagaagtacgccatgggatgaaatgttcggcgttactggctaaatgcagacgattgtggtgttgcccatgaaactgttatcggggacgtatgttcttctgttccttgtgcattctccgatccatctctaggatccgagttctagtccaacattaacctaccattgccttgggtaatgagatgacttgtgcttgctgtggtaactatgctagtgttgatgttaatgnnatctcattgagggcttgttcaannnnnnnnnnnnnnnnnnnnnnnnnnnnnnnnnnnnnnnnnnnnnnnnnnnnnnnnnnnnnnnnnnnnnnnna

SEQ ID NO: 85072 - protein, 116 aa, Zea mays
  misc_feature: Ceres CLONE 1571279
  misc_feature (5)..(110): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKYEATARSWTQKYAMG

SEQ ID NO: 85073 - DNA, 811 bp, Zea mays
  misc_feature: Ceres CLONE 1571281
  misc_feature: Encodes the peptide sequence at SEQ ID NO. 85074
cggccgctctagactagtggatcccccgggctgcaggaattcgtctcacccctagaaaaaaaacccttacacctcctcctcccttggccgcgcagtcgccattgacgaccccctctcactctcccctcccttaaatccctcctctccccgcgtccttctccccatcaacgcttcattcgctccagtctcatcgaatccaattcacagccagccagacagggcgggagatctccaagaagctatcttggaatccgagaacaccttgcattcgcggtcagtcaaggattcgaattctgacggacgagctctccggccaaaaaagtcagataattttcgggatagctcgggtggcgtctcggcaaccggaggagaccccggggggattaaggaaggtgcaagatggtgaggctgccttacacaacggcgctgaccacgctgttcagctacgggctgctcttcgccttcgggcagctcagggatttcttccggcaagttcgtcgactgggttaaagggcaagaacgtcaaggggctacgcgccgaatctggcctggggcctggagggatttctatggggcgacgactgggtccctgggggatccaggaattggctttggggagggcggaatcgcaagggggcccctgaattcaagggggtttgaagtgttgttgaaaccgcccccctccaacgggcggattgaaaaggacaattaacagcgggtgcccccgaaaagaaccccccagaaatggcgcctcaaaccctggtgggggtcgggaaaaaaagttaccctgtggggtttttggccaccacgg

SEQ ID NO: 85074 - protein, 36 aa, Zea mays
  misc_feature: Ceres CLONE 1571281
MVRLPYTTALTTLFSYGLLFAFGQLRDFFRQVRRLG

SEQ ID NO: 85075 - DNA, 943 bp, Zea mays
  misc_feature: Ceres CLONE 1571282
  misc_feature: Translation starting site: 188
  misc_feature (723)..(723): n is a, c, t, g, unknown, or other
ctccccgcggtggcggccgctctagaactagtggatcccccgggctgcaggaattcgtctcacccctagaaaaatgtctctctctctcgttctgctcacatcgacgcggttcggttccagtttcactcccactgccgtctcggcaacctcccctgttccacgcttcgtcctcgcctgccaggctgccatggccgcaacgtcccccttcgactgcgtcctcctagacctcgacgacaccctgtacccgggcgacaccggcatcggcgcggccctgaggcgcaacatcgacgagttcctccagaccaagctcggcgtgtcggccgacaaggccgccgccacgcgcgccgagctcttccgcgcgcacggaagctccctcgccgggctcatcacgctcggctacgacgtgcacccggacgagtaccacagctacgtgcacggcaggctaccgtacgacaggatcgcgcgcgacccgcagctggcgcagctgctgcagagcatcccgcagcgcaaagtgctgttcaccaactcggaccgcgcgcacatggagcgggcgctggagcggctgggcgtggactaagccgccttcgacgccgtcgtgtgcttcgagaccatgaacccgcacctgttcggcgacgacggtggcgaccggcgcccggccgtggtgctcaaaccagcggtggactcaatcgtcgccgggatgcgcgcctctggctccaaccacgncggacgctgttcgtggacgacagcgagatgaacatcgccgcggggaaagcgctcgagctccgcatcgccatgatacgtaacacaccatcctcagcgttctgctctgcatcactttgagacgacatgtggtagatggtgaatctcaagtgtggcacactgacacacacacgggcgatattatggaggggtactagacttgctaactacaggccagtgcccc

SEQ ID NO: 85076 - DNA, 862 bp, Zea mays
  misc_feature: Ceres CLONE 1571284
  misc_feature: Encodes the peptide sequence at SEQ ID NO. 85077
tacccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctctagctcaccgccgtcgacagccgccgcgccaccgtcgtcgtccccaacgaccccgaactcatagacatcctcgccaccaacggcgtcgacatcttcgtcttcgaaggccaagtcggtcggccccgggcgggtttcgtccccttttgtcgggaaacctccttcttccctttaaacggggttcgctgggcctctttctttcttttttccgccgccgcccaaggggggggccccggcgccgggggcctgggggggccttccgggggggcccactgggaatttcgggccgtcttcaaaaaggaaagtttctctcgggagggggccctt

SEQ ID NO: 85077 - protein, 131 aa, Zea mays
  misc_feature: Ceres CLONE 1571284
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLL

SEQ ID NO: 85078 - DNA, 864 bp, Zea mays
  misc_feature: Ceres CLONE 1571285
  misc_feature: Encodes the peptide sequence at SEQ ID NO. 85079
ggccgctctagaactagtggatcccccgggctgcaggaattcgtctcacccctagaaaaaaagttatcgttgtcttctctagcgacggcgaggcttgagcgctcacgtccaggcgttcccgtgccggtggccaagccagcagccgacgagatggactacctcaggacggtggttccgtcacaactcttggcagagcgcggctccaatcttgtcgtcatcaacccaggatcgggaaatgtgcgaatggggtttgctagtcaggatgtgccattcaatataccacattgcattgcccgacacatcaatccacaagagggcgaagaaccaagattctctgtgcgcgatcagatgctcaactgccatgctacttcatcgcagaatgcagagcgggagagtgcatatgatattattgcagcactgatgaaaatcccatttttggacgatgaagaaatgccttcaccgaaccaaccccttcctccaaagatgggacgtgttgatggcttctcttcgcagcaaaacagagacgataataaattcacttggacagatgtgtcagagagaatttattagccatccacaccattcgataggtcagtatacaaggatgctgaggaagatactctgcccagcaccatctgatgatgataatggacaggacttttaaagagataagtataaagaaatgatatttgaagaagatgctctgaaaatcccctcttcaaaatcatactggcctgaatcgcccaaattaggaaaaggccattttaaggggtccccaaaattaattcagggccttcggggttttaaaaagatttccccccttattttggaactgggaaactgaaacaaaaaatgtgtccttta

SEQ ID NO: 85079 - protein, 139 aa, Zea mays
  misc_feature: Ceres CLONE 1571285
MDYLRTVVPSQLLAERGSNLVVINPGSGNVRMGFASQDVPFNIPHCIARHINPQEGEEPRFSVRDQMLNCHATSSQNAERESAYDIIAALMKIPFLDDEEMPSPNQPLPPKMGRVDGFSSQQNRDDNKFTWTDVSERIY

SEQ ID NO: 85080 - DNA, 916 bp, Zea mays
  misc_feature: Ceres CLONE 1571286
  misc_feature: Encodes the peptide sequence at SEQ ID NO. 85081
  misc_feature (757)..(757): n is a, c, t, g, unknown, or other
ctccccgcggtggcggccgctctagaactagtggatcccccgggctgcaggaattcgtctcacccctagaaaaaagtcatgaacgtcaagcacattaattcgtcctctctccgctgcccctcctatctcctcgcgagcaccgctggcctcgcttaacggcctgatctcccagccgccgcttccgcctcgcgtcccaccggtctccatctacatgcagccgcgctcgccaccgccgtcggaggcgcctgcgccctccgacgccatcatgatgcccggcgtgggcggcgtggagccggccgtcacgttgggccaggtgccgcgctggagcgaccccgaccagcgcatcttcctcgcctccacgtccgaagaggcgtccgcggaggacgacggatccggcacgacctctgcgtctggcttcatctctttctccgacccgctcacggtcgacgacggcgccgtcgggggtggccacgccgggggtgcctcgcgcttccccgtcgaccaggagatcaactctaggatctatctctggcgtggccagccctggaacctcgaggtcgacgcggtcgtcaattctaccaacgagagcttggacgaggcgcacagtagcccggggttgcatgctgctgccgggtcagggctcgccgaggagtgcgccaccttgggaggttgccgaactgggatggccaagatgaccaatgcctacgatctgcctgcaaggaaggtcatccataccgtgggccccaaatatgctgtncagtatcacacagctgcagagaatgcacttagtcactgctatcggtcctgcttggaactgctcattgagaatggtctgaaagcatcgcaatgggttgtatatacacagaagctaaaactaccctcgtgaaacagctgctcatgtggcaataagaactgt

SEQ ID NO: 85081 - protein, 206 aa, Zea mays
  misc_feature: Ceres CLONE 1571286
  misc_feature: SWISSPROT Homolog: EC 2.4.2.30 NAD(+) ADP-ribosyltransferase
MMPGVGGVEPAVTLGQVPRWSDPDQRIFLASTSEEASAEDDGSGTTSASGFISFSDPLTVDDGAVGGGHAGGASRFPVDQEINSRIYLWRGQPWNLEVDAVVNSTNESLDEAHSSPGLHAAAGSGLAEECATLGGCRTGMAKMTNAYDLPARKVIHTVGPKYAVQYHTAAENALSHCYRSCLELLIENGLKASQWVVYTQKLKLPS

SEQ ID NO: 85082 - DNA, 835 bp, Zea mays
  misc_feature: Ceres CLONE 1571287
  misc_feature: Encodes the peptide sequence at SEQ ID NO. 85083
ctccccgcggtggcggccgctctagaactagtggatcccccgggctgctggaattcgtctcacccctagaaaaaactagctccactccaccacacacaccgcgcagctagctgtcaccggagcaagaaggaagaaaaaccagcggcaccgatcgatcgacgacacgcgcgcgatcgaggtgaggagcgaaagaaaaggtggccttttcgaagccgccggacggagtgtagcgctagctagctccccaggccggagaggaggatggtgggacgaggagcggcgacggccctcgtgtgggcggcggtggtggcggtcgcgacggtggtgtcgcgggcgcagcagctgcaggtggggttctacgacacgctgtgcccggcggcggagatcatcgtgcaggaggaggtgagcaaggcggcgtccggcaaccccggcgtcgccgcggggctcctgcgcctccactttcacgactgcttcgtcagggggtgcgacgcgtcggtgctgctggactctctcggcgggcaaccaggcggaaaaaggagcggggcccaaacgccaggcttgcgcgggtttcgagggcaccgaaaggccccaaaacccggctgggagcaggcctgcttttggggtccttttcctggggccaaatttctctccctttgccgccccccgaacccccttctcccttggtcggggggggaaccgcttcccaagtttcccgtcggggggcgaaagggaacggaaaactttctcccccgggcgccaaggagagggggggcgcgaaaacccggccccccctccccaaaggggtgagggacgcagcaccctctggtgtgcccag

SEQ ID NO: 85083 - protein, 181 aa, Zea mays
  misc_feature: Ceres CLONE 1571287
  misc_feature: SWISSPROT Homolog: EC 1.11.1.7 Peroxidase
MVGRGAATALVWAAVVAVATVVSRAQQLQVGFYDTLCPAAEIIVQEEVSKAASGNPGVAAGLLRLHFHDCFVRGCDASVLLDSLGGQPGGKRSGAQTPGLRGFRGHRKAPKPGWEQACFWGPFPGAKFLSLCRPPNPLLPWSGGEPLPKFPVGGRKGTENFLPRAPRRGGARKPGPPSPKG

SEQ ID NO: 85084 - DNA, 822 bp, Zea mays
  misc_feature: Ceres CLONE 1571288
  misc_feature: Encodes the peptide sequence at SEQ ID NO. 85085
  misc_feature (751)..(751): n is a, c, t, g, unknown, or other
  misc_feature (752)..(752): n is a, c, t, g, unknown, or other
ggagctccccgcggtggcggccgctctagaactagtggatcccccgggctgcaggaattcgtctcacccctagaaaaaatcttttttgttcgaacgcattatcccgttcgttcattgtgtactactggattctcacaccgcagcatccgttcacgtgtcttcaccccgagtgctgtctctctccttcctctctgctacggctgggtgaggcggggggctactgccgccgcctaacgccaggttccgaggccttcgtcggtctatttgccggcgatgaacatccaccagggatggttgcaacaatttgggcatagcgttggtatcagtggttcgaagatggttctccatatgacccacaatgtattcagttttcgatgctttgctgccaatgggcgtggcttcagtgcggattctaccaataagagaaaaattaaaagcaagaagaggcgaaaggatgttgcactggaatcaagtgaggtaatatctggaaatccaaggaacagggaccaatgggtgccagaattaagaactgaaagtgaaaacaaatctggtaaaaaagtcatggataagaaattttttggaaaaagtggaagcggttcgaaggtctgctcttgagaaaaagaaagctgaagagaacaaagattatcaagctattgattatgatgctccaattgagtcagataaaagtactattggcttgggtactagggttggaaattggtgttgcaggtgtttatatttggactagtcnntcgcttttggggatttctgccctaatggagtgttagccctagcaaaaaagtgcagtaagttaccaaaagt

SEQ ID NO: 85085 - protein, 113 aa, Zea mays
  misc_feature: Ceres CLONE 1571288
MNIHQGWLQQFGHSVGISGSKMVLHMTHNVFSFRCFAANGRGFSADSTNKRKIKSKKRRKDVALESSEVISGNPRNRDQWVPELRTESENKSGKKVMDKKFFGKSGSGSKVCS

SEQ ID NO: 85086 - DNA, 875 bp, Zea mays
  misc_feature: Ceres CLONE 1571290
  misc_feature: Encodes the peptide sequence at SEQ ID NO. 85087
tccccgcggtggcggccgctctagaactagtggatcccccgggctgcaggaattcgtctcacccctagaaaaagtgctagggtttcccccgtcttatcgcttcctcgttcccgcagccgccgcccaaaccctagcaaacccgtcctccgccatggccgacgaccactactcgtccaagcggaagtacgacgacccctcgccgccgccgcggcgcacggggttctcttctggcccgccgcctgcctcgccgcccgctggcggcgccccgtcgtacaacagcgttgcgccgccccccgatgagatccagctcgcgaagcagcgtgcgcaggagatcgcggcgcggatctttaacgccgcagaggccaagcgccctcgcgtcgacaacggcgacgatgacctcggcggcttcggtggaggaagttccctgggtggcagcggtggtggtggtggtggccgcatcgggggcgcaggacttggcttctcgtcctctgccggtggtgggcatggggcttctatcccaccgttatcttctcagagcagtgcaccacagtactcatatggtggacatcaggttacaagcaaaaagattgaaattccaaatggaagggttggtggttattatttgaaaaagctggggaaactattaagtatatccaacttcaatcaggagcgaagatttcaggttcggaaagaccatgaagctgaacctgggtgcactgacagggcaagttgagcctttctgggcaatcctgagcagataaccaaaagctgaaccgttgattcaaagaattttttgcagaaggctgaatgctggggtcatccgggggctggtatcttggggggcgggaaaataaaatggacccacagccagggga

SEQ ID NO: 85087 - protein, 193 aa, Zea mays
  misc_feature: Ceres CLONE 1571290
MADDHYSSKRKYDDPSPPPRRTGFSSGPPPASPPAGGAPSYNSVAPPPDEIQLAKQRAQEIAARIFNAAEAKRPRVDNGDDDLGGFGGGSSLGGSGGGGGGRIGGAGLGFSSSAGGGHGASIPPLSSQSSAPQYSYGGHQVTSKKIEIPNGRVGGYYLKKLGKLLSISNFNQERRFQVRKDHEAEPGCTDRAS

SEQ ID NO: 85088 - DNA, 953 bp, Zea mays
  misc_feature: Ceres CLONE 1571300
  misc_feature: Encodes the peptide sequence at SEQ ID NO. 85089
ccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccagggcgtgtacctggcctccatccccgtcatcgtgatggtgtgccgcgccgagctgggtagcctcagccgcgacgagctgtggcgcaaggtgtggggggaggccacctacgacctcgccaccgtgctcgacttcctcgccgtcctcgccttcaccatctccgtctacatcatgtgcaggcccaggcccatgtacctcatcgacttctgatgcttcaagtcggccgacgatctcaaagggtgcaagggggagttcgtcgacctggcgcgcaagtcctggaagttcgacgaggacggcctggctttcggatccggtctgctggcctaatcccggcttccgcgaatagtcttacatgccggactgtttgttccaacccaaggccagctgcgacatcaatgaagagggccgcgcccagggcgtcaacggccatgtatccggccactgaacatttggttaacaagtgcccgttcgggccaaagacgggggcgcgctgggggactattggaacccctttaactgagggcctcactgttcgcctggatggtaaagctttttgggagcgcggcaactcctgagttaaacctggggggcagagcccg

SEQ ID NO: 85089 - protein, 128 aa, Zea mays
  misc_feature: Ceres CLONE 1571300
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISQGVYLASIPVIVMVCRAELGSLSRDELWRKVWGEATYDLATVLDFLAVLAFTISVYIMCRPRPMYLIDF

SEQ ID NO: 85090 - DNA, 1118 bp, Zea mays
  misc_feature: Ceres CLONE 1571302
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (17)..(17): n is a, c, t, g, unknown, or other
  misc_feature (18)..(18): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
ttttttttnnntttttnntttgggttggttgtggggtgggtggtggtggcgtgggtgtggtgannnacacaatttttttaaagctggagctcacctcggtggcggccgctctagactagtggatcccccgggctgcaggaattcgtctcacccctagaaaatcctcgcctccccctcttcgtcagccccgcatctggcccggattagccgcctccggctccctcccggatcgccccaccaacagccagcctcgccaggtatgtctcgtgttccctcatctggacgcttctcccttctcggccggccgcctcgttggttgccatcagcggacgccgccgattcggctctccttgctgtgttcggcgtcgggtcgcgcgacagacgattctataatatggagtacatgcgtgccgcgcactgtttagtggttcctgcggtcgtccgtcgctgcgggaatgttcctttgttgctaacgaattcagtgattgtgggtcgcacggggtgatgccaatttcagtaaatcgcccggccaatcttttaatttgtccggggggagccccgtccgaaaaacccccgggttttggcggtttaaggaaatttaattgggaaatttccccaacaggcggcccctggggcaaatttttccgtgttccccattcccccccccatttctttgtggtccacgggggattccccctttggggggggaaaaaatttcccttaagggggccctccccaacattctcttggaaaatccctttcccctctgtttgcacatattttttgggggttgcccctcttttataccccatcccaccaatgttcccccagagagggggccgcccaaaagaagtgaatataaaaaattttctccgggttgtcatccgttaaaagtttgttccccatcacccacattttttcctctcatatactcctcttcttaaacagaaaatgtggataatatttttattgctccgcggcggggaaatatattttttatcttttgaaaataaggtttggtggggtcccggcgaccccacacagcaaaaaagaacatagggggggaaaaatcctcgcgggggtgtggtttggggaattgggaaatctgtaaacccccc

SEQ ID NO: 85091 - DNA, 965 bp, Zea mays
  misc_feature: Ceres CLONE 1571304
  misc_feature: Encodes the peptide sequence at SEQ ID NO. 85092
tcaccgcggtggcggccgctctagaactagtggatcccccgggctgcaggaattcgtctcacccctagaaaaacctagaaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccattctccctcgaggagaacgggactgtcgtgctcacgccgcatcagggccaagaagcctcctccaccttgctggccatcaactttcgatggactcccccaggttttgaaaccaggtgcaacgatatttgtgggccaatactggttcactgggtagcgagaactacttcggttttgttggagggtttctgaagttaaaggagatgaatgtggttttgtttcaatcaaaaaacaaagctacctgtggctgggtgcgctctttccgcctggattgtttccacgatttctttttgactttgccacacctgtgtttgtataagtattagagatgtgttaccaaaaactg

SEQ ID NO: 85092 - protein, 142 aa, Zea mays
  misc_feature: Ceres CLONE 1571304
  misc_feature (30)..(142): Pfam Name: PK Pfam Description: Pyruvate kinase, barrel domain
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPILPRGERDCRAHAASGPRSLLHLAGHQLSMDSPRF

SEQ ID NO: 85093 - DNA, 818 bp, Zea mays
  misc_feature: Ceres CLONE 1571306
  misc_feature: Encodes the peptide sequence at SEQ ID NO. 85094
  misc_feature (721)..(721): n is a, c, t, g, unknown, or other
  misc_feature (722)..(722): n is a, c, t, g, unknown, or other
ctccccgcggtggcggccgctctagaactagtggatcccccgggctgcaggaattcgtctcacccctagaaaaacttcccgttccccaattcgaaatcgagtcgggtactcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtcccccaattgaagaagtgatccagccagggagtcgggccccgaattcattggatttccttaccgcggagggaccttccccaaaccccctttttaaagggttcctgggggcccttcccccaaaatttggttctgggggccttcttaaaaaaaaacccctgggagggggggggggtaaaaaaaaaaaaaagggggggggnnccccccccccctctttttttggcccccccccccccccccccaaaaaaaaaaaattttttttcacaaaaaccctctttggttttttttttttttttt

SEQ ID NO: 85094 - protein, 204 aa, Zea mays
  misc_feature: Ceres CLONE 1571306
  misc_feature (4)..(96): Pfam Name: IBB Pfam Description: Importin beta binding domain
  misc_feature (173)..(173): Xaa is any aa, unknown, or other
MSLRPSEREQMRKGNYKQTVDAEESRRRREGQMVDIRKAKREESLQKKRRDGFPAAGAVPPMGHSTALQQKLDGLPAMVQAVHSNDPTVQLEATTQFRKLLSIERSPPIEEVIQPGSRAPNSLDFLTAEGPSPNPLFKGFLGALPPKFGSGGLLKKKPLGGGGGKKKKKGGGXPPPSFFGPPPPPPKKKKFFFTKTLFGFFFFF

SEQ ID NO: 85095 - DNA, 851 bp, Zea mays
  misc_feature: Ceres CLONE 1571310
  misc_feature (497)..(497): n is a, c, t, g, unknown, or other
ctggagctccccgcggtggcggccgctctagaactagtggatcccccgggctgcaggaattcgtctcacccctagaaaaaaagctagctagctctgccctctgctcggggctcctccttcccagtaacaactaacaagtctacacacaggggacaccacaagtacatcgccaccgacggaggaggaacaacaagaaccccgatgacaattgcagccgcggtgaccgcgcccacgtccgcgccagtgcacgtcgcgccgcgccacgccagccccgcggtccagccgcgcgccgcgccgcgcagggagccgtcgccgctcaaccccaacgcgccggcgcaggcgctccgctccccagccccggccggccggcggggtcttccgcggccacggacggcgccagggctcacatcgccaaccttgacaaggtgctcgggaagccgccgcaggtgccgagccccgcgagccacgccgccgccagcaggcaggcccagggccanggggcaagaacgcaagcaggaaccgcctcaacttccgggacggcctgctcaaagcggctaaaccttcccttctttttggccatgccccggaatgcggggcccggaagggcccccaaaaaaaaatttttcgcccgcccaccctttgtgcaattgaagaatttcccttccgccaaatcccccggggggctcccccgggggggaaaaattcgccccggggtggggcgaccccctaccaggaaaaggcgctctttgaaaggggcccctctcaaaccccggggaaacccaaaacccccccccggaagatctcccccgcattaggggagaatttttggggggggccggtaataaaaggcc

SEQ ID NO: 85096 - DNA, 894 bp, Zea mays
  misc_feature: Ceres CLONE 1571311
ctccccgcggtggcggccgctctagaactagtggatcccccgggctgcaggaattcgtctcacccctagaaaaaacgtgcccacgtcagatgcgaccgagatccagcttcaggaacggggataaaatatgagctcatttggcgtcatagtgtgcgcatctggtgccaaatgactgccaaatgatctgccgtcgcatcaatccttagctttgattcctcggcctaagcagctagcgcaacgcaaacgcagttccggcggtgggcggactgggaacacatgtcaatgatcatgagatcaatgctcggtcgtgctggcctgagggatcagcactcgttgatgttacatgtgctttcaggacgccaccggaaggccttccttgctggtgtgttccacaagactctcgagagtatctcgactacagtgagcagcacacacgacgactgcaccattacgtatcgttcgccacgacagcatatgtacgacaaggtcgcgacttcgacaacaaatgcctgtcggggggactgatggtgagaagcccaacaatctggttgggggagtctaaacggagagcatctgctggaggccagggttcaaacccgagtttcggggcaaaaaacccggtcaaaataaaaccccttggtttgggaaaaggtcaaaccaactcttataaacccgggggaggtcccccagggggacacccttttcccttttcccccgaaaaacaaaacacaccttttattgggcccaaaaaaggggaaaaaacctttattttggggggtgtgggggtttacaaacacgggattccatgggggggcctcctggggggggagaaaacctccgcctttaaaaacaaaacgcccccccaatttgggggtgaaaagggcccccggaacc

SEQ ID NO: 85097 - DNA, 1003 bp, Zea mays
  misc_feature: Ceres CLONE 1571316
  misc_feature: Encodes the peptide sequence at SEQ ID NO. 85098
  misc_feature (359)..(359): n is a, c, t, g, unknown, or other
  misc_feature (404)..(404): n is a, c, t, g, unknown, or other
ggagctccccgcggtggcggccgctctagaactagtggatcccccgggctgcaggaattcgtctcacccctagaaaaaacctcacctcacctcactcataccgagcgccagttgccagcacgaagagtaggagtagggatcgaagagtgagtgaaactgaaacacgaggaggagtcatggcgaccccggatgaccgcggcagctggttgctgtacctgtccctagccgccaaatgcgccggcgaccagccttaccgcctcgcgggcttcctggccgtctgcgccgtggccttcgtcgtgacctgcctcctgcactggtgcttcccgggaggcccggcgtgggggaggtggtggtggacncggcggctcggtgccggtggcggcgcgacggctgttccccccccngccctgccgggggccgaggggcctgcccgtggttcgggagcatgtgggttcatgacggggcctggggcaccgcaaggctcgccggcggcgggcgggagaagcctccggcggccagggcgcctggaatggcctttttctccttcgggggccaccaagggtggggttggggggccctccccacccccggaacttggcggccccgaaaaattccttcaagcaaacccccggggttttttgcgggacacgggcccccataacaagggaaatcccgcgcgtaaaggggggtctcctgggttttccccccggggcccaattggggtttttcgcccccccaaagggggcgcccataatgtgggggcggccctttgcccccccgggggggggtcacaaaaacaccttcttttctcccccccgggggggggggcccccccgtttgggcccccgaaaagggcccccttatttttggcgccaaaaaaggtgcgggccccccctagaaaaaaattttttgtggggcttctccccggggggggggcgcccgcgcgggactaaagaggacccgcctctttttgggcgcgggtctctcccaccaaatttgttgg

SEQ ID NO: 85098 - protein, 258 aa, Zea mays
  misc_feature: Ceres CLONE 1571316
MATPDDRGSWLLYLSLAAKCAGDQPYRLAGFLAVCAVAFVVTCLLHWCFPGGPAWGRWWWTRRLGAGGGATAVPPPALPGAEGPARGSGACGFMTGPGAPQGSPAAGGRSLRRPGRLEWPFSPSGATKGGVGGPSPPPELGGPEKFLQANPRGFLRDTGPHNKGNPARKGGSPGFSPRGPIGVFRPPKGGAHNVGAALCPPGGGSQKHLLFSPPGGGAPPFGPPKRAPLFLAPKKVRAPPRKKFFVGLLPGGGAPARD

SEQ ID NO: 85099 - DNA, 765 bp, Zea mays
  misc_feature: Ceres CLONE 1571321
  misc_feature (533)..(533): n is a, c, t, g, unknown, or other
ctggagctcaccgcggtggcggccgctctagaactagtggatcccccgggctgcaggaattcgtctcacccctagaaaaagttccccgcggcctgcgcgcgcgttctctccctcacctccgcccctctctctctctctctctctctctctctctctctcgctccgggcgacggctgggcgaccgccgctttatccgtgcggcccttccttttgttctcccgtccccccaaccccccttcgagctctatctgtctcttcctctcgaggcgacgcctgggctaccgcgccgctactgcggcctcccgcgacaggtgcctagtctccatcaggtgccatgtcttcttcgggctcttcaccgtcgacgtgcactgccagctctgcatgtatacacccaagtcctttactgggtccgccgccgcccctatgtacttcgttaggtttagtatgttgttaagtttgtaattctagggtctggagggaagcatagatctcaagaggggtgaaatttggtgggtatttcctgagaatttcanggagacaagggcgtggaggttgtttctgggagggatctgtgagcacagcagcagaaaatttgaggttggtgggtagcctgttgatccacgatggtggggtaaaggaactgggtgggtgcaaagggaatgggccttgtttgacataccgtgagtttgcctgcaaaaggccacgccttccggggaggtggcgggcaaaccggggcaccaccctaccgtcgaaaacttacggggg

SEQ ID NO: 85100 - DNA, 924 bp, Zea mays
  misc_feature: Ceres CLONE 1571322
  misc_feature (223)..(223): n is a, c, t, g, unknown, or other
  misc_feature (224)..(224): n is a, c, t, g, unknown, or other
  misc_feature (235)..(235): n is a, c, t, g, unknown, or other
  misc_feature (237)..(237): n is a, c, t, g, unknown, or other
  misc_feature (238)..(238): n is a, c, t, g, unknown, or other
  misc_feature (799)..(799): n is a, c, t, g, unknown, or other
gccgctctagaactagtggatcccccgggctgcaggaattcgtctcacccctagaaaaaatcccacgctgccctcggcgctgcgcctggacccggcacctacctcccccctccccaccttgccgccggcgggtggagtcgggctggagcagccgctctcctctgttacccccctaaccccctataaagaaaaagaaaaaaaaacagaagagagagaagcgagnncgaccggcggncnntcggcagccattggggggcaacgggcgtccagctggcgcccccgcacccgggcgaacgaagccaccgaaattactttttcccgcgcggggggacaagggttcggggggaaacccttccaagggccccctggggaaaacccgtcttctccttttaaaaagggccgaaaaaccctccctttttttttttttggcccccgggcgcggggggggcaaccaaaggttttttttaaagaaaaaaagagggggcctttttttttttccgggggggggtttttttcaaaaaaaatatttctcccccccctccccccccccccaaaaaaaaaagggggggccgcccccccctccctctcctacaaaaaagaggggaggaggatttcttctttaaaaaacacaaaaaagagggggggcccccttctttgtgtgagaaagaaaaacacacaccccccggcgggggggtggggtgtagcgccccccccaccccccaccccgggacaaaaagaaaaaacgatcagtctattggggaaggacaaaaaaaaactattcctccgcggctccccactntctatgaacgctctttgggcttatcggaattagtttccttggcgcccgcgccccccgcggctcgtggatgtcagaagaaagaggccgccctccccacccgccccgcggaggcgggcggggtaaga

SEQ ID NO: 85101 - DNA, 944 bp, Zea mays
  misc_feature: Ceres CLONE 1571323
  misc_feature: Encodes the peptide sequence at SEQ ID NO. 85102
ccccgcggtggcggccgctctagaactagtggatcccccgggctgcaggaattcgtctcacccctagaaaatacgacacaatttgcttccaacatacctcgaattgggagcatcaaaactgctgcagatttaaatggtcgaaaaatggtgtttgttggaatgtcactcatggaataccttgaagctgctttcaaggatggaaaggcaccactggatccatcaactcttggtcaaggtagaggacatggatgcatatgcgcctaaagatcttctggtggtcactacaggttcactagtcattcctggaaatgagacacgggtaatgaagatgatgaatcgtctcactgatcttggcccaaaaattatcatgggtgaagattctggaatggatacctcccccacccccctacagagaggagctggagcaagttccttccgattggtaaaaccacaacaatttcttgccctgttcatggaagaaatcccgtatttctcaaaagaacatgaaattcctttggaaaaatcaactttgtattaaggcaacccaactggtaattaaaaaagggaaaaaaatactttggtgggtgccaccattctaaaaagaaaataaaaaggttctggggccaaaatgggggctcggctttcattaagggagaaaagaagggattctttccccccccagtttataaaatgaaagtgtgaaaaaagggtttttttgaaacgtccccctggatactccacgggtttttttaaaaaaccaacaaaaatttcgacttggagtgcgcctttttttttataagaaatcgagaaatttttcccaccccctaaaaagaaaaaaattttttattgcaaatcacgggtttggaaaggggaaaatttaaaattctcccaccatgtttttgggggtttatatattgaaaaattatgggacaccctctccgagg

SEQ ID NO: 85102 - protein, 87 aa, Zea mays
  misc_feature: Ceres CLONE 1571323
PRGGGRSRTSGSPGLQEFVSPLENTTQFASNIPRIGSIKTAADLNGRKMVFVGMSLMEYLEAAFKDGKAPLDPSTLGQGRGHGCICA

SEQ ID NO: 85103 - DNA, 804 bp, Zea mays
  misc_feature: Ceres CLONE 1571324
  misc_feature: Translation starting site: 227
  misc_feature: SWISSPROT Homolog: EC 1.8.1.9 Thioredoxin-disulfide reductase
  misc_feature (422)..(422): n is a, c, t, g, unknown, or other
  misc_feature (464)..(464): n is a, c, t, g, unknown, or other
agctccccgcggtggcggccgctctagaactagtggatcccccgggctgcaggaattcgtctcacccctagaaaaaatcagatccctcccgcagtctcgcgcgctctcccccacccacccaccccctatccatccatccatcccacctcctgctccacatcctcccctccgcccaccaacgcagcagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccacctgctgcaacagccgcgcgccgatgtctctgcaggccgccgccgccgcacctgccgccggcgcggtcgacgaggagactcctngctccctcccctcgtcagatgctagcaagggggtgggagaanctggtgatcatcggctctgggaccagcgggtacaccgctgccatctacgccgcccgggcgaaacctgaagctgtcgtgtttgaaaggtgcagaatggggggtgtcccccggcgggcagctgatgaccaccaccgagggtgaaaaattccctgggttcccgggagggaattaccgggcctgattccctggaaagaaggcgcaaagcaacggaaaacctggggccaaaaatttacccaaaagaaggtgaagttttggaaaggaaaaaaaaaccccccttttggttttcttaacccgacccgggggggggaaaaggcccaaacccaaatttttgggagggggg

SEQ ID NO: 85104 - DNA, 948 bp, Zea mays
  misc_feature: Ceres CLONE 1571325
  misc_feature: Encodes the peptide sequence at SEQ ID NO. 85105
ctcctcggtggcggccgctctagaactagtggatcccccgggctgcaggaattcgtctcacccctagaaaaaacagcaaaggcggcactgctcaaaccacctctttggccacacacacgcatactgccaccgctactgcttcatcagcagctagcagcaagcggccggtggtgcagcgctgcgcctgcgccgggtaatcgaacacatggctcagatgatctcaaccatgcccatgctagacgccgccccggcctcgtcagccattatgcccaagctgccgcccgccgcctgcctggacgcgccgccggcctcgggcatcaccgtcgtgtcgaggcagcacgttcgcccggacgccgcgtcggcggtcggcgacctcacgctgtccgtctccgacctgcccatgctgtcgtgccactacatccagaaggggctcttcttcccggcacccgacctgcccatgtcctcggtcgtgtcgctgctcctgtcctcgctgtcgcgggcgctcgccgtcgtcccggccctcgccggccgcttcgtcacgctgcccgacgaccgcatcgtcatccgctgcaacgacgcgggcgtggacttcctccacgccgtcgcacccggcctgtcgcttgacgactttctcgtctccgacgccgacgtgccgaccaagcacacaaaggaactgttccccatggaccggaccgtgagctacgatggggaccgtcgcccgctcacgtcgttccaggtcaccgcactcggagacaggaccgtctttatcggcttcgtccgccaacaacggcgtcgtggaacagcacctcctttttggcaattcttcatacctggggcgggcattctgccccgggggattccccctaactgtccggaattccccccgaaactccttcggggaaatccaatgtccggtcttccgctttccccggaggggttttgggcccc

SEQ ID NO: 85105 - protein, 247 aa, Zea mays
  misc_feature: Ceres CLONE 1571325
MAQMISTMPMLDAAPASSAIMPKLPPAACLDAPPASGITVVSRQHVRPDAASAVGDLTLSVSDLPMLSCHYIQKGLFFPAPDLPMSSVVSLLLSSLSRALAVVPALAGRFVTLPDDRIVIRCNDAGVDFLHAVAPGLSLDDFLVSDADVPTKHTKELFPMDRTVSYDGDRRPLTSFQVTALGDRTVFIGFVRQQRRRGTAPPFWQFFIPGAGILPRGIPPNCPEFPPKLLRGNPMSGLPLSPEGFWA

SEQ ID NO: 85106 - DNA, 889 bp, Zea mays
  misc_feature: Ceres CLONE 1571326
  misc_feature: Encodes the peptide sequence at SEQ ID NO. 85107
atagctggagctccccgcggtggcggccgctctagaactagtggatcccccgggctgcaggaattcgtctcacccctagaaaaaatgccagccacacctgttcgaccacctgacccgcgcgcgccctgatggctcccgcgctcacctccaacccgccctccttccgtcccctaacgtccccactccgccgtcgtgccgccaccgtcccatgccgcgtcggtaagcccggcaaggactcctccgctgcggatgacgctaccggccccaacaagaggcccaacctcttcgcggacttcgggaatgccaagtcgctcatacaggcgttcccgtcgcagtcgctgttcgcgggcggtggcaggggcaggaaggacccgcagacggtgttcgtcgcaggcgccacagggcaggccggggtccgcatcgcgcagaccctgctgcggcaagggtttgccgtgcgcgcttggcgtcccggaccctagcgtccgcgcaaggagcctagcgcgggctgggcggcgggcataccgggctcatcttccccccgccggaaaaccccgagcggcctaaaccgcagggtagaaggcggggcctttcgggtggacccccggaccgccgatatagcccaaattcctttccggccccccgcccgccgaaaagggggggtggggccaaccatatcggggttccgggcccgacaaaatggggcccaataaagggcgggaaggcgtgtccaccgacccgaaaaaaggcccctccccaaaaagggggtcgagggcccccaaaaattcctccgccacgcctggggggcgcacccctgcagtttcgtccctgggattgagaccaaagaggggcacggccacaaccggaagaccacttgagacagacaaggggg

SEQ ID NO: 85107 - protein, 116 aa, Zea mays
  misc_feature: Ceres CLONE 1571326
MAPALTSNPPSFRPLTSPLRRRAATVPCRVGKPGKDSSAADDATGPNKRPNLFADFGNAKSLIQAFPSQSLFAGGGRGRKDPQTVFVAGATGQAGVRIAQTLLRQGFAVRAWRPGP

SEQ ID NO: 85108 - DNA, 817 bp, Zea mays
  misc_feature: Ceres CLONE 1571327
  misc_feature: Encodes the peptide sequence at SEQ ID NO. 85109
  misc_feature (695)..(695): n is a, c, t, g, unknown, or other
ctccccgcggtggcggccgctctagaactagtggatcccccgggctgcaggaattcgtctcacccctagaaaaaaaggctgctgccgccgcctgctgctaggggatcgcttgctttcctcggaccactctgccgaccacatctacaccgcatcaacggtccttccaagtgagctccaatcccctgtctgtagatggagagggtgctcaaggatgacgccgtcgaggagaagggcgagcgcgccaggatggcatcgtttgttggggccatggcaatctcggatttggtgaagaccacattgggcccaaaaggaatggacaagatcctgcaatcaactggcagaggacgtaatgttactgttacaaatgatggggctaccattttgaagtcacttcacattgacaatcctgctgcaaaggtccttgttgacatctcaaaagttcaagatgatgaagttggtgatgggacaacttctgttgttgttctagctggagaacttttgaaggaggctgagaagttaattaacatgaaaattcatccaatgactattattgcaggttacagaatggctctcgagtgtgccagagattctttgctaaaaaagacctggacaacaaagaaatacagataaattcagatctgatctcatgaatattgctatgactactcttagttcaaaaatactttcccaagacnaggagtacttcgctgaaactgccgttgatgctgtcttgaggcttaaaggtagcaccaactggaatctattcaattctgaagaaaccttggagatctccttaggattctttttggaccaaggg

SEQ ID NO: 85109 - protein, 145 aa, Zea mays
  misc_feature: Ceres CLONE 1571327
MERVLKDDAVEEKGERARMASFVGAMAISDLVKTTLGPKGMDKILQSTGRGRNVTVTNDGATILKSLHIDNPAAKVLVDISKVQDDEVGDGTTSVVVLAGELLKEAEKLINMKIHPMTIIAGYRMALECARDSLLKKTWTTKKYR

SEQ ID NO: 85110 - DNA, 802 bp, Zea mays
  misc_feature: Ceres CLONE 1571329
  misc_feature: Encodes the peptide sequence at SEQ ID NO. 85111
ctccccgcggtggcggccgctctagaactagtggatcccccgggctgcaggaattcgtctcacccctagaaaaaccctagaaaaagagagaaaaaaaactgcggagaggtagcggtggatcgaaaccctaggcgcggtcggcggcgatggcggcggcggcagcagcggcagctgcagcgcctgagtcgtacatcgggagcttgataagcctcatgtcgaagagcgaggtccggtacgagggcgtcctgtacaccatcaacaccgaggagtccagcatcgggctaaaaaacgttcgctcatttggaactgaaggtcgtaagaaggatggccaacagattcctgccagcgacaagatatatgagtacatactctttcgaggaagtgatataaaggatttgcaagtcaaatcatctccaccatctcagtcggcaactttacacaatgatcctgctattattcagtcacattatcctcatccagcttcgctttctacaagtttgccttctgctgcaagcacaataggagccaaccctacttcacagaatgctccatctttgattcagatgccaccgccatttcaagggaatttgcccccttaccagtctggcaccagcttacagtcatggaactcagcacctatgccatcatctgcaaatggcactgggccttacaatgcccacaatgtactgggcaggattatacacacccccaacggggttttctcatctgcaagcaacactcttcccttagccaccccccagtttggcttgttccacaggtcctgcaggctccggtaaaaatc

SEQ ID NO: 85111 - protein, 216 aa, Zea mays
  misc_feature: Ceres CLONE 1571329
MAAAAAAAAAAPESYIGSLISLMSKSEVRYEGVLYTINTEESSIGLKNVRSFGTEGRKKDGQQIPASDKIYEYILFRGSDIKDLQVKSSPPSQSATLHNDPAIIQSHYPHPASLSTSLPSAASTIGANPTSQNAPSLIQMPPPFQGNLPPYQSGTSLQSWNSAPMPSSANGTGPYNAHNVLGRIIHTPNGVFSSASNTLPLATPQFGLFHRSCRLR

SEQ ID NO: 85112 - DNA, 927 bp, Zea mays
  misc_feature: Ceres CLONE 1571335
  misc_feature: Encodes the peptide sequence at SEQ ID NO. 85113
  misc_feature (759)..(759): n is a, c, t, g, unknown, or other
  misc_feature (797)..(797): n is a, c, t, g, unknown, or other
  misc_feature (825)..(825): n is a, c, t, g, unknown, or other
ggagctccccgcggtggcggccgctctagaactagtggatcccccgggctgcaggaattcgtctcacccctagaaaaaagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgacccccgagccttcgccgagctcaaggtgaagagctncagacggccgcctcgccatgttttccatgtcggcttcnttcgtcaggccatcgtcacgggcagggnccgctcgagaactcgctgacacatcgctgaccagtcaacaacacggatgggctacgccaccacttcgtcccgggaacttagctcacggctatgctagcactt

SEQ ID NO: 85113 - protein, 238 aa, Zea mays
  misc_feature: Ceres CLONE 1571335
  misc_feature (61)..(228): Pfam Name: Chloroa_b-bind Pfam Description: Chlorophyll A-B binding protein
  misc_feature (211)..(211): Xaa is any aa, unknown, or other
  misc_feature (224)..(224): Xaa is any aa, unknown, or other
  misc_feature (233)..(233): Xaa is any aa, unknown, or other
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLGLADDPRAFAELKVKSXRRPPRHVFHVGFXRQAIVTGRXRSRTR

SEQ ID NO: 85114 - DNA, 846 bp, Zea mays
  misc_feature: Ceres CLONE 1571341
  misc_feature: Translation starting site: 223
ctccccgcggtggcggccgctctagaactagtggatcccccgggctgcaggaattcgtctcacccctagaaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccgccgctggtgtgccgccgatgggccactccaccgcgctccagcagaagctcgatggcttgccggcgatggtgcaggccgtccactccaacgacccctccgtgcagcttgaggccaccacacagttcaggaagctgctttctatagaacgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtggtgggttgagagtggtgctgtgcccatctttgtcaagctactcaactccctcagcgaggatgctcgtgaaacagctgtattggctttaaggaaaggtgctggtgactcccccaagggtccggatcgggacctggggcaggggggggcaaacccctttgg

SEQ ID NO: 85115 - DNA, 850 bp, Zea mays
  misc_feature: Ceres CLONE 1571342
  misc_feature: Encodes the peptide sequence at SEQ ID NO. 85116
  misc_feature (776)..(776): n is a, c, t, g, unknown, or other
  misc_feature (828)..(828): n is a, c, t, g, unknown, or other
ctccccgcggtggcggccgctctagaactagtggatcccccgggctgcaggaattcgtctcacccctagaaaaaaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaagccgtgctccgcacctacgaacacgtcttctcctccccgccgcgctccctggtgtccgacatcatcatgtacggcgccaccgactcgtgcttcgggctctaggccctacggcgaaccactttccgcaagggcgcggaaagctgggtcaccgnggcaccttgcttcaaggccaagcaaaggtgcgggtcgcaagccgcccccccncgggaagaagagagtcttccca

SEQ ID NO: 85116 - protein, 160 aa, Zea mays
  misc_feature: Ceres CLONE 1571342
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYEHVFSSPPRSLVSDIIMYGATDSCFGL

SEQ ID NO: 85117 - DNA, 690 bp, Zea mays
  misc_feature: Ceres CLONE 1571349
  misc_feature: Encodes the peptide sequence at SEQ ID NO. 85118
  misc_feature (44)..(44): n is a, c, t, g, unknown, or other
  misc_feature (307)..(307): n is a, c, t, g, unknown, or other
agctccccgcggtggcggccgctctagaactagtggatcccccngggctgcaggaattcgtctcacccctagaaaaaaaaccctccctccctcctccattggactgcttactccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctngtttgatagtgacaaggggagaagtatgcacccctttttgaaagaaattccttcgtgctgctcagggaagcattggtgccccccccccttgggttgcccttgctttaaggccagggctggggtctgggataacattcggggaaatttaaataaactgccttggaaaagacccaaggttttccaaaaccctgggactcaaagaaaaaccgggggggggggaaaattcccacaagaaaattttttgggcttggaaactttttatttttttaacccccctttaaaagggcccccccttttttttcccggggcgttttttttgggggggggaaaaatccccctcccccaaaaaaaagggggggggggggggttttattcttccttat

SEQ ID NO: 85118 - protein, 54 aa, Zea mays
  misc_feature: Ceres CLONE 1571349
  misc_feature: SWISSPROT Homolog: EC 2.4.1.13 Sucrose synthase
MAAKLTRLHSLRERLGATFSSHPNELIALFSRYVHQGKGMLQRHQLLAEFDALV

SEQ ID NO: 85119 - DNA, 836 bp, Zea mays
  misc_feature: Ceres CLONE 1571352
  misc_feature (593)..(593): n is a, c, t, g, unknown, or other
  misc_feature (594)..(594): n is a, c, t, g, unknown, or other
ccgcggtggcggccgctctagaactagtggatcccccgggctgcaggaattcgtctcacccctagaaaaacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggggctgggtaaatcattattgaaagcatctcccttttacatgtaaccttgcatacaatatctggttaagatgagttcacctaaaataagttgttttcaaataagggaagatgcatggtccagtccctagcctagtaaaaggcccctttctttaaatccccaatggcagccggaaaatttgtacccgcccctttttttttaaaacccacttttttttgggaaaaaagggggcacacccccctcccnnttaaaaatgggggagaaatttttttggggggggggttctccctggaaaaaaaaaaaatcctttttttgttggggggggggggcggtgcccccccccccccggcgcggtttttttaccccccccccagagaagaggaggggggggggccccccccccccctttgttgtttgtgggaaaaaaaacacacccccccgccccgcgcggggaggaaaatatatatattttttttctcccacaccctc

SEQ ID NO: 85120 - DNA, 812 bp, Zea mays
  misc_feature: Ceres CLONE 1571353
  misc_feature: Encodes the peptide sequence at SEQ ID NO. 85121
  misc_feature (622)..(622): n is a, c, t, g, unknown, or other
ctccccgcggtggcggccgctctagaactagtggatcccccgggctgcaggaattcgtctcacccctagaaaaagcatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgataactccgtcgtcgctctgcaccctgacaccatggagaggctgcagctcttccgcggcgacaccgtgctcctcaagggtaagaagaggaaagacactatttgcattgtccttgcggacgaaacctgtgaggagccaaaggttcggatgaacaaggttgtccgccagaaccctagggtgagggctggtgatgtggtttctgtccacagtgcccagatgtgaatatgggaagcgtgtccacattcttcaattgatgatacagttgaaggcattacagggaacctgtttgatgccttcttgaaaccatatttccctagaagcatacaanccgttgaaggaaaggaaaaccttttccttgtccaaaggagaaatgaaaagggggggaatccaaagggaatagaaaccgatcctggcagaaatttgtatccgtgcccccaaaacccgaaaaattttgtgggaggggggaccctttttaaagggggggaataagaagcccctttaaaaaaatgggtttataa

SEQ ID NO: 85121 - protein, 115 aa, Zea mays
  misc_feature: Ceres CLONE 1571353
  misc_feature (30)..(115): Pfam Name: CDC48_N Pfam Description: Cell division protein 48 (CDC48), N-terminal domain
MASQGEPSASASDPKEKKDFSTAILERKKSPNRLVVDEATNDDNSVVALHPDTMERLQLFRGDTVLLKGKKRKDTICIVLADETCEEPKVRMNKVVRQNPRVRAGDVVSVHSAQM

SEQ ID NO: 85122 - DNA, 940 bp, Zea mays
  misc_feature: Ceres CLONE 1571356
  misc_feature: Translation starting site: 359
  misc_feature: SWISSPROT Homolog: EC 5.4.99.8 Cycloartenol synthase
  misc_feature: SWISSPROT Homolog: EC 5.4.99.7 Lanosterol synthase
  misc_feature (483)..(483): n is a, c, t, g, unknown, or other
  misc_feature (607)..(607): n is a, c, t, g, unknown, or other
  misc_feature (685)..(685): n is a, c, t, g, unknown, or other
  misc_feature (699)..(699): n is a, c, t, g, unknown, or other
ggcggccgctctagaactagtggatcccccgggctgcaggaattcgtctcacccctagaaaaatttttttcttgcattcactgtgagtaccaatttagatgcctcatgaaataggaactagcaaattgtagcaggaatctgatttttagattacatggaagacttatgtttcatgtttcctggtttacaaaacagctactaattgtgtgtaccctttgtccagatcataacattgtatgtgactggagcactaaacactgtcttgtcattggaacaccagaaggagatccgccggtatctttataatcaccagaatgaagatggcggctggggcttgcacattgagggtccaagcaccatgttcggctcagcactgacctatgttattttgagattgcttggagagggaccagatagtggagatggagccatggagaaaggtcgaaactggatattagaccatggtggagcaacatatataancatcatgggggaagttttggctttcggtactaggtgtatttgaatggtctggtaacaacccggtgccaccagaagtatggctactgccatatctcctcccatttcacccagggaggatgtggtngtcattgtcgaatggtgtatttgccaatgtgctacatttatggggaaagaggtttgttggcccgaatcacaccacttnctgttgggaattanggaaggaacttttcaaagacccttacagcaagattgattgggacaagccccgcacctatgtgcccaaggagatctgtactacccacaccattccgttcaagatgtgttgtgggccactctcataattcgttgaaccagtatgatgcattggctggcagcaaatgaggagaaagctctggaacatcatgcaacatgtcatatgagatgagaacctcgtataatgcatggcccgtaaacaggt

SEQ ID NO: 85123 - DNA, 821 bp, Zea mays
  misc_feature: Ceres CLONE 1571360
  misc_feature: Encodes the peptide sequence at SEQ ID NO. 85124
ctggagctccccgcggtggcggccgctctagaactagtggatcccccgggctgcaggaattcgtctcacccctagaaaaaaggccaatacccacattcgctcgctctacccgactaccccgcaagtcgaggccttccgctggctctcgctcgctcgctcgccccgcgactggttgcctctccgccccgaccctgccctgagaccggagacgaccgcgccccgcggtggcgctgcgacccgcgatacgctttgggcactgaaggttggcttacttgacaggaaattccccgtttaattgcatattggacatgtcttgtggcgtttgattggagaatttaattcttcccaacgatttccgttcttcggaggcttccatcttggtttcagttctgcagatctgtgactgagaggggaggaattccagtcagtcgtttatgaatcctggggcctgtgcttactagagggagggcaaggcaagttaggatccgagatgagggggagaaatgactccgggaacagcaagccggttgtgctgtgctgtgtgatgatcgtgtgcctatgcctcctcttcttgtatttctcgggctccaatggacaggctgggagcaccgcatttgagtacgggaccaaattctcacggtcacttggatggggcagtgatgatggttctgaagagtccatttttggaaccggggatgcagatgatgtcaagcctaagagctttcttgtgtgtgatgaccggcactctgagctgatcccctgcttggatcggaacttgatatatcaaatgaggctgaactgggatttaaacctgatggagc

SEQ ID NO: 85124 - protein, 110 aa, Zea mays
  misc_feature: Ceres CLONE 1571360
MRGRNDSGNSKPVVLCCVMIVCLCLLFLYFSGSNGQAGSTAFEYGTKFSRSLGWGSDDGSEESIFGTGDADDVKPKSFLVCDDRHSELIPCLDRNLIYQMRLNWDLNLME

SEQ ID NO: 85125 - DNA, 803 bp, Zea mays
  misc_feature: Ceres CLONE 1571362
  misc_feature: Encodes the peptide sequence at SEQ ID NO. 85126
  misc_feature (524)..(524): n is a, c, t, g, unknown, or other
ctccccgcggtggcggccgctctagaactagtggatcccccgggctgcaggaattcgtctcacccctagaaaaaaacatgtgagcgtgttcggcattactccacttcactccctccctccctcacctctggctcatcagtgcctgcctcactaacctcaccattactgaaatgcagagctcgcataaataggcaggacccgtggtgctactctcctgtccccttccggccttttccccccttctggagcttggggggaggcactctgcaccttcgtcttcgtcttggcgtcctccagcgctctgccttcctgagctggcttcttgtccgcaggatccatggcgaaagactacccagcttctccgaaagctcagcagctccaggaatccaagaagcagcgcctgacatacatcctcgtcgtaagcgcgctctgcatcgccttctacgtccttggcgcatggcagaacaccacgctttccaagcccataggcaactcggcgatcacccggggttggctgcgatccnactggccggcacgggacagtcctcctggctctgtgccctcgtttggggcaggctccggcgaagtgtttggacttcaaagcaaaccaccggggttacccttaaaaaacagggaagggcaatggggaaacttcaacaattttcccggggtggccccctcccaaatttcagggaagtaacacccccgttgtaaagaacaccaagggcccgggggccccggtttccacccaaaaacatttttttgtttgttttggggaagccccccttgttctcttggaaagg

SEQ ID NO: 85126 - protein, 120 aa, Zea mays
  misc_feature: Ceres CLONE 1571362
  misc_feature (63)..(63): Xaa is any aa, unknown, or other
MAKDYPASPKAQQLQESKKQRLTYILVVSALCIAFYVLGAWQNTTLSKPIGNSAITRGWLRSXWPARDSPPGSVPSFGAGSGEVFGLQSKPPGLPLKNREGQWGNFNNFPGVAPSQISGK

SEQ ID NO: 85127 - DNA, 859 bp, Zea mays
  misc_feature: Ceres CLONE 1571364
  misc_feature: Encodes the peptide sequence at SEQ ID NO. 85128
aaagctggagctccccgcggtggcggccgctctagaactagtggatcccccgggctgcaggaattcgtctcacccctagaaaaaaggccaatacccacattcgctcgctctacccgactaccccgcaagtcgaggccttccgctggctctcgctcgctcgctcgccccgcgactggttgcctctccgccccgaccctgccctgagaccggagacgaccgcgccccgcggtggcgctgcgacccgcgatacgctttgggcactgaaggttggcttacttgacaggaaattccccgtttaattgcatattggacatgtcttgtggcgtttgattggagaatttaattcttcccaacgatttccgttcttcggaggcttccatcttggtttcagttctgcagatctgccactgagaggggaggaattccagtcagtcgtttatgaatcctggggcctgtgcttactagagggagggcaaggcaagttaggatccgagatgagggggagaaatgactccgggaacagcaagccggttgtgctgtgctgtgtgatgatcgtgtgcctatgcctcctcttcttgtatttctcgggctccaatggacaggctgggagcaccgcatttgagtacgggacccaattctcacggtcacttggatggggcagtgatgatggttcttaagagtccatttttggaaccggggatgcagatgatgtcaagcctaagagctttcttgtggggtgatgacgcggcactctgagcctgatccccctggcttggatcggaaacttgttattatccaaatgagggctggaaccctggattttaaacccctatgggaaccctattgaagaaggctttta

SEQ ID NO: 85128 - protein, 60 aa, Zea mays
  misc_feature: Ceres CLONE 1571364
MRGRNDSGNSKPVVLCCVMIVCLCLLFLYFSGSNGQAGSTAFEYGTQFSRSLGWGSDDGS

SEQ ID NO: 85129 - DNA, 864 bp, Zea mays
  misc_feature: Ceres CLONE 1571365
  misc_feature: Encodes the peptide sequence at SEQ ID NO. 85130
  misc_feature (602)..(602): n is a, c, t, g, unknown, or other
ctccccgcggtggcggccgctctagaactagtggatcccccgggctgcaggaattcgtctcacccctagaaaaaatcccccgtcgagcacacaacacatcctcctccaagactcgcttcgcttctcccccagctcggacggagctcctcgcagtcgcagcagccgccgatcaacctgcgctcgggctcagcgctggaaggtgttggaagagaatagcctgaaggttcacagtaaccttcatctgttggaagatgtatcgggctaagagggctgcattgtcaccgaaggtgaagcgccgcgtcggcaagtacgagctcgggcgcaccattggggaagggacctttgccaaggtccggtttgctaagaacaccgaaaacggggaacctgttgctatcaaaatccttgacaaggagaaggttaagaggcacagattggttgagcagattaagcgtgaaatttgcatcatgaaattagtaaggcaccctaatgttgttcgactgtttgaggtgatgggaagtaaagcaagaattttcatcgttctggaatatgttaccggcggagagctttatcgaatcattgctactaatggaagattgaccgangactaagcacgtaaatacttcccagcactgattaatgctgttgattactgccacagtagggggagtgtatcacagacacttgaagctcgagaatttgctgcttgatgctgcaagaaatctcaaaggttctgactttggttacagtgctttaaccgagcattgaaaggctgatgatcttgcttcaaccaacagggggaacccctcaataagttcgcccctgaggggatccaaggatggggggccttggatgcggccacctcca

SEQ ID NO: 85130 - protein, 118 aa, Zea mays
  misc_feature: Ceres CLONE 1571365
  misc_feature: SWISSPROT Homolog: EC 2.7.11.1 Non-specific serine/threonine protein kinase
  misc_feature (117)..(117): Xaa is any aa, unknown, or other
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELYRIIATNGRLTXD

SEQ ID NO: 85131 - DNA, 916 bp, Zea mays
  misc_feature: Ceres CLONE 1571366
  misc_feature: Encodes the peptide sequence at SEQ ID NO. 85132
gcggtggcggccgctctagaactagtggatcccccgggctgcaggaattcgtctcacccctagaaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttacaatccccctggcctgctgcttttctgacaatcgaccagttccccagtcttgctccctgcagtcctccctcctcatctccagcgttgtgttccgactcacctgcaccatgggttgttcttccggcggggggtggtccccgggctcaactattggggttgagggcttgaaaaccccttgaaatcacttccctgaggcaccggctttgggaccccctgggagggggtggcggcccttccaggcccaaattgacttgttctgaactttgcggggggaaaacggtcccaccctccaagggatttggcccctgttcccccgaaaaagtgggtctttccccgagaatggcaaaaccgggggccccaatccgttataatt

SEQ ID NO: 85132 - protein, 50 aa, Zea mays; identical to SEQ ID NO: 23071
  misc_feature: Ceres CLONE 1571366
  misc_feature (1)..(50): Pfam Name: AdoMetDC_leader Pfam Description: S-adenosyl-l-methionine decarboxylase leader peptide

SEQ ID NO: 85133 - DNA, 823 bp, Zea mays
  misc_feature: Ceres CLONE 1571367
  misc_feature: Translation starting site: 197
  misc_feature: SWISSPROT Homolog: EC 1.4.1.2 Glutamate dehydrogenase
  misc_feature (743)..(743): n is a, c, t, g, unknown, or other
  misc_feature (744)..(744): n is a, c, t, g, unknown, or other
aaagctggagctccccgcggtggcggccgctctagaactagtggatcccccgggctgcaggaattcgtctcacccctagaaaaatctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgcttgaagcttaccttggcagcacgatcaagaatgctgtttgtcacgggtccctgcccaactttaaacaactcccaaagaaggcagggccccccaaaggaatcctgggggggggaattgcccgggccccacaagggggctggggnnaaaacatacaaagtaaaccaaaccgccggcgcgggaattggcgccctagggggtctgagaacaaaaagggggcacccct

SEQ ID NO: 85134 - DNA, 800 bp, Zea mays
  misc_feature: Ceres CLONE 1571368
  misc_feature: Encodes the peptide sequence at SEQ ID NO. 85135
ctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgtatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggaactgatgctgctccgcctcggcgccgtgccgaacgtggtggtctcgtcgccgcgcgtcgccgatggcgttgctcgcacctacaacacgtttttctcttcggcccgggttccctggtggccgaaatcatcatgtacgggggcaaccaaaccgtggttcggggcctaaaggggaaccaattccccaaaggggggaaaaacctggtaaccgggaaatttggcttaagcccgccaaggggg

SEQ ID NO: 85135 - protein, 160 aa, Zea mays
  misc_feature: Ceres CLONE 1571368
  misc_feature: SWISSPROT Homolog: EC 1.14.13.68 4-hydroxyphenylacetaldehyde oxime monooxygenase
MAAQLYHALYELLHEAAAAQRALLLAIPFSLLLLPLLLRYLAASASASASATKNDGAAAVAASDPDKLLSLLPSPPMKLPIIGHLHLMGDIPYVSLAALATRYGPELMLLRLGAVPNVVVSSPRVADGVARTYNTFFSSARVPWWPKSSCTGATKPWFGA

SEQ ID NO: 85136 - DNA, 770 bp, Zea mays
  misc_feature: Ceres CLONE 1571369
  misc_feature: Encodes the peptide sequence at SEQ ID NO. 85137
  misc_feature (715)..(715): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
acccgcggtggcggccgctctagaactagtggatcccccgggctgcaggaattcgtctcacccctagaaaaaaaatcgccgaagccgcgcgacggaaaccccaaacccaacctcatctcttttctcggcctctaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctgagaagccaccatcagttcgatttcattcaagaataacttaacatgcgttaatcatgaaactggagtggttgccccgaggaagtcagcgttctggggtactggcagcgtgattacctcatggaatacatccttacccatctcaggaaagagatgacttcgcccccgaaaccgcaggctagtttcagcttcccgaaggggacattctttcaaaggagggcaggaacctcaggtccatccctgggggactcggaaaaaagctttcccgcccctgggtccccaaaatttttaaaaaaatttaagccggattccagtntttagnnnnnnnnnnnnnnnnnnnnnnnnnnnnnnnnnnnnnnnnnnnnnnnnnc

SEQ ID NO: 85137 - protein, 92 aa, Zea mays
  misc_feature: Ceres CLONE 1571369
  misc_feature: SWISSPROT Homolog: EC 6.3.2.19 Ubiquitin--protein ligase
MTPGSSAAGSGVVVPRNFRLLEELERGEKGIGDGTVSYGMDDADDIYMRSWTGTIIGPHNTVHEGRIYQLKLFCDKDYPEKPPSVRFHSRIT

SEQ ID NO: 85138 - DNA, 903 bp, Zea mays
  misc_feature: Ceres CLONE 1571374
  misc_feature: Encodes the peptide sequence at SEQ ID NO. 85139
  misc_feature (539)..(539): n is a, c, t, g, unknown, or other
  misc_feature (550)..(550): n is a, c, t, g, unknown, or other
  misc_feature (650)..(650): n is a, c, t, g, unknown, or other
ctggagctcaccgcggtggcggccgctctagaactagtggatcccccgggctgcaggaattcgtctcacccctagaaaaagtccatcggcgtgacacgaaaccaagcaacaattgagcgatcgatccatcgcctctctctctctcagcaatctatccgcgacaactaagcattcgattctccgacaacaacaagcagggcaatggcgtctgcggacgtgcacatggctggcggtgcggagacggagaccttcgcattccaggccgagatcaaccagctgctctccctcatcatcaacaccttctactcgaacaaggagatcttcctcagagagctcatctccaacgcatcggatgcgcttgacaagatccgcttcgagagcctgacggacaagtcgaagctggacgcgcagccggagctcttcatccggctcgtcccggacaaggccagcaagacgctgtccatcatcgactccggcgtgggcatgaccaagtccgaacttgtcaacaactcggcaccatcgcgcggtcgggcaccaanggagtcatggnagcgcttgccgcgggcgcccacgacgtgtcgatgatcgggcagtttcgcgtcggcttctactccggctacctcgtcgcggacagttcatggtcaccaccnaggccaacgacaacgagcagtacgtgtgggagttccaggccggcggggtctttcctgtcacccatgaaccccggggggaccaaactcgttcggggcaaccaaaatcccctctttccttaaggacaaaccacctcaggatacctggagggaccgcccccctaaaggaccttctcaaaaaaaaccctcggaggtttttaaggtacccccttttacctggggggagggaaaaaaacccccgaaaaggaaaatcccc

SEQ ID NO: 85139 - protein, 127 aa, Zea mays
  misc_feature: Ceres CLONE 1571374
  misc_feature (113)..(113): Xaa is any aa, unknown, or other
  misc_feature (117)..(117): Xaa is any aa, unknown, or other
MASADVHMAGGAETETFAFQAEINQLLSLIINTFYSNKEIFLRELISNASDALDKIRFESLTDKSKLDAQPELFIRLVPDKASKTLSIIDSGVGMTKSELVNNSAPSRGRAPXESWXRLPRAPTTCR

SEQ ID NO: 85140 - DNA, 953 bp, Zea mays
  misc_feature: Ceres CLONE 1571376
  misc_feature: Encodes the peptide sequence at SEQ ID NO. 85141
  misc_feature (621)..(621): n is a, c, t, g, unknown, or other
  misc_feature (884)..(884): n is a, c, t, g, unknown, or other
atctccccgcggtggcggccgctctagaactagtggatcccccgggctgcaggaattcgtctcacccctagaaaaaaaaagtgctttcttagactgtgggtcggcttctcctccctctcccgttccggttccggctcatgaagctctcctgggttccgctccatgactgagcagatcaactccgcggcggcgaatgttaagtaccactccttcatgagcctcctcttctgcggccacagaataccactccctcgacgtctccttcatcacctacagccagctcctcaactccgtgattatcctcaatccccacacgatgagctccctcctcttcggcttcgtcaccttctcctcggtcgaggcgatgcagaacgacctcgagcgcatcatcgacttcgagctggacagccccaacctcaccgtcaaagagatccactcccacaacgacaccttagagatgctcgctgccctactgttgtggccacctgacgcggcttctaccgccagtggtgaggtcctccttatggcccccctacgctactgccgcagcacggtggtcccacggccgtgaccggctttataacttcggcggtggttgcctccttgatcgcactgctattncgtagtttgttgtaccgtactatgctaaacttcttttagatactttggttgcatctgtcgccgcttaagattttgacttggcctgtatggtataattccctagtgcttaggtcttcctgtgatgaacatgataattatattccttgcctttgtttttaattaaaagacccattgatgaatttttttgagacattttccatgtttctttccgcttcgctgctccccctttaagtctgatcaacctcgtcctcccactctgatcnccgtgcttgtgcaaattaaatggaacaaagttccaagaaagaggccctgccaggtccccagacatgttt

SEQ ID NO: 85141 - protein, 84 aa, Zea mays
  misc_feature: Ceres CLONE 1571376
MSSLLFGFVTFSSVEAMQNDLERIIDFELDSPNLTVKEIHSHNDTLEMLAALLLWPPDAASTASGEVLLMAPLRYCRSTVVPRP

SEQ ID NO: 85142 - DNA, 794 bp, Zea mays
  misc_feature: Ceres CLONE 1571382
  misc_feature: Encodes the peptide sequence at SEQ ID NO. 85143
gcggtggcggccgctctagaactagtggatcccccgggctgcaggaattcgtctcacccctagaaaaacacagaaaaacgaccacgtgacacctctcacagtctcacctcgtcgtcctcgtcccttccgcggccagccaggcagtcaggccggctggccgaggcagccgtgcccacgtgcacgaagcagcgggccgtgacgtggtttggggcgagcaggtgaccggcgagtagaagtagaagtaggctagcaacctgcacgcctacccgtcccacgcacctcccgacttctccggttctcccttcttcatagcagccacccacgcatctcagcgccgaggcgagcgaggacctcgtggttcgtgccctgctcacctcgtgaggatgtggatcgcgaggcggctcttcctcgcggcggcggcgctgctgatggctgtgcttctgctcgtcgcggggccggtggcggcgcaggacgcggcggtggagggcgtggccccgcctgcggaggagatcgcggcgaacgcgagggccaaaggagcggcggttctggccgccgagctagtgcagctcagggcgaagatctccgccgttagagtctcgcattgcagagcagaacctggagttcaggaccaagaatgatgcaatcgaaacactgaatatgattgtcaaggaaaggtcacagaagattgctcctatgcagaaatgaagtaactttccctcgagggccaaagggtctttaacttgcaaaaggaacagggaaaccaaagccaatggccctgggctatttggacttat

SEQ ID NO: 85143 - protein, 84 aa, Zea mays
  misc_feature: Ceres CLONE 1571382
MWIARRLFLAAAALLMAVLLLVAGPVAAQDAAVEGVAPPAEEIAANARAKGAAVLAAELVQLRAKISAVRVSHCRAEPGVQDQE

SEQ ID NO: 85144 - DNA, 671 bp, Zea mays
  misc_feature: Ceres CLONE 1571383
  misc_feature: Encodes the peptide sequence at SEQ ID NO. 85145
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (643)..(643): n is a, c, t, g, unknown, or other
ctccccgcggtggcggccgctctagaactagtggatcccccgggctgcaggaattcgtctcacccctagaaaaaaccgcctgcgactgcgagctcaaagatccatccacactgagctgcccaaatccacattcccatcggcgcagacggccgggaggaggatgtccatgccggagacgttcaccctgaaggtgggggaggcgacgccggccgccgccggcagggccgtcggccgggcccgtgtaccggagcatctacgccaggacggcctcatggtacctcccacaggggaacaattcnnncaagtccccccttgggacttgttcagtgggggcatcaagaagtccccaccaacaagatgggccgggcaacctctccggttccacaatggggaaaggcccgggtaaaattttttgggggcaaacctttccaagggaaattgtggccccaaaaaggccccttgggggatttttgtaccccccgcccttcaaaaaaaaccccgggggggggtaaaaaacccgggggaaccccccccccggggggggggattttttggggggccccccccccccccccccccccaaaaaaggggtggtttttttgcccccccccccccccnnnnacnnngggtgggggatttgtgntataaaaacaaccaacaaaaaaaaaaaa

SEQ ID NO: 85145 - protein, 81 aa, Zea mays
  misc_feature: Ceres CLONE 1571383
  misc_feature (47)..(47): Xaa is any aa, unknown, or other
MSMPETFTLKVGEATPAAAGRAVGRARVPEHLRQDGLMVPPTGEQFXQVPPWDLFSGGIKKSPPTRWAGQPLRFHNGERPG

SEQ ID NO: 85146 - DNA, 888 bp, Zea mays
  misc_feature: Ceres CLONE 1571384
  misc_feature: Encodes the peptide sequence at SEQ ID NO. 85147
  misc_feature (487)..(487): n is a, c, t, g, unknown, or other
  misc_feature (508)..(508): n is a, c, t, g, unknown, or other
  misc_feature (509)..(509): n is a, c, t, g, unknown, or other
  misc_feature (564)..(564): n is a, c, t, g, unknown, or other
ctccccgcggtggcggccgctctagaactagtggatcccccgggctgcaggaattcgtctcacccctagaaaaaacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtggggcgtgccccccnaaggtgggcaaggggtcgtcnntcgggaacacaatgctcagcagggggggggagttccttccgcgcccggcgttgcngggggggttccctccaaccgaggggccggccgtcatacaaaaaaatggggtggctcctgcgggccccgaggaaaaacacctgggggggacccccccgggaattgaggcacccttggggggccccccacaaaaaaaagaaggggggcccccccggggaaccacaataaagggacccccctttccccaacaagggggaacaaaccccggggggaaaaccccccacaagggggcccccccaaaccccccgaaaaaactttttttttgggaggggctccccccacggggttgtggaaaaaatttttttttggggacaaaagaagtggg

SEQ ID NO: 85147 - protein, 107 aa, Zea mays
  misc_feature: Ceres CLONE 1571384
  misc_feature (48)..(48): Xaa is any aa, unknown, or other
  misc_feature (55)..(55): Xaa is any aa, unknown, or other
MSALLDLLMGIFRQQTLGGAALELAALAAPLWLAALVGLLIGWGVPPXGGQGVVXREHNAQQGGGVPSAPGVAGGVPSNRGAGRHTKKWGGSCGPRGKTPGGDPPGN

SEQ ID NO: 85148 - DNA, 784 bp, Zea mays
  misc_feature: Ceres CLONE 1571385
  misc_feature: Encodes the peptide sequence at SEQ ID NO. 85149
  misc_feature (742)..(742): n is a, c, t, g, unknown, or other
  misc_feature (743)..(743): n is a, c, t, g, unknown, or other
ccgcggtggcggccgctctagaactagtggatcccccgggctgcaggaattcgtctcacccctagaaaaagatgagatcggcgcgtatatcttttccggtgtccgatgattcatgcattagcaatttgactcgtacgtgcgtgactacagttgcatgctatggccatggccaccacttcgccggcaactgtgcagccatcatcatacaagcacacgagccgcggcgcggcgcggtgctgccctcctcctctgctgtcctggaagacacgaagctttgggcagcaggtgacgacaagggccacggcggcgagctcccgtgggcagcccgccggcgtggcactggcagggggagaagagggcgacagtatcaggcggctgcagaacgggtcggacgtgcggggcgtcgcgctggagggcgagaaaggccgggccgtggacctcacgccgctggcggtcgaggccatcgccgagagcttcggggagtggctgcgagaggaggagctccggctccggggccaggagcccgagcagctgcgtgtgtccgtcggccgcgaccccaggctgtcggggccgcggctcagcgcggcgctctttgcggggctcgccagagcgggctgctccgtcttcgacatgaggctcgccaccacgccagcctgcttcatgagcaccatactgccacgcttcaactatgacggctcaattatggtagtgaagtaatgatacgtattttacgtttgcgtcnntggtggtgtgcgtgcctgccatgcaatgcatgtgtttcact

SEQ ID NO: 85149 - protein, 183 aa, Zea mays
  misc_feature: Ceres CLONE 1571385
  misc_feature (69)..(183): Pfam Name: PGM_PMM_I Pfam Description: Phosphoglucomutase/phosphomannomutase, alpha/beta/alpha domain I
  misc_feature: SWISSPROT Homolog: EC 5.4.2.10 Phosphoglucosamine mutase
MATTSPATVQPSSYKHTSRGAARCCPPPLLSWKTRSFGQQVTTRATAASSRGQPAGVALAGGEEGDSIRRLQNGSDVRGVALEGEKGRAVDLTPLAVEAIAESFGEWLREEELRLRGQEPEQLRVSVGRDPRLSGPRLSAALFAGLARAGCSVFDMRLATTPACFMSTILPRFNYDGSIMVVK

SEQ ID NO: 85150 - DNA, 929 bp, Zea mays
  misc_feature: Ceres CLONE 1571386
  misc_feature: Encodes the peptide sequence at SEQ ID NO. 85151
  misc_feature (627)..(627): n is a, c, t, g, unknown, or other
  misc_feature (874)..(874): n is a, c, t, g, unknown, or other
ctccccgcggtggcggccgctctagaactagtggatcccccgggctgcaggaattcgtctcacccctagaaaaatcttccatctttgcggagcgacgcgcatctggcctgcccatctctttcgtgctcctacccctcaagccttcttccgcccgccgcctcagccctcaaggcttttccttctcatcttcttctcagaccggggacgggcccgacggggacagggacaaaaggtggtgcgatcttgttgggcacactccgcctccgcgcgcgggaagagagagagagagagagagagagagagagagagagagagagagagaaggacggagggtggcagggccgccgcgccggtgagccgacccccagccatggcattgccggctccccccgtccgcctggcgctgctgctgctcgtcgcgctgccattctgcgccgcgcatcccgggccgggggccttcaacgctcctcgccacttccagacgcccgcgctccactctgatggatttggcttggtggcaagaaggtcggttgctgaagctcctgctgacatcaacgtcactaccaatagctcctttgtgctggcggcagataggacatatcgaagggacccttttgatggcttcangaaatacccgggcggctggaatatcagtgaagtgcactatttcgcttccgtcggatatacagccattccgctgttcgccattgctctcgtgggggtttgtgatcttttccctggtaatgcctgggatttgctgcccgtcattgctgttgcccgcctcacaccttcaagtattcccgaacagcaaatggctcttccatggaaactcccaaaacggtcacaggggccgcaattggcggaagggccaggntaaacccatggcccgggaaaattccccaagaccacaagccccttctttatttttt

SEQ ID NO: 85151 - protein, 168 aa, Zea mays
  misc_feature: Ceres CLONE 1571386
  misc_feature (86)..(86): Xaa is any aa, unknown, or other
MALPAPPVRLALLLLVALPFCAAHPGPGAFNAPRHFQTPALHSDGFGLVARRSVAEAPADINVTTNSSFVLAADRTYRRDPFDGFXKYPGGWNISEVHYFASVGYTAIPLFAIALVGVCDLFPGNAWDLLPVIAVARLTPSSIPEQQMALPWKLPKRSQGPQLAEGPG

SEQ ID NO: 85152 - DNA, 830 bp, Zea mays
  misc_feature: Ceres CLONE 1571388
  misc_feature: Encodes the peptide sequence at SEQ ID NO. 85153
  misc_feature (263)..(263): n is a, c, t, g, unknown, or other
agctccccgcggtggcggccgctctagaactagtggatcccccgggctgcaggaattcgtctcacccctagaaaaattctgctccccttcgcctcccttcccttcctcgacttcacctcaccaccatctccagctccatccgcacgcagccgtccaccaaccgacgcagcgaggagatgaacgcgtcgcagttcatggacaagcagatcctcggcctggctgcctccgcctccccctccggcggcggcgcggggggcggtggngggtgtggatctcagcgatctgatgataccgatcccccaggacgacggcgagaaccgcctcggtcgccggcgtagcagcaccagcgtcaacggaaccgcaggcgacatgctacccagttatgacttccagcccatccgcactagtgacggcgccgtggccgccgccgcgcctcaggcctcgtgggggtcgctcgactccaaggcaccctccgcctcttacaacctcaagagtgctggtatattggagccgcatgtgctgaagaaagttagtcatgaggaagacaagagtaactttcctacagttactattgcggatattgatcgaaccatgaagaagtactctgataacgttttgcatgcactggaaggtgtaagctcaaagctttcacagatggagggtagaacacaccaactcgaaaactgtgttgaatgagttgaagttaacaatcgggaaactataatggggagcacttgatggaaaaactgagggaccctttgagaacattgctcaggggaggtcccaagcaaggggttgcagaatttttgcggagacaaagcgggaaaata

SEQ ID NO: 85153 - protein, 136 aa, Zea mays
  misc_feature: Ceres CLONE 1571388
MIPIPQDDGENRLGRRRSSTSVNGTAGDMLPSYDFQPIRTSDGAVAAAAPQASWGSLDSKAPSASYNLKSAGILEPHVLKKVSHEEDKSNFPTVTIADIDRTMKKYSDNVLHALEGVSSKLSQMEGRTHQLENCVE

SEQ ID NO: 85154 - DNA, 846 bp, Zea mays
  misc_feature: Ceres CLONE 1571389
  misc_feature (518)..(518): n is a, c, t, g, unknown, or other
  misc_feature (591)..(591): n is a, c, t, g, unknown, or other
  misc_feature (618)..(618): n is a, c, t, g, unknown, or other
  misc_feature (627)..(627): n is a, c, t, g, unknown, or other
  misc_feature (628)..(628): n is a, c, t, g, unknown, or other
  misc_feature (643)..(643): n is a, c, t, g, unknown, or other
  misc_feature (661)..(661): n is a, c, t, g, unknown, or other
  misc_feature (669)..(669): n is a, c, t, g, unknown, or other
  misc_feature (674)..(674): n is a, c, t, g, unknown, or other
  misc_feature (695)..(695): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (763)..(763): n is a, c, t, g, unknown, or other
  misc_feature (765)..(765): n is a, c, t, g, unknown, or other
  misc_feature (807)..(807): n is a, c, t, g, unknown, or other
  misc_feature (808)..(808): n is a, c, t, g, unknown, or other
  misc_feature (810)..(810): n is a, c, t, g, unknown, or other
  misc_feature (841)..(841): n is a, c, t, g, unknown, or other
ggagctccccgcggtggcggccgctctagaactagtggatcccccgggctgcaggaattcgtctcacccctagaaaaacctcacacacacactgaccgacacagcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggcccaagaccgaggggctcgtgcgcaggaagctgatgaggctcctgtcggctcgtccccttcggctgccgtgctgggaccatcgacgaagcgccgccgcccgtggacacgctgccggcgcccgccgcgaggaggcccccgaaggaggaagggcaaaaaaaagcccccccaacttgcttgggggggttgtttgcgggggggctcccccaaaaaaattgtggggggncccccccccttttttttgggggggaaaaaaaaaaatttttggggggggggggaggaaaaaaaggcgatgagtntcacggtccccccaaccgaaacagcgntcaaaaaannttattttgagagagnaaaggagagagggggggngggagcgntgccnctttgcgtagccaaaaccagncccccnnnnaggcgtaaggcggggggggtggtggcttttttgcccctccgaccgtaagagccgggttntnaggggttgtagtggaataaaaaaaaagcaaacacaagcgaannancacagcggaaggcggatagtgacgtcaggtngaggg

SEQ ID NO: 85155 - DNA, 824 bp, Zea mays
  misc_feature: Ceres CLONE 1571394
  misc_feature: Encodes the peptide sequence at SEQ ID NO. 85156
ctccccgcggtggcggccgctctagaactagtggatcccccgggctgcaggaattcgtctcacccctagaaaaaacatacatcggtgtgttgcggtgagagccggaatatacccggttgctcccccttggatccttgtttgcttcctgctgcctggccttctctcctccccaaaatcaatcgcccacaaaggagagccaggcagccagccaaatcttccacctcctccatttccagccccgtccccacaccagctcgcgtaacctcctgcccatggctggaggcggcggcgcaggcgcgggctcgtcgtccggcggcggcggagggggcggcagggagggcgactgggactgcggcagctgcggcaaccgcaactacgccttccgctcgctctgcaaccgctgcaagcagccgcgcctcctcgtcgaccccaacaccccgcgcgactccaagtggctaccccgcgccggggactggatctgcaccggtaacacctctcctgccacgctacccttcattattacccagccctgaatcacccgtcacttgttgtagatgctggctctcatccatccctatgcagcgcattgatagtctagtgaatctagcatttctccttcatcccttgtgttcgctctaggtttagtatgttggcatagccctggttattattgtagacttcttagctagactttgggtctgtttggattcaaagatctattactagctagctaaaattagctaaaattgattctagtgcatccaaagcagagggctaatagacgtgataattttttagcccagtttttactagctgttagctaa

SEQ ID NO: 85156 - protein, 86 aa, Zea mays
  misc_feature: Ceres CLONE 1571394
  misc_feature (21)..(50): Pfam Name: zf-RanBP Pfam Description: Zn-finger in Ran binding protein and others
MAGGGGAGAGSSSGGGGGGGREGDWDCGSCGNRNYAFRSLCNRCKQPRLLVDPNTPRDSKWLPRAGDWICTGNTSPATLPFIITQP

SEQ ID NO: 85157 - DNA, 809 bp, Zea mays
  misc_feature: Ceres CLONE 1571396
  misc_feature (397)..(397): n is a, c, t, g, unknown, or other
ctccccgcggtggcggccgctctagaactagtggatcccccgggctgcaggaattcgtctcacccctagaaaaaacctcgccttcacctcagctcacggcctcacccgtccacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccctatgggccagtcgcctgagcgcgctacgtatcagctcatcgaccggcgggaaggctgtancgtcggtttggacggtcgtgaggcgtgcagagcaattaagcaaagcagggcttgggtaaatcatttatggaaagctctcccttttacatgtaccttggctacaataatcgttaagagaagttccctaaataaagtgggttcaaaaaagtgaaaatgcatggtcaatccctacctaggaaaagcccccgctttaaatcccaatgcgccgggaatttggacccgcccttttgttaaaaccaattttttgggaaaagggaccagctccctaaaaaaaaccaaaattttggggggggtcccccccgggaaaaaaaaatttccaaaatagggcgcgggggccccccaaagggttctaaaaacccccaaaagagggggggggcccccccaattttttggggaaaaaaaaccgcttccc

SEQ ID NO: 85158 - DNA, 886 bp, Zea mays
  misc_feature: Ceres CLONE 1571408
  misc_feature: Encodes the peptide sequence at SEQ ID NO. 85159
aaagctggagctcaccgcggtggcggccgctctagaactagtggatcccccgggctgcaggaattcgtctcacccctagaaaaagcggcagcagcaactgcagtggcggcgcctacccccacgcgcctccgcctcccgctcctctcccgcaccctgcgctctggtcactgtagaagctcttattcctccaggctcctacggttctcgtgcagtgccaccaccatgggagatgagacctcaacctcggttgctccccaggagcaggaatccactgtgcaggctgggagtgtcaagcaacagctctccgggctggtccttatgtccctccgggctactagtgcctgaggtggaggtagaaaccgatgggttgaaagtttcagccaaagtttgcctgactaccagtgccaacaacccctatggggattattggttcaaaaggttaaaaggattcttggaaaaccagtttttcaaaaaaaccccttaatggcccatttgggaaacaagggcccatttggccaaaaaaaactttgcccccttcctttcccggaaaatttttttgggaaaatcccaaccactccggttgttgccccagggaaccccgggggtttttataaggaaaaaaaaatggggccgcctttaggtcaagaaaccccgctttggggggtttgtgccccccggtgggatattctaccaaggacccttggggcccgtctttagagcaggttttatctaaaagaaatatttgtggggacaccccccaatttttctttccccgaaaaagaagaggaagggggcaaacagcgaacattctaaatttttttttccaccccccaccccgtataaaatatttttgggcacaaaaagagaaaaaacaccgccttgtttg

SEQ ID NO: 85159 - protein, 40 aa, Zea mays
  misc_feature: Ceres CLONE 1571408
MGDETSTSVAPQEQESTVQAGSVKQQLSGLVLMSLRATSA

SEQ ID NO: 85160 - DNA, 962 bp, Zea mays
  misc_feature: Ceres CLONE 1571409
  misc_feature: Translation starting site: 186
  misc_feature: SWISSPROT Homolog: EC 3.6.1.1 Inorganic diphosphatase
ctccccgcggtggcggccgctctagaactagtggatcccccgggctgcaggaattcgtctcacccctagaaaaactcctcccttccctcccgtaccgtatcagtctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttggggtctgtcgagggattcagcacgaagagtcaacctttgccactatatcaaggaccagacttgcaagcctgcccttgctaatgccatcttcagtactatagcttttgtgcttggtgcagtcacctcactagtttccggctttcttggaatgaagatcgcaacttatgggaatgcccggacaacttttgaggccagaaaggggtgtcggaaaggcatttattactgccttccgagctgggtgaagaatgggctttcctgcttggtgccagccggtcctttgggttcctttacattggctatcaatttggtgtgggaatttattacgggggtagactgggcaagggtctctgtgaatcccattacctggtgttggcccctggtgggccttttcaatgggaccctctttagacccgtgttgggagaggggatgtttatccacaagg

SEQ ID NO: 85161 - DNA, 803 bp, Zea mays
  misc_feature: Ceres CLONE 1571412
  misc_feature: Encodes the peptide sequence at SEQ ID NO. 85162
acccgcggtggcggccgctctagaactagtggatcccccgggctgcaggaattcgtctcacccctagaaaaaaccagaagctcactcactgctcgttgccggctgcccccgcggccccggccagtccatcccctcgctcgctccccaactccagcaggcagatcagatacatccatccattcgcggaccggaaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcaggggccccgtcgccgccgcccttaagacagattcggtgctcaaggcgctgaacatgacctccccgaagggcggcggcgacgccccgcgggggttccggggagaaaccaggaacgccgaagagccgaccaagtacgccggcagccccaagagcacgctccccgcgtgatccaacaacctcgctagggtcgcctgggggaactcatcaggaaaggtgctgccccctctgcagccttggctcctggctgcgccccctgtcctggtctgctcctttcaatccaaataacggggggttcgagccaatgggaaaaagggggcccaaacggaaaaaaatcccctttggattaggaaagt

SEQ ID NO: 85162 - protein, 87 aa, Zea mays
  misc_feature: Ceres CLONE 1571412
MSAVAVSSSLNPDAPLFIPAALLQVEDFSPQWWDLITTTAWFRDHWSRERAHLDEMAEQIDAAGLLPDDEDLFYDDQLEQGPRRRRP

SEQ ID NO: 85163 - DNA, 893 bp, Zea mays
  misc_feature: Ceres CLONE 1571413
  misc_feature: Encodes the peptide sequence at SEQ ID NO. 85164
  misc_feature (402)..(402): n is a, c, t, g, unknown, or other
ccgcggtggcggccgctctagaactagtggatcccccgggctgcaggaattcgtctcacccctagaaaaaacaccaacctcagcacaccaaggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcncccgaccacaacctggccaagaatgaggccggcggcatcatcggcacccggttcgagtcctccgaagtcaagtccaccccgttgcagccctacagcgaggtgttcggcctccagcggttccgcgagtgcgagctcatccacggccgcttggccatgctcgccaaccctcgggggcccttctccgtcgagtgggctcaccgggcgtcatcttggcaggaacccggcaaggtgggagctgggggacgggtcctccttactgggccagccgctgccctttctccatttcgaacgctcatttggatccagggggctcgtgaacgggcttaattgaatttccaagggaatgcccaaactcgaacccggaaaaaaaaggttttacccccggcgggttccttattttaaacccccctcggcctgtgggggccgaacccttgaaaaaaaagaacgggctgccccggggggaaaataaaaaaccggccccctctcccttg

SEQ ID NO: 85164 - protein, 204 aa, Zea mays
  misc_feature: Ceres CLONE 1571413
  misc_feature (63)..(200): Pfam Name: Chloroa_b-bind Pfam Description: Chlorophyll A-B binding protein
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSPDHNLAKNEAGGIIGTRFESSEVKSTPLQPYSEVFGLQRFRECELIHGRLAMLANPRGPFSVEWAHRASSWQEPGKVGAGGRVLLTGPAAALSPFRTLIWIQGARERA

SEQ ID NO: 85165 - DNA, 1333 bp, Zea mays
  misc_feature: Ceres CLONE 1571417
  misc_feature: Encodes the peptide sequence at SEQ ID NO. 85166
atatttcaccatatgtttctttattctccctgatggatttctaatataatgtatattggatcggctctcaataattggaaactctccgcggtggcggccgctctagaactagtggatccccctggctgcaagaattcgtctcacccctagaaaaaacacacacacggccaaattccgctctctgctttgtttacacaggcgacgcaagccacgcagcgcgccgccaccgcgtctgcactccgcccccgcgaagcttccggggggccctcttccttcctccgccccagccctcgagtcggtctccaccggcggcggcggtaggcttccgcgccggctccggactggatcggcccggccgcgagattattaagggcaggcagaccttacttgttttatggctagaaataatgagggtcatctcctgctcccagacacggatcatattcaacccaagaacaccccgcacaatgaatttttacctctaggccagaagcttatgctgcatcctggaagtgatgcaccccttagaattggtcattcaaggcatgagtataagagacttaaatcaaactgatcttccaccctttaagtccctactgtgaccatacttccaagggtaataataactgcggtaatacccaaggaggccgtcggctatatctctctttctgtggtttcattttttccacgccttgtcgaaatttgtccatattaaatcaatttcgtagctcgtaaaacccttgggtttgagatacacttcttctcaccttaatttagctttctattaaacggaaaagagacatattttgtacgtttcctcataagttaggggcatatcctcccccaatcatttggtgctcacccgtacaacattttataaaagtgagagtgctttagtcccaagtatgctaataatatttccctgagaacgaacagaagaatattcccgctcttatttatttgtgatggacaacttcacttccttttgtgctcttcgaggcggaaaatcccaaacgatgtggactctatatcacgggggggaacttattttctaccatgtgttttcttgtcgtgatacacccatactctttttcctccaccaaatggcatctctgacactatacaatcactgaaaagaccatcttctctattatataactgtatactaaatatatgctgtttcgactttcctactctatgacggtcggaagcgcccatgtataaccgtttccaaattcacaaaatgatccatcgtgttttgagctatatttttgtcaacgtgaaataatatgtatttatatactaaatatgacccgtcctcatctatactact

SEQ ID NO: 85166 - protein, 59 aa, Zea mays
  misc_feature: Ceres CLONE 1571417
MARNNEGHLLLPDTDHIQPKNTPHNEFLPLGQKLMLHPGSDAPLRIGHSRHEYKRLKSN

SEQ ID NO: 85167 - DNA, 863 bp, Zea mays
  misc_feature: Ceres CLONE 1571419
  misc_feature: Translation starting site: 133
  misc_feature: Pfam Name: MoeA_N Pfam Description: MoeA N-terminal region (domain I and II)
tccccgcggtggcggccgctctagaactagtggatcccccgggctgcaggaattcgtctcacccctagaaaaagtgggaaattgaagcggaggaagatagagagaagaagaggagactagagagggagagagatgctgcaagtggaggaggcgctggcggcggtgctgtccgcggcggcgggccacgcggagccgcacgccgtgccgctgcacggcgcgctcgggctcgtcctcgcggaggacgtctgcgcgcccgatccgctccctcccttccgcgcctccatcaaggacggatacgccgtcgtggcctccgatgggccaggggagtatcctgtggtcacggagttctagggcgggcgacgacgccctcggagtggttgtcgtccccggcacggtcgcctacatcaccaccggagggccggttcccgatggcgccgatgccgtcgtgcaggtggaggacaccgagcagctccctggcggagcggatgggtccaagagggttaggattcttgcgcgggcctctcaaagacaggacatccgcagtgtgggatgtgacatatagcaggattccattgtgctcaactctggagagcatatgggtcctgcagaaattgggctacttgcaacaggggggtgtaaccactgtaaaggtgtacccttcggccaaaaatcgctggtttctccccagggggatgagctaaggggagccgggcccctggcaccctccccccgggggtcgaattcttggattccaatcggggcaaggctttttaattggggtgcttttcgcaaaaaaattgcaagggggtgtgacctctggggatttctcaaaggaacactttttaaaaaaaattctttcaggt

SEQ ID NO: 85168 - DNA, 1275 bp, Zea mays
  misc_feature: Ceres CLONE 1571421
  misc_feature: Encodes the peptide sequence at SEQ ID NO. 85169
  misc_feature (63)..(63): n is a, c, t, g, unknown, or other
  misc_feature (64)..(64): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (93)..(93): n is a, c, t, g, unknown, or other
  misc_feature (783)..(783): n is a, c, t, g, unknown, or other
  misc_feature (924)..(924): n is a, c, t, g, unknown, or other
  misc_feature (980)..(980): n is a, c, t, g, unknown, or other
  misc_feature (981)..(981): n is a, c, t, g, unknown, or other
  misc_feature (1105)..(1105): n is a, c, t, g, unknown, or other
  misc_feature (1106)..(1106): n is a, c, t, g, unknown, or other
  misc_feature (1122)..(1122): n is a, c, t, g, unknown, or other
  misc_feature (1199)..(1199): n is a, c, t, g, unknown, or other
aaacgcgtcggatcgggggcatttttagttgtggtgttggtgtggggtggggtcccgccggtnnacaaaannnnnaaaaactggagctcaccncggtggcggccgctctagaatagtggatcccccgggctgcttgaattcgtctcacccctagaaaaaaagctagctagctctgccctctgctcttggctcctccttcccagtaacaactaacaagtctacacacaggggacaccacaagtacatcgccaccgacggaggaagaacaacaagaaccccgatgacaattgcagccgcggtgaccgcgcccacgtccgcgccagtgcacgtcgcgccgcgccacgccagcccctcggtccatccgcgcgccgcgccgcgcagggagccgtcgccgctcaacccctacgcgccggcgcaggggctccgctccgccagccccagcggcggcgggtcttccgcggccactgattgggcaggcccccacatcaccaacctttgacaaggtgctcgaggaagccctccccacggtaccgaagggccctcgaagcaatcttcctcctgccagacaggcaaagggtcttggggccaaaggggtaaatggacgggcgaaaaaccaggtttccaacctttgaggggatccgggggaaaggggcccttgtgattgaaacggaaagtcctacatagcttttgcatcaccttttcctttacacaggaggcgcagaagacgcccgctagaggaaaacttgctcggagagaacagaccaggtaaaaaataagggaccncctcactgttatcctgtgatcttcctctcaaatgatttgtgttcaacctatcataaataaggtctataacgcgccgtatggcccaagtgggagaggaagagaaaggtgacagaataatccagaagctaggctgcgcgggtntgatttactgcgtgggctgagagtagtctctactccctcttatgagtcgacttttnntcttcttctccccgccgcggtgtaactgggagtggtagcacacccaacatatagagcctatggcgattacagcacagtagtgaagcggtccacaaacgaatatgttgtgaatgcgcggggcganncgcgggggtagttgtnctatagaacgccagagagggttgcgatcctttaagccaccagggtggcggggagtggacactgctctatggaaactncacttatgttactcagtagatgtatctcttctatactgcttgtgaatagtaaatataacactacaaatagataaat

SEQ ID NO: 85169 - protein, 72 aa, Zea mays
  misc_feature: Ceres CLONE 1571421
MTIAAAVTAPTSAPVHVAPRHASPSVHPRAAPRREPSPLNPYAPAQGLRSASPSGGGSSAATDWAGPHITNL

SEQ ID NO: 85170 - DNA, 1166 bp, Zea mays
  misc_feature: Ceres CLONE 1571422
  misc_feature: Encodes the peptide sequence at SEQ ID NO. 85171
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (1114)..(1114): n is a, c, t, g, unknown, or other
  misc_feature (1166)..(1166): n is a, c, t, g, unknown, or other
gtgtttttttgtgggggggggtacaggagcactaattctatagagagtgtaagaaagaacataaaacccggtnnnnntggtagctggaactccccgcggtggcggccgctctagaactagtggatcccccgggctgcaggaattcgtctcacccctagaaaaagtccatccgtattcccgtcacgcccccaacacgcccacaacccggagcagcgaaagctcccctaaccctctccgcgcatccgatcgcaaggaagaagagggagatgagctactacgggcagcaaccccccgtcggcgtcccgccgcagcaaggctacccgggcaaggacggctacccgccagcggggtacccgccggccggataccccccgccggcgcagggctaccctccgcaaggctaccctccgcagtacgcgcagccgccgcctccacagcagcagcagagcagcggggcttccttcatggagggatgcttggcccccccccacctgctgctgccctcctaggacgcctcgcttctgaacagtgaagagggggccgaaccgaacggatttcgacacggggcgacaaagtgaaaacctacttaggcttttcctttgccgcagggggacaagaagaggtagaaaagcctgggaaacttgggaaatgtaagccccttgggaaaaggccttatggcaagggcttaattccccagaccctctgttgtccccgaaaagccccataaaattatgtgtcgccgcggcccccctaagaaactttttctctctaacttgtgggacactctccccgcggctggagacaccaatagctctttttggtatatccgggtggagaatccatagaataaacagatgttgagatccacgtgttaggaaataatttcgccctgtacaccctcgttggtggtagttagtgtggcccccgagaagtctctctgctttggagggaggaagaaaaatctctctcggcgcccgcgcgggggctatttttagtgttgcgaggtgccaggctctttctttctctacaacacactgaatcatagtggacgcgtttatacaccagcaccaacaccgggggggggagtgattttcccgccaacgaacgcgaaaantaagggtaaatataggagcgcttgacatctaaaacgatcgtggcgtggaccn

SEQ ID NO: 85171 - protein, 80 aa, Zea mays
  misc_feature: Ceres CLONE 1571422
MSYYGQQPPVGVPPQQGYPGKDGYPPAGYPPAGYPPPAQGYPPQGYPPQYAQPPPPQQQQSSGASFMEGCLAPPHLLLPS

SEQ ID NO: 85172 - DNA, 1333 bp, Zea mays
  misc_feature: Ceres CLONE 1571424
  misc_feature (898)..(898): n is a, c, t, g, unknown, or other
  misc_feature (1063)..(1063): n is a, c, t, g, unknown, or other
  misc_feature (1288)..(1288): n is a, c, t, g, unknown, or other
tagtttggctattttaggtttatttcttctatagtttctttttaagtattattgttggtgagttttaatgaatggtactccccgcggtggcggccgctctagaactagtggatcccccgggctgcaggaatgcgtctcaccccctagaaaaagcactctcgtgcacaagactagcagagagaacataatccaaagatgggctggagaccacacgttgtctctgcgtcatcatccgcactagtgcttcagttcctcgtgctgctgctgcccctgcccctgcccctgctgtccgccgatgcatcggcgagccaaacgactacgacgatttacgttggtgtacatggtcgagaagaaacacgacgatccttccgtcttcatggcgtcgcacccatgccgttctgacctccgttcttgggagcaaggacgaagccctccgtcccacatcccacagctacaagcacggattctctggggttttgggggaaagctccccatgccccgagcccgaccagattacaataaacccctgtgagatcgtgaacagtgtaagcctaacaccgtaccaatcctcataacctagcgacccgggatactggtgaatttttcttttgggcataaatacgaagagggacaaaaatcgacctgtccttttagacgctcaagtcgtatccgcgtggtgggcctcgcgggaaaggggcccaaaatctacggcgctgtgtaaagtaataggaattacacgcagcatggtcttgtcataatatatcttccatgagtccaatccatgacgtccctcggataatagcactcactagcacaagcttacttcttaaccgactaataagtatctgagagttgttacgggcgcccacccaccagtagtaaccacacagtaatagtncgggtagggtggataaataggagcgtggtataggcaaccaccgacaaatccatagggagactaaatggtctgtatgtatattagacgatgtgggacagtcaatagctcacatttatcccgcgaggacgctgcgctataccttatctgtctcgaagaacgccgcanacggtaactacactcgcagccccacagacgcactctgcgctcattaagacagatagagacatccacaccaagataagaaatacagcaagaggtcaagcgttatatgataccttttaccacttctcgttctcttatactctataccctagacgacgccactctatagtttatattaacagtgcgtgtccatcgcgggaattagaattcgactaagtgagctattgntgtgctgaatcaggttggttcatgcagtagtcaccatcagatgcc

SEQ ID NO: 85173 - DNA, 1047 bp, Zea mays
  misc_feature: Ceres CLONE 1571426
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (101)..(101): n is a, c, t, g, unknown, or other
  misc_feature (822)..(822): n is a, c, t, g, unknown, or other
  misc_feature (823)..(823): n is a, c, t, g, unknown, or other
  misc_feature (959)..(959): n is a, c, t, g, unknown, or other
  misc_feature (1018)..(1018): n is a, c, t, g, unknown, or other
nnnnnnnnnnnccccnntttcgtgagccgtgcggagaacatgtagttgctggtgccctcactaaaaaatatnnnnnattnnnntgtagctggagctcaccncggtggcggccgctctagaactagtggatcccccgggctgcaggaattcgtctcacccctagaaaaaggaggcggagagccacaggaggaggagctcgagggacgacgaccagctgaattaggactggagggggcagacgacgtcgtcgtagcggcagcagcaggagaagggaagactcaaacgagggatctccgagagaggagtgtggtaggcaggaagaaagaataaggcgagccgagagccattcgcatggaggcggcgatggatctgatgcggcggatgcgccacggagcgcggagacggcgctcaacgcgctgctctcctcctcccgacactccctcgactccctcccagtcgacctcccgctccaggtttgcttggacaccgggagcctggaaggaaccccccctatggtatatattaaccgtgatgcctaactcccgcaccaaatcccccctgggtcaaaaaaaaattatggaacccccccctttgggaaaaaaaatggggaaccatcttccccccttcttcctaaggggggaaagggaggagaaaaccttcttcggaagggtgttttgaagcgcgccccaaaacacaaaaaaaagttttctctttctccgcacaccgaggggggtgataacttcgggtgtgagacccccctcccgaactcctttcttttgaaaaaagggggggggggaaagatttccacaaaaagcctcgggnntcataaacaaccttttcttgatgggaggggctgtttaaaaaacaaatactggtgggagttatagatacagccagaggggcggccctctttctatttataaaaaaaaaagaggggcggccccaggggaatacaaaanaggggggtacctgagcgcaaatatcggtgttccactgaggggagaagatttttattacncctccacccccaccgagggggaccccgaa

SEQ ID NO: 85174 - DNA, 926 bp, Zea mays
  misc_feature: Ceres CLONE 1571428
  misc_feature: Encodes the peptide sequence at SEQ ID NO. 85175
ctccccgcggtggcggccgctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcaaccacgtcggccttgcccccggcgggggaccccttcgtggcgtgcaacgagtgcgcccttccccgtctgccggggactgcttcgattacgagcgcccgggagggcacgcaagaactgcctcccagtgcaagaactcgataccagccgccccaggggcttgccagccttgtgaccgggtgaaccagaaggagggacggccttccattgaccttgaaaaaacgagtttcaactggggagggcgcattaattcccaattctgtggggccaggttccttggtttttcgggccctatgaaacttccgggccggggggggtgaaccccaaggggcgccccccaaagtttttccgcctcaaccccccagggttccctctcctccccacaggggcaaatggggggaaaaaatcccccccgggagacccccccgcccgggggtccttttttttagggggggggggggaaaaaaagaaaaccccccccttttttggggggaccccctttttctgtggggcccccgtgttgggggcgcccccccga

SEQ ID NO: 85175 - protein, 148 aa, Zea mays
  misc_feature: Ceres CLONE 1571428
  misc_feature: SWISSPROT Homolog: EC 2.4.1.12 Cellulose synthase (UDP-forming)
MEASAGLVAGSHNRNELVVIRRDGDPGPKPPREQNGQVCQICGNHVGLAPGGGPLRGVQRVRPSPSAGDCFDYERPGGHARTASQCKNSIPAAPGACQPCDRVNQKEGRPSIDLEKTSFNWGGRINSQFCGARFLGFSGPMKLPGRGG

SEQ ID NO: 85176 - DNA, 788 bp, Zea mays
  misc_feature: Ceres CLONE 1571429
gcggtggcggccgctctagaactagtggatcccccgggctgcaggaattcgtctcacccctagaaaaaaaacgccgcgcaaatctcgccctgcgatgcaaacccccatccccaccccatcaccctcttcctccccacaccgcctataccactgtccccaacaactcctcagatcggccacgggcactcccttgatgtctctcttcctgtcttcaccctcgccctcgccgccagcaccaccaaccacatctattgcatggctccaccctcaatgacgacaagggtgtcgcggctgcaggcaatccctcgctcgtgctctctctcttcacgtctccgtcctcaccctcgtcgccaacaccaccacccacggtcgctacacggccatcctcgatgccggcaagggtgtcgcggtcgcagggcatcggcgtagccaggggccagggcggaggtgggtgcgaggaccggtcctcgctgctgctccgtgagcgaggccaattctcccgcacgctccttcgtagaggaggtcatcaccggctatgacaagaccgatctctacaagacctggcagaaacagccatggccgatggtcctgaagcagaaaggagaaaacatgcccaaatcctagatggccttttacctcttccgcgtttgatatatgtattgtatttgaaatctgtctgacaaaattccattgttcaaatttaaggtaaaggcaaatgtcccaccctttaaagggcagtttattttccttcctaccaacctggaccagatttcccgattgaatgggct

SEQ ID NO: 85177 - DNA, 986 bp, Zea mays
  misc_feature: Ceres CLONE 1571432
  misc_feature: Encodes the peptide sequence at SEQ ID NO. 85178
  misc_feature (81)..(81): n is a, c, t, g, unknown, or other
  misc_feature (89)..(89): n is a, c, t, g, unknown, or other
  misc_feature (239)..(239): n is a, c, t, g, unknown, or other
  misc_feature (860)..(860): n is a, c, t, g, unknown, or other
tatatatttttttttttcccgctgctgcgcatatcttactcgttttattcgtgttaggagtatttttttattataatccanccaccctnaatttagaactcaccgcggtggcggccgctctagaactagtggatcccccgggctgcaggaattcgtctcacccctagaaaagctcgctcctagctggggtggggagggaagaagaggacaagcatgcagcacgccaacgcgcggcgcgnagcataccgacagctccagcctccagggaacgactgaaggagtaggagaaagacaaagaacaagtgtgggaaacagacaacgagaagaccgacgagccgcgacaccgccaccgccaccccgctcctaagtcctagctcctcgtgctacaaaggaataaaccaaggccgggcccatgtccttcatctaggcgtttgtaaccgcgggccgaacaattcttccccggtcacctgccctccctccgttcccctttcctgggtccctggctccattctttccttccttggaactttctccggggccccgggccccgccccttggggggggtcccccccgcggaaaccacaccacccgcccaccctttccccggggggcccccggggggggggcgccccccccccccccggggggtgcctccccctctccgggggggcgggtgcccctcttctccccctgggcccccccggggggaaaacaaaacaccgcggggagaaggagggcgtcttaccccccgcagaggggataacttctttggggcgccccccctcctttgggccccccgggggatggtgggaacaccaagggggcccccccccccaccctcgtggggagaagtctccccnaaaaacccccccccaaaagagggggaaaacattttccccccccccgggtggggggggggcggggggcaccccctttgagaccccgggtggtgttttccccccccccccccccgggggggggaagat

SEQ ID NO: 85178 - protein, 44 aa, Zea mays
  misc_feature: Ceres CLONE 1571432
MVGTPRGPPPPPSWGEVSPKNPPPKEGENIFPPPGWGGGGGHPL

SEQ ID NO: 85179 - DNA, 777 bp, Zea mays
  misc_feature: Ceres CLONE 1571433
  misc_feature: Encodes the peptide sequence at SEQ ID NO. 85180
  misc_feature (490)..(490): n is a, c, t, g, unknown, or other
tccccgcggtggcggccgctctagaactagtggatcccccgggctgcaggaattcgtctcacccctagaaaaattattacaaccgaccaacgcgctttgcaacgcctccgctgcaatcagcccccgcggcgagattgccctgcccctgagtgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggtgcttggcttcctattcctcaccttcaactcaggcatggcgatttatcggtccaacggtgacgccggctccgtcgctttcgtcgtggtatcttatctcgacctggtggccctgttcgcctgcttgcgctactacgagcagttggatcagcagcactcccaaaagcgcgcgagggtcaaggctggggtttgnagcctcacgaccctccttactatcatgttcagttacaaggtggctgagattatgcccctgccagtcaaacttgttgtctggtcgatggcagccgctaccacctgtggcggcttctacgctttcttcgtccacagcgagaagcctgtcatgccagcggcggcgccacggcccgccgcggccaaggatgcagcctccaactaggttcgtttgcccacacaaggcgcatactgccgggccttgttcggcaccgcgcgttagatcccagggccaaactaggttgttctcta

SEQ ID NO: 85180 - protein, 138 aa, Zea mays
  misc_feature: Ceres CLONE 1571433
  misc_feature (72)..(72): Xaa is any aa, unknown, or other
MADFSWLTVLGFLFLTFNSGMAIYRSNGDAGSVAFVVVSYLDLVALFACLRYYEQLDQQHSQKRARVKAGVXSLTTLLTIMFSYKVAEIMPLPVKLVVWSMAAATTCGGFYAFFVHSEKPVMPAAAPRPAAAKDAASN

SEQ ID NO: 85181 - DNA, 785 bp, Zea mays
  misc_feature: Ceres CLONE 1571434
  misc_feature: Translation starting site: 137
acccgcggtggcggccgctctagaactagtggatcccccgggctgcaggaattcgtctcacccctagaaaaaccttggtgatcggtttccatggcaagttaagtcagctatcctatcaaccctgacaatcatcatcatgaaaggtggaattgcacttaagcccttccttccacaacttcaaactacatttgtaaaatgtctacaggataataataggtctgtccgggcgagggctgcagctgctctgggaaagcttagtgctctcagcacacgggtggatcctttagttagcgatcttctgtccatgttgcagtcaggagatgaatctgtcaaagagagtgtgctttctgcgcttaaaggtgttatcaaacatgctggtaaaagtgtcagctctgcaataaggtcacgttggatgtgctctttcttgagatctgctgcaagctgaagctgatgatgtccgcagttgtgctgcaaaagtgattggcacattgtctcagtacctggaggaaacagagatttcagatttggtgccaatccctattgaacatgagcacttcttccagactggtgtcccagacatggtgcctttgttatcctttctcatacatatcaatgcattccccaatcaaaaattgtggcctttttggcatccctttcccatcccctggggcgaaaccttttggaaaaggttccctccaaaaaacaacaagttttcccccgttccgggaaaatttgcctacacaaaaaccccttggagaaaaaaaaacccctttttttggaaccct

SEQ ID NO: 85182 - DNA, 768 bp, Zea mays
  misc_feature: Ceres CLONE 1571435
  misc_feature: Encodes the peptide sequence at SEQ ID NO. 85183
  misc_feature (559)..(559): n is a, c, t, g, unknown, or other
  misc_feature (568)..(568): n is a, c, t, g, unknown, or other
  misc_feature (605)..(605): n is a, c, t, g, unknown, or other
  misc_feature (606)..(606): n is a, c, t, g, unknown, or other
  misc_feature (627)..(627): n is a, c, t, g, unknown, or other
tggagctccccgcggtggcggccgctctagaactagtggatcccccgggctgcaggaattcgtctcacccctagaaaaatccccccgccacgacccctcagccctcacacaagagacgcagctgcgagtccgccagccttatcctcctccccgtcttcggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccanctctgtggntcttgctcaggggctgatcgctgaagggtgttaaggnntgtgcagctggtgctaatccntgtcagataactcctggtatcgagaaaacgcgaaagcactagttgaagaactacggaagttgtcttaagaagtccaaaaatatgaactttgcaatgttgctgctgttaatggcgggcaacaactccaaaatgggtaattgg

SEQ ID NO: 85183 - protein, 138 aa, Zea mays
  misc_feature: Ceres CLONE 1571435
  misc_feature (125)..(125): Xaa is any aa, unknown, or other
  misc_feature (128)..(128): Xaa is any aa, unknown, or other
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTXSVXLAQGLIAEGC

SEQ ID NO: 85184 - DNA, 1010 bp, Zea mays
  misc_feature: Ceres CLONE 1571436
  misc_feature: Encodes the peptide sequence at SEQ ID NO. 85185
ctggagctccccgcggtggcggccgctctagaactagtggatcccccgggctgcaggaattcgtctcacccctagaaaaaaaaaaaaaataagagacgagtcgagtgagggggcagaggccacaaaacagagagtacccaaacgatcgatctgtgcatctccccgtccgtcccgcaaccatctaattcagaagcagacatcaatggcgagcaacggctgcaacggcaacggcaacggcaacggcaacggcaaggcggctccggcgggtgtggtggtaccggagatcaagttcaccaagctcttcatcaacggcgagttcgtcgacgccgcctccggcaagacattcgataccagggacccacggaccggcgacgtgctggcccacgtagcagaggcagacaaagctgatgtggacctggcggtgaagtccgcccgggacgccttcgagcacggcaagtggccccgcatgtcaggctacgagcgcgggcggatcatgagcaagctggcggacctggtggagcagcacacggaggagctggcggcgctggacggtgccgacgccgggaagctgctgctgctgggcaagatcatcgacatccccgcggccacgcagatgctgcgctactacgccggcggcgccgacatagatccacggcgacttcctgcgcgtctccggcaggtaccagtgctacacgctcaaagagcctatcggcgtcgtgggcgtcatcatcccccttggaacttcccaccatgatgttcttcctcaaggtcagccccggggctcggcgcgggcttgcaccgtcttcgtcaagccccgccaaggaagaacccgctttcccgcgcctctactacgcgcaccctcgaaaagaatggccgggcgtcccccgacggagtgtaccaagttgtcccccggggttggggcccaacgggcgggggccgggtttggccttccaaatggtaaatccaaacaggttgggcttctcacggggtccccaagtaggtggggtggg

SEQ ID NO: 85185 - protein, 183 aa, Zea mays
  misc_feature: Ceres CLONE 1571436
  misc_feature: SWISSPROT Homolog: EC 1.2.1.3 Aldehyde dehydrogenase (NAD(+))
MASNGCNGNGNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGGADIDPRRLPARLRQVPVLHAQRAYRRRGRHHPPWNFPP

SEQ ID NO: 85186 - DNA, 749 bp, Zea mays
  misc_feature: Ceres CLONE 1571439
  misc_feature (593)..(593): n is a, c, t, g, unknown, or other
  misc_feature (597)..(597): n is a, c, t, g, unknown, or other
  misc_feature (631)..(631): n is a, c, t, g, unknown, or other
acccgcggtggcggccgctctagaactagtggatcccccgggctgcaggaattcgtctcacccctagaaaaactaatcaatcagtcggtcgccgccgtccgcccgtccgctcagccggccgagcgctcgagcctcctccgtcccgctcccgcccgtccgccgagcgccgacggcccgagcagccagcaccgcccagcaggcgagccgctccgcctccgcgcctctatccgccgtccgctcgtcccgaggccgcgagccgctccgcggctacgaccctccgcccgccgtctgcccgtccagcgagcgcccgacggcccgagcagcggagcaggcgagcagctccgcgcctccggccttcgcccgccgtccgctcgggctcggaccgagccgctccgcccaccgtccgccgagcgcctgacggcccgagcaggcgagcagctccgcgcctccgcccgccgtccgctcggcccgagcagctcactcgctcagccgcagagccgctgtgccttccacttccaggcggacaccaccgtgtcgcccccgcgtcctaaacctctcacttcgccgggggtcgggtagcggcgaacgatgcntcgncgcgcgctcctctcctccggtctccccactccangggaacggtacgaatcccgagcccccagctaactctcctatccaagccccttctcgctccaagggagcagggtacgccctccggggggtctcaatcctcgggcccccggcggccgccc

SEQ ID NO: 85187 - DNA, 812 bp, Zea mays
  misc_feature: Ceres CLONE 1571440
  misc_feature: Encodes the peptide sequence at SEQ ID NO. 85188
ctccccgcggtggcggccgctctagaactagtggatcccccgggctgcaggaattcgtctcacccctagaaaaaatgccctccactgcagcctgcaccacacggcccctggcactgccaacctcgtcgcccacccaagtctcttcatttgcagcgacaaaaataggaacggagcaaaggtccggcgagccagagcaatagttaacaaccatctccacaaacaggctaccacgtagctacgtatatgccggaactgaactgagctgagaaagctcaggcgtgaactgaactagatggtgtttcctgccatcctccccaaggtggccgtgcgattgctcttcacgttctaccgcgccgccaggaagctcaggcgccacgccttcaagctctacagaccgtaggaccgccgccaagccgccttcgttctccgtctcacagcagcaggccggtgccgccaccttcaagaccgacgccgccatccctgacaccgccagccggaccatcgtctgtgacgtgcacagagccctggtggactcctccgcgctcttacactacttcatgggcgtggcatacgagggcggcagccttctgcgcgccatgctgctgctctgcgcattccctctcgtctgggcactcggggagcgcagcggcggcactggcgccgtccgtgtgatggcgttcgtcaccttcgcggggatctagcccagggaccatggacatcttgaaacatcgccgatcctgcccaagctctacattgtagcagctcaacgcccctggtgtactgggggcccgtggctccccggcccagagaag

SEQ ID NO: 85188 - protein, 47 aa, Zea mays
  misc_feature: Ceres CLONE 1571440
  misc_feature: SWISSPROT Homolog: EC 2.3.1.15 Glycerol-3-phosphate O-acyltransferase
MGVAYEGGSLLRAMLLLCAFPLVWALGERSGGTGAVRVMAFVTFAGI

SEQ ID NO: 85189 - DNA, 816 bp, Zea mays
  misc_feature: Ceres CLONE 1571441
  misc_feature: Encodes the peptide sequence at SEQ ID NO. 85190
gcggtggcggccgctctagaactagtggatcccccgggctgcaggaattcgtctcacccctagaaaaaaaactcacaacacggtagcagggggtggtagtagaaggcataagctctgttctctgaccctcaagtgtttgagcctatttgcgcaacgaaaaaatgagcatcaaaagcattaatggaaagagccccatagtggttggaccttggggagggacaggagggtacccttgggatgacggcgtgtactcaacaatacgccagatcgtgattggccatggtgcagctattgactcaataaggattgaatatgatctgaaaggaaggtcggtttggtcagaaacgcatggaggtactgatggtggctccgaaacagataaggtgaaactagattttccagatgaagtcctcgtgtctgtaagtggacactacggatctgtctgcgggacaccggtcatcataagatcgttgacgtttcagagcaacagctcgacgtacggacccttcggcaccgaggatggcacacctttctcactcccagttagcagtggcaagatcattggattccacgggcggtctgggtcgtatctcaactcaatcggtttctacctgaagcaggtgcattttccaactccagtgaatccttctccagcttcacctctgagcctcccgagtccacaaagtagaaacagcgcctatggcctcaccgggtggcgacgctagacctgacatgtttctcgccgtgcgagacagaagagacagctatgctgtctacgcgagcaatcaccccaaacagcagtacacaaacccggtt

SEQ ID NO: 85190 - protein, 187 aa, Zea mays
  misc_feature: Ceres CLONE 1571441
  misc_feature (22)..(153): Pfam Name: Jacalin Pfam Description: Jacalin-like lectin domain
MSIKSINGKSPIVVGPWGGTGGYPWDDGVYSTIRQIVIGHGAAIDSIRIEYDLKGRSVWSETHGGTDGGSETDKVKLDFPDEVLVSVSGHYGSVCGTPVIIRSLTFQSNSSTYGPFGTEDGTPFSLPVSSGKIIGFHGRSGSYLNSIGFYLKQVHFPTPVNPSPASPLSLPSPQSRNSAYGLTGWRR

SEQ ID NO: 85191 - DNA, 799 bp, Zea mays
  misc_feature: Ceres CLONE 1571443
  misc_feature: Encodes the peptide sequence at SEQ ID NO. 85192
  misc_feature (382)..(382): n is a, c, t, g, unknown, or other
  misc_feature (673)..(673): n is a, c, t, g, unknown, or other
  misc_feature (713)..(713): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (747)..(747): n is a, c, t, g, unknown, or other
tcaccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgaaagcgcctcatcggagatgcgggcccaaagacccaaggtcgccnattgaaaacccccattcaacaaccgtcttttgaagccccagccgtcttcatttggccagggaggggtttagggggaagcccccccggttccccaaaggggggatttttttaagagcggtggggggccccccctctttaaggaggggggttttttttctcttgtggggcgccccccccggggggggaaaaaaaccccccccccccccgaggggggggttttttttttttcctcccccccccccccccacaaagggggggggggggggggggaggggaaaaagaaaaaaacanttttttttttttttttttttcttttcccccgccccccccncaaaaaaataaataagaaannnnnnacacacccnccccccaaaacacccccaccccccgcgggggcggggggtgaaaacagaaaca

SEQ ID NO: 85192 - protein, 65 aa, Zea mays
  misc_feature: Ceres CLONE 1571443
MAGKGDGPAIGIDLGTTYSCVGVWQHDRVEIIANDQGNRTTPSYVAFTDSESASSEMRAQRPKVA

SEQ ID NO: 85193 - DNA, 874 bp, Zea mays
  misc_feature: Ceres CLONE 1571444
  misc_feature: Encodes the peptide sequence at SEQ ID NO. 85194
tccccgcggtggcggccgctctagaactagtggatcccccgggctgcaggaattcgtctcacccctagaaaaaatgccctccactgcagcctgcaccacacggcccctggcactgcagacctcgtcgcccacccaagtcgcttcatttgcagcgacaaaaataggaacggagcaaaggtccggcgagccagagcaatagttaacaaccatctccacaaacaggctaccacgtacctacgtatatgccggaactgaactgagctgagaaagctcaggcgtgaactgaactagatggtgtttcctgccatcctccccaaggtggccgtgcgattgctcttcacgttctaccgcgccgccaggaagctcaggcgccacgccttccagctctacaaccgtacgaccgcccccaagccgccttcgttctccgtctccaaacagcaggccggtgccgcaaccttcaagaccgacgccgccatccctgacaccgccagccggaccgtcctgtgtgaacgtcacggagccctgctgcactcctcccggcgcttcccctacttaatgggtcgtgggcctgcggagggcagccacccttctgcgcggccatggggcttgatctgcagcagttccccttctcggcgggggacaaccgggggaacaccaccggctggcacatggcccccgtcccgggtgaatagagtttcataaacctttgcggggggttcttgggccaggggacatgggaacttggtggggacaaagcccatccttgccccaagacttctacgtggttagcggcttgaaacacccctggtggatactgggaacacctttgggtctcccgggtcatggaagaaaagagtgggggggttaaaccagg

SEQ ID NO: 85194 - protein, 30 aa, Zea mays
  misc_feature: Ceres CLONE 1571444
MGLDLQQFPFSAGDNRGNTTGWHMAPVPGE

SEQ ID NO: 85195 - DNA, 857 bp, Zea mays
  misc_feature: Ceres CLONE 1571445
  misc_feature: Encodes the peptide sequence at SEQ ID NO. 85196
ctcaccgcggtggcggccgctctagaactagtggatcccccgggctgcaggaattcgtctcacccctagaaaaactccacgcagctccactccacgggctagcagcagcagcagcttccccatgcatgcaatggcgtggtggggcggcgaggagggcgagccgttattcccgtccgtggacaagtgcgacgcgtcccgcctcggtcgggactccacgctggtggcggacctggacggcgcgctgctccgctccccggacgccttcccctactacgcgctcgtcgccttcgagacgggcggcgcggcgcgcctggcgctgctgctgctgctggcgccgctggccgcggcgctgcgccgcgcggtgtcagagtccgcgggggagcgggtgctggtgttcccgggcacggcgggcgcgcgcgtcgcctacgtcgagtccgcgggcgcgcgccgtgctgcccaggttctaaccccgcctagtgcgcccgggacccctggcccgtcttctccccttgccggggggcgaaagctggtgcctccccccccccccccgggtcatgggccaaaccctttccttgggggggtacccttggggccaaaaccctttccccgggaaggaattttccccggggggggggggacccccccccggggggggggggaaccccccccccggggggggggtgtttctttggggaaaaaaaagggccccggcgctctgcgcaaaaaatcccccaccccccggggagggggccccccaattttggggcgctcccccccccggaaaataccgaaaattccccccccttgtgggatttttccgcgaggggttcccccccccctttttttttttctccccc

SEQ ID NO: 85196 - protein, 245 aa, Zea mays
  misc_feature: Ceres CLONE 1571445
  misc_feature: SWISSPROT Homolog: EC 2.3.1.15 Glycerol-3-phosphate O-acyltransferase
MHAMAWWGGEEGEPLFPSVDKCDASRLGRDSTLVADLDGALLRSPDAFPYYALVAFETGGAARLALLLLLAPLAAALRRAVSESAGERVLVFPGTAGARVAYVESAGARRAAQVLTPPSAPGTPGPSSPLAGGRKLVPPPPPPGHGPNPFLGGVPLGPKPFPREGIFPGGGGTPPRGGGEPPPRGGGVSLGKKKGPGALRKKSPTPRGGGPPILGRSPPRKIPKIPPPCGIFPRGVPPPLFFFLP

SEQ ID NO: 85197 - DNA, 883 bp, Zea mays
  misc_feature: Ceres CLONE 1571446
  misc_feature: Encodes the peptide sequence at SEQ ID NO. 85198
  misc_feature (327)..(327): n is a, c, t, g, unknown, or other
ctcaccgcggtggcggccgctctagaactagtggatcccccgggctgcaggaattcgtctcacccctagaaaaagttcggacttccgccgcgcttcgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaacggctctcacttactgacatncagattgacatcaaacgcgtttcccaagaaagtcaaaccctgattcaagggctattggaaggaacctttaattgttcaaaaacccaaagtgggggaaaacccgcttccttgggggccaaaaaaccttaatttgtcccaaaaaagggaggggctgccccccactgggcacttttaaaggggttcaaaggggccttgctgggcaagagaataaaaaaagggggggggtggctttcttggggaaaaaaattctcccccaaaactttaaaaagagggcgcctcccgggggtttaaaagccccctttttggggggaggggggcgggggtaaatttttttggggggttccgcgggggccaccccccacattttttttttttttggggggggtgcccacaacccccgcaacaatatttagaaaaaaattgtttttccggggggggggcccccccctcttttatacacactcttcttcaaaaaaaaaaagggtgggggggggcgccccccccgaaaaatattttttggcggggggggcgggggggttttttttataacaatcct

SEQ ID NO: 85198 - protein, 71 aa, Zea mays
  misc_feature: Ceres CLONE 1571446
  misc_feature (58)..(58): Xaa is any aa, unknown, or other
MPFKRFVEIGRVALVNYGKDYGRLVVIVDVVDQNRALVDAPDMVRCQINFNGSHLLTXRLTSNAFPKKVKP

SEQ ID NO: 85199 - DNA, 837 bp, Zea mays
  misc_feature: Ceres CLONE 1571447
  misc_feature: Encodes the peptide sequence at SEQ ID NO. 85200
  misc_feature (504)..(504): n is a, c, t, g, unknown, or other
  misc_feature (506)..(506): n is a, c, t, g, unknown, or other
  misc_feature (519)..(519): n is a, c, t, g, unknown, or other
  misc_feature (522)..(522): n is a, c, t, g, unknown, or other
  misc_feature (525)..(525): n is a, c, t, g, unknown, or other
  misc_feature (528)..(528): n is a, c, t, g, unknown, or other
ccccgcggtggcggccgctctagaactagtggatcccccgggctgcaggaattcgtctcacccctagaaaaaacatctcctacggccaagacccgtggacactagtgggcaagaaagcaaccacggaaccaccgaagagacccaccggaaactcctacagccctaagcacacagcgtagcgggacccacaagtcagccaaacgtctcaagctcgccatttcgcctccgtttccaactcccagtgccggtcttccactcctcccttcttcgcctcccaatttccaaacctctctcttgggagcacgtacacgcggaggaaaagcgatcggccccgcggcggcaagatgactgcggcggcgacgatgacgtggcacgaggacctggccactctcgtgggggacacggacgttcacctcacaggcgccggggggcacacgccggcgccggcgaatgttgcggcggcgggggccggggtggtacggggaggaggaagagtgaggcgangnaaagggttgggcncancangcnaaaggggtcgccggagtccacggcggaaatgctgcgggaactggggcggggggctgtggaattccccccccaaagcctcccccgggcccaaggaaaccagaccttggggggcggcttcgagaaacgggcgggcggccccgggggaagcgcctcaccttccttaaaaaaaatactttcccaaagagacgcgcacccgggaaaggggtgtgggtttattttgcccccaagaccctattttgcacagcccctcaaattttgtggggcgggggggaggggcaaaaaaaaccccccgagaaagctctccacaaa

SEQ ID NO: 85200 - protein, 115 aa, Zea mays
  misc_feature: Ceres CLONE 1571447
  misc_feature (54)..(54): Xaa is any aa, unknown, or other
  misc_feature (59)..(59): Xaa is any aa, unknown, or other
  misc_feature (60)..(60): Xaa is any aa, unknown, or other
  misc_feature (61)..(61): Xaa is any aa, unknown, or other
  misc_feature (62)..(62): Xaa is any aa, unknown, or other
MTAAATMTWHEDLATLVGDTDVHLTGAGGHTPAPANVAAAGAGVVRGGGRVRRXKGLGXXXXRGRRSPRRKCCGNWGGGLWNSPPKASPGPKETRPWGAASRNGRAAPGEAPHLP

SEQ ID NO: 85201 - DNA, 713 bp, Zea mays
  misc_feature: Ceres CLONE 1571448
tccccgcggtggcggccgctctagaactagtggatcccccgggctgcaggaattcgtctcacccctagaaaaactacttccttagctaacttcccagccccgacaccttggccgccgctccgtgcgcacccagttgctgaggttgcaacgctgcagccggcgaggatcggatgaaccaccaacccctcctataaatcctaaccgagtcctctgcttctgctctcatccatctgtagagtgcaacatgcagtgccccatggacactgctgctagtggaacctcgccagtgatgcaaattccatagcaatgcctgatggagtctattcgcccattccatctcccattgggcaaacattaaataccaacgttttcaaagcggcccattggctatggggggatgggattcccccagggggaaattttccccccctttgtgtgggggtgaccccccccccccccccccctttttgttgtctcccccccccagggggggggcccccccccccaccaaaaaaattttttttttgggggggtggggtagattataatatagggggggggcgcccccacaaaaaaaaaaaaaaaaaataatttttctcccccccccccccacccatgatggttgggggggggggggggggacctgtccccccccccccggggggtgagatgggtatattttttttttcttgttttctttgtctgtctagcaa

SEQ ID NO: 85202 - DNA, 789 bp, Zea mays
  misc_feature: Ceres CLONE 1571449
  misc_feature: Encodes the peptide sequence at SEQ ID NO. 85203
ctccccgcggtggcggccgctctagaactagtggatcccccgggctgcaggaattcgtctcacccctagaaaaactctctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctagacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggccagttcggcgtcggtttctactctgcctacctcgtcgccgatagagttgtcgtgaccaccaagcacaacgatgacgagcagtacgtgtgggagtccaagcgggcgggtcgttcactgttactcgtgacacgtcaggggagcagcttggcaggggcactaagatcacactgttcccttaagacgatcagctggagtaccttgaagagcgtcgccctcaggatctggtcaaaaagcactctgaggtcataagctaccccatctcccctgtgaactgaaagacaacaa

SEQ ID NO: 85203 - protein, 202 aa, Zea mays
  misc_feature: Ceres CLONE 1571449
  misc_feature (28)..(166): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESKRAGRSLLLVTRQGSSLAGALRSHCSLKTISWSTLKSVALRIWSKSTLRS

SEQ ID NO: 85204 - DNA, 846 bp, Zea mays
  misc_feature: Ceres CLONE 1571450
  misc_feature: Encodes the peptide sequence at SEQ ID NO. 85205
  misc_feature (322)..(322): n is a, c, t, g, unknown, or other
ctcaccgcggtggcggccgctctagaactagtggatcccccgggctgcaggaattcgtctcacccctagaaaaatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaagtgatgatgnctttcacgccttcttcagtgagactggtgctggggagcacgtgccccgtgctgtttttgttgaccttgaacccactgtcaccgatgaggtgaagactgggacctaccgccagctcctccacccctgagcagttcatcagtgggaaggaggatgcagccaaaaactttgccccggggcacctacccctttaacaaggagaattggtgtaccctgtggccttgaacccattaagaaaatttgcccaaaaaaagggaaggggtttccagggggtcccccgggttttaaaaaattttgggggggagaaaaggggtcctgggccttggtttccccccccccaaaaaaacccccggctttttttcctccgggaaaaaaaacccccgccgggggggccaccggggagcccccccccccccccaaagtttccccctctggggggtgggggacccaaaaaaaaaggtgtggtggggccccccccctccctccctccgaaaaaaacaagaaggggggcgtaaaaccgcggggga

SEQ ID NO: 85205 - protein, 89 aa, Zea mays
  misc_feature: Ceres CLONE 1571450
  misc_feature (48)..(48): Xaa is any aa, unknown, or other
MRECISIHIGQAGIQVGNACWELYCLEHGIQADGQMPGDKTIGGSDDXFHAFFSETGAGEHVPRAVFVDLEPTVTDEVKTGTYRQLLHP

SEQ ID NO: 85206 - DNA, 943 bp, Zea mays
  misc_feature: Ceres CLONE 1571451
  misc_feature: Encodes the peptide sequence at SEQ ID NO. 85207
  misc_feature (778)..(778): n is a, c, t, g, unknown, or other
  misc_feature (785)..(785): n is a, c, t, g, unknown, or other
  misc_feature (789)..(789): n is a, c, t, g, unknown, or other
ctccccgcggtggcggccgctctagaactagtggatcccccgggctgcaggaattcgtctcacccctagaaaaagcgcaccgtccctcaccgccggcctctgctcctcttccgccgccgcaggatctcgtatcgccggagaccatgtaccgcgccgccgggagccacctccgctccctcaagcatcatggtgcttctaggcttgccagtacaagtgttgcgaagcagtcctcaggtggtctgttcagctggcttcttggtggaaaatcaagcgaactccctccccttgatgttccactcccaggcattagcattccctcacctctaccagattttgtagagccatctaagacaaaagtcactactcttccaaatggcgtcaagatcgcctcggagacatcatcgagcccagcagcatctgtgggtctgtacattgactgtggttccatttacgaaacacctgcttcatctggagtatcacatctgttggagagaatggccttcaagagcacagtgaatcggactcacttacggttagttcgtgaggtagaagccattggaggaaatgtctctgcatcagcttcccgtgaacaaatgagctatacctatgatgcattgaagagctatacaccagaaatggttgaaagtctcattgacagtgtgaggaatccagcattcctcgattgggaggtcaaagagcagctcccagacataaaatctgaaatagctgatgcgtctgctaatcctcaaggtctacttctggaagcccctcatttcgntggatantccngggcactggcaaaactttgatgggctcagatctgctgtaaacggttggatgtaagcagcttggaggaatttgttgctgaacataccctgctccaggatggtcttgcagcatcaggagtgatcatgatgcgctgattcaagtgtaaacccctccg

SEQ ID NO: 85207 - protein, 221 aa, Zea mays
  misc_feature: Ceres CLONE 1571451
  misc_feature (80)..(210): Pfam Name: Peptidase_M16 Pfam Description: Insulinase (Peptidase family M16)
  misc_feature: SWISSPROT Homolog: EC 3.4.24.64 Mitochondrial processing peptidase
  misc_feature (212)..(212): Xaa is any aa, unknown, or other
  misc_feature (214)..(214): Xaa is any aa, unknown, or other
  misc_feature (216)..(216): Xaa is any aa, unknown, or other
MYRAAGSHLRSLKHHGASRLASTSVAKQSSGGLFSWLLGGKSSELPPLDVPLPGISIPSPLPDFVEPSKTKVTTLPNGVKIASETSSSPAASVGLYIDCGSIYETPASSGVSHLLERMAFKSTVNRTHLRLVREVEAIGGNVSASASREQMSYTYDALKSYTPEMVESLIDSVRNPAFLDWEVKEQLPDIKSEIADASANPQGLLLEAPHFXGXSXALAKL

SEQ ID NO: 85208 - DNA, 793 bp, Zea mays
  misc_feature: Ceres CLONE 1571454
  misc_feature: Translation starting site: 532
  misc_feature: SWISSPROT Homolog: EC 3.4.23.5 Cathepsin D
  misc_feature: SWISSPROT Homolog: EC 3.4.23.34 Cathepsin E
  misc_feature (290)..(290): n is a, c, t, g, unknown, or other
  misc_feature (307)..(307): n is a, c, t, g, unknown, or other
  misc_feature (337)..(337): n is a, c, t, g, unknown, or other
  misc_feature (541)..(541): n is a, c, t, g, unknown, or other
  misc_feature (627)..(627): n is a, c, t, g, unknown, or other
  misc_feature (653)..(653): n is a, c, t, g, unknown, or other
  misc_feature (786)..(786): n is a, c, t, g, unknown, or other
ggagctccccgcggtggcggccgctctagaactagtggatcccccgggctgcaggaattcgtctcacccctagaaaaacttggccactcttcttcctcctcatcaatccgctctccagcacttgttcggaagaaaagaagtagaacacgctaacaagacaacaaggatcatggggcgcgggcgcggccacctcctgctgccggcagcagccgcctgcctgtgggcgctgtcgtgcgcgctgctgctgcccgcgtcccctcaccgcgctggcgccagcgccggcgggctgnctgagggtcgggctcancaagcgcggcggcgggctcgaccagcgcgncgctggcggcggccaaagccgcgaggcagcaggaaggcaagccgtctccggggctccagcggcggcgacgtccttctccgtcgactacctcaaaaccagtacttatcggggtcgtcgcatcggcacaccgccgcagaacttcaccgtcatcttcgacaccggcagctccaaccctctggggtccccccctccagatgctacttnctcgaattgcctgctacctgcaccacagatacaagtcggccaggtctagcacgtacaaggcggacggcgagacctgcagatcaccntacgttccggctcggatcgccggttnctcagcgacgacgacgtgctggtcgggggactgaccgtcaaaaccagaagtcatcgagacacgcgccgaagcagcgtaacgtcataatcggcagttcacggcatcctcgtctcggatacccgagatctcgtcngcaggcc

SEQ ID NO: 85209 - DNA, 953 bp, Zea mays
  misc_feature: Ceres CLONE 1571457
  misc_feature: Encodes the peptide sequence at SEQ ID NO. 85210
  misc_feature (708)..(708): n is a, c, t, g, unknown, or other
  misc_feature (722)..(722): n is a, c, t, g, unknown, or other
  misc_feature (869)..(869): n is a, c, t, g, unknown, or other
  misc_feature (953)..(953): n is a, c, t, g, unknown, or other
gcggtggcggccgctctagaactagtggatcccccgggctgcaggaattcgtctcacccctagaaaaaatgctactgctaaaatccccctcacactcacacccctctcctaatcatccgcttaaacccacgagcccggcaggcaagcagcccggtgccgatggactcctcgggctccgcctccgcctcgtcctacaagctgcagctcgccctcgcggcactcgttggcgcctccgccgccgcttcagcggcctactacctgcactgccgtgccgtcgcgcaggttgctcgctccgcctccacgagccgccgtaggccccgcgcccccgcctccgccgctagcggcggcagcggcggcgtgaagctccctccaccgcgccgcgctgccgtcggctcagcctcgcttcccgacctctctgcgttctatgatgtcggcagccgcggcggcggcgggctcgccgccggcgggtacctcgtggaggaggaggaggacgacgatgcggatggggtcgtgggcccgcacgtgaacggtggcgcgctcgaccccgcggagttccttcagataccccagggcttgcctagactgcacgtgggccccgacggcagtaaacaacttgcccggtcaggttcaaatagacgggttgaaataattagacctaagtcacccaagtcccctgctgccagtgcaagtgaagatggatcagatgangatgattctatacnaagtagtggtaaacttgacaatggctacatggacacaagtggaaacctgggaggagaacacaaaggaaaatgcaattgtggaaaatggggggctgcaagcattagctgcagcaaacttgatacggtcacgcagtaaatccataatcntcatggcagtcaacctgacccagttgctgcagatattctacgaaaagaacctcacgcagatcattggtcaagctgctaactacn

SEQ ID NO: 85210 - protein, 232 aa, Zea mays
  misc_feature: Ceres CLONE 1571457
  misc_feature (183)..(183): Xaa is any aa, unknown, or other
  misc_feature (188)..(188): Xaa is any aa, unknown, or other
MDSSGSASASSYKLQLALAALVGASAAASAAYYLHCRAVAQVARSASTSRRRPRAPASAASGGSGGVKLPPPRRAAVGSASLPDLSAFYDVGSRGGGGLAAGGYLVEEEEDDDADGVVGPHVNGGALDPAEFLQIPQGLPRLHVGPDGSKQLARSGSNRRVEIIRPKSPKSPAASASEDGSDXDDSIXSSGKLDNGYMDTSGNLGGEHKGKCNCGKWGAASISCSKLDTVTQ

SEQ ID NO: 85211 - DNA, 744 bp, Zea mays
  misc_feature: Ceres CLONE 1571460
  misc_feature (187)..(187): n is a, c, t, g, unknown, or other
  misc_feature (202)..(202): n is a, c, t, g, unknown, or other
  misc_feature (203)..(203): n is a, c, t, g, unknown, or other
  misc_feature (215)..(215): n is a, c, t, g, unknown, or other
  misc_feature (216)..(216): n is a, c, t, g, unknown, or other
ctccaccgcggtggcggccgctctagaactagtggatcccccgggctgcaggaattcgtctcacccctagaaaaagaaccctcgcgccgccgcctactccagcctccagcgtgatctgagtcctgaccaagccctaaacgccaccgccctcgcaaatctcctttcccttcgatccatgagccgccgnccgtcgtccgccccnncgcgccatcccnngcaagacgggagaaacctacaccgacacctatagcgccgcgacgaacgtgggcgcgggcgccaaacaatcgccccgctgggcgcgcgcccggtcgccccgaacggcccggtggcgccaacccttccggctgggggccccccccgggggggcattggggaataaaagaaaggaaatccgcctttttcgggggggggaaacccaaaggggctcccaggggggagggggggccttttttttttcccccccccaaaaaagaaaaagggggggggggcccccccccacaattttcccctttttttctccccccccaccaaatagggagggggggccctcctcccccccttcccccaaaagaaaccccccccccccccgccgggggggggggggaaaaaaaattgtgttctctctccctccccccccccaaaagaaagatttttttttttttttttcccccggggggtgttttcctcccccccaaaggagagggaaagaaaaaacccccccccccccccccgccccgctggggt

SEQ ID NO: 85212 - DNA, 932 bp, Zea mays
  misc_feature: Ceres CLONE 1571462
  misc_feature: SWISSPROT Homolog: EC 4.1.1.49 Phosphoenolpyruvate carboxykinase (ATP)
  misc_feature (344)..(344): n is a, c, t, g, unknown, or other
  misc_feature (345)..(345): n is a, c, t, g, unknown, or other
  misc_feature (822)..(822): n is a, c, t, g, unknown, or other
  misc_feature (907)..(907): n is a, c, t, g, unknown, or other
ctccccgcggtggcggccgctctagaactagtggatcccccgggctgcaggaattcgtctcacccctagcaaaaatcccatccaaggtgatccgatcactcccggtaccgttctcccggccaaccctcgatgtccttcttcccccctaccccctcgatcggccgagctggcgacgccgaacgggcttgcgcggatcgagacgaccgggaagaagaacgcaggacaacggcgtgtggtacgacgacagctcggcgccggtgcgcgcgcagaccatcgacgagctgcgctcgctgcagcggaagcggtcggcgcccagcacgcccaagcggtcggcgcccaccacnnccatcaagggcggtgccctgctcgcccttcgccgtcgcgatctccgaggagcaccccacacgcagcagatgcagtccatcagtgcggcgttggcgtctctgacgcgtgcaaccgggccgaaagtggtcaagggcgacccggccgcgaagggcgaggccgccgcgcagggcgcgccatcgacgccgagggcgcaccagcagcaccgccaccccgccgccccctccatcggccgtcagcgacagctccctcaagttcactcatgtgctcaacaacctctcgcctgctgagctgtacgagcaggccatcaagtacgagaaagggtcgttcatcacgtccaccggcgcgctggcgacgctgtccggtgccaagaccgggcggtctcccagggacaagcgcgtcgtctaggtacaaggccccgcccaagaccctgggtgggggcaagggccgccccacatcgaagtggaccataagatcttnctgatcaacagggagagggccctccactactcacccccccggaaaaggggttcccaaccacccttccccctcctgggcccggaanacccgatcaggtccacaccgccccc

SEQ ID NO: 85213 - DNA, 799 bp, Zea mays
  misc_feature: Ceres CLONE 1571463
  misc_feature: Encodes the peptide sequence at SEQ ID NO. 85214
  misc_feature (512)..(512): n is a, c, t, g, unknown, or other
ggagctccccgcggtggcggccgctctagaactagtggatcccccgggctgcaggaattcgtctcacccctagaaaaagcactcttgggttcttgcatcccgcataccctcgaaagctcgaaagatcccgcggcgcagcagccacccttctctcctctccgctcccaatcttatcgtcgcctccctcgaagtcgccgctgccttcattccaccatggcgcttcacgccccggtcctcgtgatgaaggactcgctgaagcgggagtctggcgcgaaggttcaccaagctaacatccaggcggccaaggctgttgctgacatcattcgcaccacattgggtcccagatccatgctgaaaatgcttctggacgctggtggaggtattgtggttactaatgatgggtaatctattttgagggaaatagacatcgcacaccctgctgccaagtctatgattgaactaagtcgtacacaagatgaagaaagtgggtgatggcactacatctgtcattngttctagcctggaaagatgctacaacgttgcacgggcatttcatgacaaagaactaccaaccctactgttaatttggcgaagcatacacccaaaacacttggaaggaggccaattggcggaacttgagaaaaaattgcaatgccccgtttaaggggaaaatgaacccggggcgaaaggcttagggccttgtgaaaaaagtctccctttgggcacaaaaattccacggccccaagttttgggggaaacctttttggggggaaacctcgggcacatgggagggccccct

SEQ ID NO: 85214 - protein, 63 aa, Zea mays
  misc_feature: Ceres CLONE 1571463
MALHAPVLVMKDSLKRESGAKVHQANIQAAKAVADIIRTTLGPRSMLKMLLDAGGGIVVTNDG

SEQ ID NO: 85215 - DNA, 776 bp, Zea mays
  misc_feature: Ceres CLONE 1571468
  misc_feature: Encodes the peptide sequence at SEQ ID NO. 85216
ctccccgcggtggcggccgctctagaactagtggatcccccgggctgcaggaattcgtctcatcccccctagaaaaaaccgactcacactcacacagcaaataccccacaaggccactccaaagagctagtagtggaaccgaagatgttcgggaacatcggaaagatccccatcatcggcgacctgacgggcagcaacaagaatgcgcacctcaagggcaacgtggtgctcgtgcgcaagaccgtgctcggcttggacgtcaccagcatcgccggctccctcctcgacggcgtcggcgagttcctcggccgcggcgtcacctgccagcttatcagctccaccgtcgtggaccctaacaacggcaaccgcgggaagttgggcgccgaggcgagcctggagcagtggctgctgaacccgccgccgcttctgtccagcgagaaccagttccgcgtcaccttcgactgggaggtggagaagcagggcatcccgggcgccatcatcgtcaagaacaaccacgcctccgagttcttcctcaagaccatcaccctcaacgacgtccccggccacggcaccatcgtcttcgtcgccaactcatggatctacccgcagtccaagtaccgctacaaccgcgtcttcttctccaacgacacgtacctccccagccagatgccggcggcgcttaaacccctaccgcgacgaacaagctcccgggaactggaggggggaacaaaccaacgggggccccgtcccaagaagaacgaaccgggtttttaccc

SEQ ID NO: 85216 - protein, 210 aa, Zea mays
  misc_feature: Ceres CLONE 1571468
  misc_feature (58)..(164): Pfam Name: PLAT Pfam Description: PLAT/LH2 domain
  misc_feature: SWISSPROT Homolog: EC 1.13.11.12 Lipoxygenase
MFGNIGKIPIIGDLTGSNKNAHLKGNVVLVRKTVLGLDVTSIAGSLLDGVGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPLPRRTSSRELEGGTNQRGPRPKKNEPGFY

SEQ ID NO: 85217 - DNA, 820 bp, Zea mays
  misc_feature: Ceres CLONE 1571470
  misc_feature: Encodes the peptide sequence at SEQ ID NO. 85218
ctccccgcggtggcggccgctctagaactagtggatcccccgggctgcaggaattcgtctcacccctagaaaaagcctctcgccatttttactcgtcggctggtccggccccagcgattcggtttggtgcgcctcgtggtccacgtgcgcgggctttgtgctctctcttccctctgtgtgtgtgtcagttcgtcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctttcgcggaagcacgtgcgggcgccgctctgcgcagggtgcgccgcgcgcccggccgccgcgcgcgtctccctcggcgccgacccggcgttcctctgcgcggactgctgcgagggctgcgccgccgcttccgcggcgcgcgtgtcggttgagggcttctcggggtgcccctcggcggccgagctcgccgcgtcatgggggctcgacctccgccgcgcggccgtggccgtgggcgactacggcgacggctgcgacgaacgacaactctttctcttcgtgctcgactactcgtgctggggggtgggggtgcccaaaacgaacctgccctaactctacttgccgggcgacccaccgggggttgccgtccctgaggcggggcgcgcccgcttaggggcaagggcctttgcaaccaattcccgaaaaatggccgggggaacaaagaaaaaccttcccctca

SEQ ID NO: 85218 - protein, 157 aa, Zea mays
  misc_feature: Ceres CLONE 1571470
  misc_feature (11)..(58): Pfam Name: zf-B_box Pfam Description: B-box zinc finger
MKSCGGGGADGQQCPCDYCGEAAAALHCRADAARLCVACDRHVHAANALSRKHVRAPLCAGCAARPAAARVSLGADPAFLCADCCEGCAAASAARVSVEGFSGCPSAAELAASWGLDLRRAAVAVGDYGDGCDERQLFLFVLDYSCWGVGVPKTNLP

SEQ ID NO: 85219 - DNA, 1049 bp, Zea mays
  misc_feature: Ceres CLONE 1571475
ctccccgcggtggcggccgctctagaactagtggatcccccgggctgcaggaattcgtctcacccctagaaaaaaccgactcctgtctccactggaacgcattcctgctctcctctcctcttcgtacctcgtcggtgcgtgcgtggcgcggctctgctttctgtgagaaaccactcggggatgatgatatgctgctagagtgagaggagctaccgtctgtatcctctgccttcggctgatgcctaagtggaggggacgaagcgatggacgcaagcgtccggctggtggccggctcccacaatcgcaacgagctcgatctgctccgactcgaccagaatcccgggccaaagacgcctcgggagcagaacgcgcaagtgtgcctgattttgtgcccaccacgtcggtctttgcgcccagaggggaccctttgtggggagacagaatagtgcgcctttccccgtctgccaggactgtttactaatacgaatggccggtgaggggacactgaagtgcccccctgtggaagtattcgatttaaaccccctcaagggcttgccccctggtttttccgggtaacgaggaaggaaggacgcccctcctattgacctgtgtacaaacgggtttaaaactgggaacgggcccatggacttctccatttcattggggccaaattgccttggcctctaaagggccgcctttgaagtttccgccccctgggggtgtgggccccttattgggggcgcgcccaaaagggtttccaaaactaactcccctttgtgtttcccccccctccacaacgggggggaaggtgtgggaagaaaacccccaccccggaaggaaacacgcttgtgggtggcccacattttttagggtgggggggggggaaaaaaaaaatactcccccctttccttttgggataaacaccatttttcctgtgatacccaggtttttaggcccccttccaattatctctcccgaaattgtttttagggaggggttcttttaaagaaacctcttagtatttgacacaaatacgttttggtgcccac

SEQ ID NO: 85220 - DNA, 1242 bp, Zea mays
  misc_feature: Ceres CLONE 1571479
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
ggggagagggggtgggtgttttagctcttcccgtcgcccgcgtaccccacaaaaaaannnnnaaaaannnnnnnnaaagtggggctccccgcggtggcggccgctctagactagtggatcccccgggctgcaggaattcgtctcacccctagaaaaaacgcacctgcagacctgctctctcgcgcgcatctcccgtgcccctcactgtttagtggcgacgactgggcgacagtcgccgccgccgcccgctaggggccgtgcccctggtctccatcttcgggcgcttcgcccaccagatatgagcagctggcaattccattttgaggccattatttgataacccgggacaagtgcactgttacctgaccatttcagcttgttcacatggctacccagttgccatgctccacacatctcagtccaccgtcttgtagtatgataaaagaagtcggggaaccgcaacggctacgccctcataagggcaccccaaatagtgccccaagcctgtgggaccactggcccccttccgggggccttggccagaccccccgagtaaggccaccccccttttcgggaaaggaacacgacccctttatgcaaacaaaaacaaagaccccctgtcgcccgggcggaaccattccatcgcccgaaaagggagatccctccagaccccaccttcccgccttcagaaataaaacaaggaatgtccccacaccgccatctgtggcggcacataatgtgcgacaaccgcgcgaatcctagcgccgtagcacagggacggcgcgcgcggcttatctaatacatacaccaaggcggtgcccaccgaggggcgagcgaggcgggaaccgttctctccccgataagcctcgtgtcaaaacgccgcagctgccccacactcgatcgttcgtgtcgcatctacacgagcagccacaaagcgcgtatcccgcctttcgttgtaccctctaacaccggtgcccgcatagtccagaatatctcccgcaccaggcgagttttagctctggcgccgcgggagcatatatatcttgggatactcgctcatcacggccggaataaccagagccttgcgtgttccgaatccgctcgctgttgacgccctgttttggagtgggtacatcgacgcagggggtaccccatgtccttggatgcaagcacattctactatgtacgaacgtgaaatcacccgctgtcgcgactagacacggcgcgactgggctcatcctg

SEQ ID NO: 85221 - DNA, 1000 bp, Zea mays
  misc_feature: Ceres CLONE 1571483
  misc_feature (289)..(289): n is a, c, t, g, unknown, or other
  misc_feature (290)..(290): n is a, c, t, g, unknown, or other
  misc_feature (779)..(779): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (936)..(936): n is a, c, t, g, unknown, or other
ctccccgcggtggcggccgctctagaactagtggatcccccgggctgcaggaattcgtctcacccctagaaaaaacggtcatgccccaaattcttatgcttttcgaaaattacaatcacccacccccaataaaagcgcccacaccctcctgcacctcccttcctcaacctccgccatcaccgacgctgactcccacaccggccgccgcgcgagccccggcaccatctccgcacgagcagaaatgggggatgcgtgtttctcacacagctaattgatggagatggggtcnntcacgtctctgggatggagaactcatgaaggatgccagatgggtgaatgcggctcccccatgctggtgaacaaaaatgggcccccaaagaaggggaaaatccccttttgaaacatctttttggcccaattttagggaaagggaccccctcagagaaagggccccaacccccaaaggtttttggttttccaaaggcccaaaaaattaaacccgcgcccccccttttaatgttttttgaaaaaaacttttttaagagggagggggggaagaggggccccccccctttttaaaaaaaaaaaggctgtttgttttcttttccccccccccaacaaaagtggggggaggaaaaaaaggggggggggccccccctcttggggaaaaaaaaaagaggtgtaaaaaaccccctcttttaaaaaaaaattttcccccccagaaaaaagagagtgtgttccccccccaaaaaaaaaaaatatgtgtgtttttgtttgtncggaaaaaaaaccccccccccccacaataaaaaacactctttttggggaggagagaaccccacaggggggaggggtgcggggcccccccccccccccgaaaaaaaaaaaaacaacannnnntttttttttgttggtgggaggggcgggggcccgcantaaaaaaaaaaaaaaaaaaaagaaacccccccccggctttgaaaaagagaatttagagcccccc

SEQ ID NO: 85222 - DNA, 796 bp, Zea mays
  misc_feature: Ceres CLONE 1571484
  misc_feature: Encodes the peptide sequence at SEQ ID NO. 85223
aaagctggagctccccgcggtggcggccgctctagaactagtggatcccccgggctgcaggaattcgtctcacccctagaaaaagcaatctgcctccgcactcactccacgcacacgccgccgctatacgcgacggcgccgagcgcatcgccgccggcccctccctccctgcgcctgtactcagcccgctgcttctcagtccacttcatccacagctcctcttctctcggtctagagatccgtccgggcacggtagtctcgccttcgttttgggcacaacgaacaattactctagaagagttgtactctttggtgtgccgtactctctgtaacaatcttaccaattaccattcttgagaagaggtacatctgtccgtcagcgatgtccatagaagagaggaagataagtatgataagcaagagcactgcactaaatccaaatgcagaggaatttgttccttcgtcccttagatctttcagtgattcctccaagaaatcagatgcaactatgattgtctcagggtcatctaaagaatctggcacagacaagccagaatccattttacgaagtaactctgatgaagaagcacatcagtactggcagcaacagctccctgacgacatcacccctgatttcaaagtcctgggacaagacgaaagtcctggacctgacagtctatcactcacaggcctgtcgattaatgatggcattgacacatcaatattttctccaaaccagacactgggcgtgcagcaccatgctttcacttttatcagggacaaactgaatacacgc

SEQ ID NO: 85223 - protein, 138 aa, Zea mays
  misc_feature: Ceres CLONE 1571484
  misc_feature (12)..(29): Pfam Name: PAM2 Pfam Description: Ataxin-2 C-terminal region
MSIEERKISMISKSTALNPNAEEFVPSSLRSFSDSSKKSDATMIVSGSSKESGTDKPESILRSNSDEEAHQYWQQQLPDDITPDFKVLGQDESPGPDSLSLTGLSINDGIDTSIFSPNQTLGVQHHAFTFIRDKLNTR

SEQ ID NO: 85224 - DNA, 843 bp, Zea mays
  misc_feature: Ceres CLONE 1571486
  misc_feature: Encodes the peptide sequence at SEQ ID NO. 85225
ctggagctccccgcggtggcggccgctctagaactagtggatcccccgggctgcaggaattcgtctcacccctagaaaaattttgggcttccaatccttcccctctcggcagctatccgtcgccagtgcgtgtttttgtttcccgctctcgcgatctctactctcgtctctcgtgcaagctctaaggcaaggatggggcgtaggacatgtggcacggccttcatccttctctacgtgctgtctacgtcgacattgcccgcgtcgtcatcgaacaccggcgacggcctcatccgcatcccgctgaagaagagatcgataatggacaccatctacggcgacctcctgccgaagccgagcgcgccggaggagaaggagaagcaagccgtcgacgacccggtgcgggacgccatagcccgagcacgcgagcggcagcacgaaatgctggtccaggccgctgccacggaacgcaggcgcaggtactactggagctacagcggggccgggggcaagggaaacggcagccgtctgcatgacggaggccagggcgaggggtcggggagcatcgccatcgttgcgctcaagaacttcctcaacgcccagtactttgggcagatcggggtcggctgcccgccgcagaacttcaccgtcgtcttcgacaccgggagcgccaacctctgggtcccttctgccaagtgctttttctcgctcgcgtgtttattccatcccaagtatgactcccgccagtccagcacttacaaaccgaatggaacacccggcttctattcactacgggaacgggagggggattgctggtttttacagccaagacccagtcacggttgg

SEQ ID NO: 85225 - protein, 217 aa, Zea mays
  misc_feature: Ceres CLONE 1571486
  misc_feature: SWISSPROT Homolog: EC 3.4.23.40 Phytepsin
MGRRTCGTAFILLYVLSTSTLPASSSNTGDGLIRIPLKKRSIMDTIYGDLLPKPSAPEEKEKQAVDDPVRDAIARARERQHEMLVQAAATERRRRYYWSYSGAGGKGNGSRLHDGGQGEGSGSIAIVALKNFLNAQYFGQIGVGCPPQNFTVVFDTGSANLWVPSAKCFFSLACLFHPKYDSRQSSTYKPNGTPGFYSLREREGDCWFLQPRPSHGW

SEQ ID NO: 85226 - DNA, 905 bp, Zea mays
  misc_feature: Ceres CLONE 1571488
  misc_feature: Encodes the peptide sequence at SEQ ID NO. 85227
  misc_feature (186)..(186): n is a, c, t, g, unknown, or other
  misc_feature (363)..(363): n is a, c, t, g, unknown, or other
  misc_feature (417)..(417): n is a, c, t, g, unknown, or other
  misc_feature (631)..(631): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (816)..(816): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (826)..(826): n is a, c, t, g, unknown, or other
  misc_feature (829)..(829): n is a, c, t, g, unknown, or other
  misc_feature (834)..(834): n is a, c, t, g, unknown, or other
ctccccgcggtggcggccgctctagaactagtggatcccccgggctgcaggaattcgtctcacccctagaaaaactgcctaccccgtccctccccaagcgcgccgtctagggtttcacagccgtgccccgatccattcgagcgccccgcaccgccgccatggagtttgacgaatacgagtacttgnagaaggcggtagagcccgctcccccacaggccaatggttccggctccggctccggcgagaaggaccgcggctcgcgccgccgcgagggcggcgaggaccgcatatcgaagcgctctcgctcgggggaggaccgcgaccgggacaggcaccgcagcggccggtagcaccgtgaccggnacaaggatgacgtgaaggaggagaggagccgcgaaagccgcgggaaggacaggnacagggaagggagagaacgggagaaggagaggggtgacaggcaccggctgagagagagggaagtggaacggggagcggaggagccggagccgctcggagcggcgccgtgccgaggaagaggagatggttagggagctggagcgggagcgcgagcgcatcgagcgacatcactatcgcgaccgtgatgtcaggcgtaggaaagatgacggggcanagccagaagttgatcccggaaagggacagaggactgtatttgctttcagctatctttgaagcagaccagagagatgtttatgagtcttctcaagggcgggaaagttccggatgttcgtcttatcagggacggaactcaagagttctaaagaagtggaattgccccnnnatattatnnnnnnnncnccnnnnnntntantcttnattttccattcacacttacattagtcctcctattacctctttaacactctcctcctttcttaatatgcgaa

SEQ ID NO: 85227 - protein, 63 aa, Zea mays
  misc_feature: Ceres CLONE 1571488
  misc_feature (10)..(10): Xaa is any aa, unknown, or other
MEFDEYEYLXKAVEPAPPQANGSGSGSGEKDRGSRRREGGEDRISKRSRSGEDRDRDRHRSGR

SEQ ID NO: 85228 - DNA, 775 bp, Zea mays
  misc_feature: Ceres CLONE 1571490
  misc_feature: Encodes the peptide sequence at SEQ ID NO. 85229
ctccccgcggtggcggccgctctagaactagtggatcccccgggctgcaggaattcgtctcacccctagaaaaagaggcagtgagtacagagagtagccttacgtagcgaagctcagagcaagcgagggtacggtcaaagggggtgatggcgctgtctcgactcatggcggctcccgtcctcatcctcatgctcatcctcgtcgccacaaagctggggacaaccaacgcggcggaggcaaagcactgcctgtcccagacccaccagttcaagggcctgtggatgagcagcaacaactgcgccagacgtgtgccacatctagaacttccccgactgcgagtgtaacgcggacggcgccacgcccaagtgcttctacatgaagatagtgctagtagtagccacatgctttgactggcacaagcaaggtcgtccgcacacatcatcatattcaagcatcatatcggtcctactacctcgttgctgtctactcgaccccgtgttctctttagatggatgacatggtttcgtgttgctctcatcttctggccataataaactgctccataggatctcactgctgtactgactacctccgctggtagtcaggacaattcttctccccgctgtgacgggtgactgcaaatgcatgtactaatgcaagtgtccaggtgctcataggatggatgacatgatgtcggcgctgtggaggccactccagaatgtgcactggtgcgtggagcgactgcaacagcacatcggaaggcccttggagcagg

SEQ ID NO: 85229 - protein, 65 aa, Zea mays
  misc_feature: Ceres CLONE 1571490
MALSRLMAAPVLILMLILVATKLGTTNAAEAKHCLSQTHQFKGLWMSSNNCARRVPHLELPRLRV

SEQ ID NO: 85230 - DNA, 812 bp, Zea mays
  misc_feature: Ceres CLONE 1571493
  misc_feature: Encodes the peptide sequence at SEQ ID NO. 85231
  misc_feature (683)..(683): n is a, c, t, g, unknown, or other
  misc_feature (685)..(685): n is a, c, t, g, unknown, or other
ctccccgcggtggcggccgctctagaactagtggatcccccgggctgcaggaattcgtctcacccctagaaaaaatttttttcgaccgccgccgcccccagtccccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctctggtgagccacgcttggttcgctgcctctgatcacagcataagttttgagttgaatgttagatgtaaatgtttacgcgctggttggctcaatctgtaaactatattatttttatagtttttaaagaatccgaattcagtctggactataggacctgcatgcgtgatataaggcatcccgggttttgggacaggattggagggggggggtatatataaaggggngnaaaaattttaggttggtatgaaaaggaatggtggggggaggggtgtgtgtgtgaaaaaatattatggatagattagtatatagtaatagaagaatgggtgagatatatatatatggtgaatgaataa

SEQ ID NO: 85231 - protein, 116 aa, Zea mays
  misc_feature: Ceres CLONE 1571493
  misc_feature (1)..(49): Pfam Name: Ribosomal_L6e_N Pfam Description: Ribosomal protein L6, N-terminal domain
MAPTSKLSTGIKRASRSHAYHRRGLWAIKAKNGGAFPKADKAAAAVEPKFYPADDVKPRVPSTRKPKPTKLRSSITPGTVLILLAGRFMGKRVVFLKQLKSGLLLISGEPRLVRCL

SEQ ID NO: 85232 - DNA, 780 bp, Zea mays
  misc_feature: Ceres CLONE 1571494
  misc_feature: Translation starting site: 217
  misc_feature: Pfam Name: Ferric_reduct Pfam Description: Ferric reductase like transmembrane component
  misc_feature: SWISSPROT Homolog: EC 1.6.3.1 NAD(P)H oxidase
  misc_feature (615)..(615): n is a, c, t, g, unknown, or other
ctcaccgcggtggcggccgctctagaactagtggatcccccgggctgcaggaattcgtctcacccctagaaaaagaagcggcacctgtccaagacggtggacttcatccacgagaactggaagcggatatggctcgtgacgctgtggctggtcgtcaacgtcgccctgttcgtgtacaagttcgagcagtacaagcgccgaaccgcgttccaggtgatgggctactgcgtctgcgtcgccaagggtgccgctgagatcctcaagctcaacatggctctcatcctgctgcccgtctgccggaatacgctgacgacgctcaggtccaccgcgctcagccatgtcatacccttcgatgacaacatcaacttccacaaggtcatcgcgctgtccatcgcgatcgccacagcgatccacacgctcgcacacgtgacctgcgacttcccaaggctgatcagctgcccgacggacaagttcatggccaccttggggtccaacttccactacaagcagccgacttacctggggctgctggagagcacaccccggggttacgggaatcctcatgatcatcataatgtccttctccttcacgctgggcacacattccttcaggcngagtgtggtgaaagctgccatcggcgctaacacacccttggccggtttcatggccttctggtacgcctcaccacctgctggtccctggcgtatgtccctgctggggggtgcactccctacttcatattcccccacccagggagtggtaccaaaaagaccaacttc

SEQ ID NO: 85233 - DNA, 986 bp, Zea mays
  misc_feature: Ceres CLONE 1571496
  misc_feature: Encodes the peptide sequence at SEQ ID NO. 85234
  misc_feature (659)..(659): n is a, c, t, g, unknown, or other
  misc_feature (671)..(671): n is a, c, t, g, unknown, or other
  misc_feature (793)..(793): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
aaagctggagctccccgcggtggcggccgctctagaactagtggatcccccgggctgcaggaattcgtctcacccctagaaaaaggggttcgtcatcgcgtggtggccgcgccgctctgttcctccgtcccctcctccttccggctctcgctgtcacatgtcgtgtggtgtgggggcgctctgatccggatggtgcagcgccgcgggatcgcccacggccatgattgatcgcgaacgagcagaggaaatgcaagttaataatgaggcaccactagggtgcctcaagccaaatatttctcagtataactctccagagcagataggtggtgttgaagggtttcctgagaataatgaaaaaaggaatgatattgttgctgcagaaaaaatctgggaagtgactccaaaccaacgccttagcaggaccatctaccgacaagaattttatgcctggccatatatttattcagaattatcaaatcgcgacgccagccacctaccttattggtttctgaacaaccaatttttatcgcgataaaataagggaaccaccaggttttccctaatttgagaaaaaggggttccaataatccttcccatattcaagaatgccctcccctcaaaagggacaaccccccaatggaatggacaccggcttttcnatggaaaatttncagcacaatttggggtggagttaattgggaaccttgaaaaggccacccctggtggaacaaagggtggaaacaaaattccctttttttccacaaaagaaaaaataccttgaaaatttttcccnaacgttgatcctggggtctaaaccacggtccccaccctgtgggaaaaacccccgtaacaaatgtgcccttccaaaaaattatttgttttcacggcccaagcgtaaaacatacaagtttttctcgggccggaagttttttggaacaaaataaagccattaccggggggaannnnnnggggttttttacttggaa

SEQ ID NO: 85234 - protein, 104 aa, Zea mays
  misc_feature: Ceres CLONE 1571496
MIDRERAEEMQVNNEAPLGCLKPNISQYNSPEQIGGVEGFPENNEKRNDIVAAEKIWEVTPNQRLSRTIYRQEFYAWPYIYSELSNRDASHLPYWFLNNQFLSR

SEQ ID NO: 85235 - DNA, 765 bp, Zea mays
  misc_feature: Ceres CLONE 1571498
  misc_feature: Encodes the peptide sequence at SEQ ID NO. 85236
  misc_feature (665)..(665): n is a, c, t, g, unknown, or other
ctccccgcggtggcggccgctctagaactagtggatcccccgggctgcaggaattcgtctcacccctagaaaaatctcccgccgcccgccgcgcgccgcctccgcgcgccatccagacgccagtgcgcgtcgcggtccgctgcccgcggtgcgttcaccctctccccatctcccttttcctctcccgcgcgcccttccctacgcgcctccgccggcgacgagtgcccaccagctggtgttacacacgtgtaacaatacattacatggcgctagtacagttcaatggtgccttgcttccccaactcggtgaaaaacctcggacgctatcctcgccgcctgcagttgcaagggctacctatgccgatgcaaggttcctggcaccggaaaccagttcaagaggtagaggtaaacacctgctatcatctagttatagtttgcattcgcagacctcttctgaacaaataaaccatgtaccgtcgtcaagatctcgccagaaaaggggctcaagttttgtcgtcagagctgaagctgatttctataacgtacttggtgtctcaagaaatgctagtaaatctgaaatcaagagcgcctatcggaagcttgctaggagctatcatccagatgtaaacaaagatcctggtgctgaacaaaagtcaaggaaatcnagcatgcttatgagggtttgtctgatgatgagaagcgatcaatctatgataaatatgggagagcaggtctgaaaagtgctggcatgggcacaggagatac

SEQ ID NO: 85236 - protein, 157 aa, Zea mays
  misc_feature: Ceres CLONE 1571498
  misc_feature (90)..(147): Pfam Name: DnaJ Pfam Description: DnaJ domain
MALVQFNGALLPQLGEKPRTLSSPPAVARATYADARFLAPETSSRGRGKHLLSSSYSLHSQTSSEQINHVPSSRSRQKRGSSFVVRAEADFYNVLGVSRNASKSEIKSAYRKLARSYHPDVNKDPGAEQKSRKSSMLMRVCLMMRSDQSMINMGEQV

SEQ ID NO: 85237 - DNA, 767 bp, Zea mays
  misc_feature: Ceres CLONE 1571501
  misc_feature: Encodes the peptide sequence at SEQ ID NO. 85238
ctcaccgcggtggcggccgctctagaactagtggatcccccgggctgcaggaattcgtctcacccctagaaaaaatcggcacctcgccgtcctcgtgtgcaatccccagctctcctcgcccctccctcccaaactccagcggccccccctgaccaagctccggggacggatggacggaggagccggctttccgggcacgcagccggtctcccgctcgccggaggacgtcttccgggactaccgcgcgcgccaggccggcctgatcagggcgctcaccaccgatgtggagaagttctacgtgatgtgcgacccagagaaggagaacttatgtttatatggacttcctaatgagacatgggaaataaacttgcctgctgaagaggtccctcctgaactgccagagccagctcttggaattaattttgctcgtgatgggatggatgaaaaagattggctatcacttgttgcagtgcatagtgattcttggctaatgtctgttgcattttattttggagcaaggtttggattcgataaagaatccaggtattccatttgttttattctaagataagatttttatgtttgactgttatataaatgtttcttgccaatggacctcccttaagtatctcatagtttaggaaccagttattgtttgtcacgagtattcattttctgtacatgagaggtttcatagccttgcgtttgtgattttctagtagcagctccagcgcctgggtttgactccctatgggagtgaattttgg

SEQ ID NO: 85238 - protein, 133 aa, Zea mays
  misc_feature: Ceres CLONE 1571501
MDGGAGFPGTQPVSRSPEDVFRDYRARQAGLIRALTTDVEKFYVMCDPEKENLCLYGLPNETWEINLPAEEVPPELPEPALGINFARDGMDEKDWLSLVAVHSDSWLMSVAFYFGARFGFDKESRYSICFILR

SEQ ID NO: 85239 - DNA, 908 bp, Zea mays
  misc_feature: Ceres CLONE 1571505
  misc_feature: Encodes the peptide sequence at SEQ ID NO. 85240
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (72)..(72): n is a, c, t, g, unknown, or other
  misc_feature (94)..(94): n is a, c, t, g, unknown, or other
aaagagataaataaaatattatttcattccttcaattctgtacattataaaccctnnnccctcacccaaaantaataaaaactggagctcaccncggtggcggccgctctagactagtgaatcccccgggctgcaggaattcgatctcacccctagaaaatagaaaaagttcaacaaaccaaccagcctagcgacgccgacgccgccacgtcccaacgaaaaggaaactacaaagaagaagaggacagaatgccagagtcatggcggccacgagctccgcctgcgcgtgcgcggcggtagcgctcgcgtccttcccgtccgccgcctccacctccgccccttcccgcgtctcggccaacagccaccgcggtcagcggcactccagggccgccaccgtcagatgttccagcacgtcgcccaacgtgtcccagagcgcgccggcgccggcgccgcccaagccgcaaatcgagctcgagttcgtcgggaccaagcccggtgccgacggctccttcccggtggaccgggcggaggcgaccagcggcgagaagctcctccgtgacgtcatgaacgagaacaagatcgagctctacgccgcatacggcaaggtgatgaactgcggtggcggcggaagttgcggcacttgcatcgtcgagataatcgatggaaaggagctcctgaatgagaggacgaacaccgagaatcggtacctgaagaagaaaccagactcatggaggctagcttgccagactattggaggcaacaaaagagaactctgggaaggtttgtgggtccaacgggatggccttcagtgggaaaagagatgaaccgtggccagtgccaacacccacgtttgggtgggaatagaaccgaatcggtccaaggtttggtatagctcacctaaaaaagca

SEQ ID NO: 85240 - protein, 187 aa, Zea mays
  misc_feature: Ceres CLONE 1571505
MAATSSACACAAVALASFPSAASTSAPSRVSANSHRGQRHSRAATVRCSSTSPNVSQSAPAPAPPKPQIELEFVGTKPGADGSFPVDRAEATSGEKLLRDVMNENKIELYAAYGKVMNCGGGGSCGTCIVEIIDGKELLNERTNTENRYLKKKPDSWRLACQTIGGNKRELWEGLWVQRDGLQWEKR

SEQ ID NO: 85241 - DNA, 789 bp, Zea mays
  misc_feature: Ceres CLONE 1571506
  misc_feature: Encodes the peptide sequence at SEQ ID NO. 85242
ctccccgcggtggcggccgctctagaactagtggatcccccgggctgcaggaattcgtctcacccctagaaaaaacctctcaatctcaccccacgcctgccccgagctccaaccctaaaggaacacacccctgcttgcggcggcggggagcggtcttgggcgtccgccttttgctgtggcccagccgtgacagatccgggccccgcgccgttaggtcggtgtttcttcggcgacggtgtagccgctggatgttagtctggcggatcggggcccgttgttcgcgtgattcgagctaggcggtgttgagttgtaacatttgtgtcacatgaatgaacttagagcatctcagtgttaaaactgtgagcatatcaattcccctcctttaagcaatatgggagctaattgctgcattgctgcaaaggagaggacacaaccatgcattactccattagaagtatcagcgtacaggaatgtgagacattcaccatcatggagctttcggtgggacaatcgcacacatatagaagacataatggaaatccctactctgttctccaaccatagtagtggaagcattcgacctgatacaaagagtgtttccattgccccgactgaagggggttttctatggaatagccttggaactagcccttcaatgtgtctcacggaacaaagtggcacaaatctgacaaaaaaaatggagcaatctaggttccaaggctgatcctcgagctgaccaccccctgcaagtaactcctcctttgaggcaaagctttcaggaaatactgg

SEQ ID NO: 85242 - protein, 110 aa, Zea mays
  misc_feature: Ceres CLONE 1571506
MGANCCIAAKERTQPCITPLEVSAYRNVRHSPSWSFRWDNRTHIEDIMEIPTLFSNHSSGSIRPDTKSVSIAPTEGGFLWNSLGTSPSMCLTEQSGTNLTKKMEQSRFQG

SEQ ID NO: 85243 - DNA, 874 bp, Zea mays
  misc_feature: Ceres CLONE 1571507
  misc_feature: Translation starting site: 212
ccccgcggtggcggccgctctagaactagtggatcccccgggctgcaggaattcgtctcacccctagaaaaaaagccgcgactgcccctcgacctgcccgcttccaccgacgcctagggttttctacggggcgccgccgccgcagccgcggccggggatgcaggtgggcccgcgcagtaagccgcttttggatccaccgccgccgcgcgccatgtcgctcctgcggcggcggaagcagcagcagctgccgccctcggacggcgacgggtccgaccacgacgacaacgacaaggggaagaagccgtcctcgtcctccgcgccgccgtccaaggagcccacgaggcggaccaaggccaagtggtcgtgcgtggacagctgctgctggctggtcgggtgcccgcgctccgcctgggggttgctgctctttctctacaacgcgatgccagcttcgttcccgcagtatgtaacggaggccatcacggggccgctcccggacccgcccggggtcaagctgcagaaagaggggctgcgagctaagcaccccgtcgtctttgtccccggcatcgtcaccggggggcctcgagctatgggagggacaccaatgcgccgagggtctcttcctcaagcggctatggggcgggccatttggtggcgtatacaagaaacctccttgctgggttgaacatatggtctttggacattgaaactgggttataaaaacctgggaaaaagggtcaggttttccaccaggcccttttttccacaaaaaaaattttctccccccggaaaattttggtttggggcgcgccttctattgcccaaatttacctcgcgattggggaattgaagaaaaaagaccatagtttcatggggg

SEQ ID NO: 85244 - DNA, 878 bp, Zea mays
  misc_feature: Ceres CLONE 1571509
  misc_feature (878)..(878): n is a, c, t, g, unknown, or other
gcggtggcggccgctctagaactagtggatcccccgggctgcaggaattcgtctcacccctagaaaaaatgctttcttagaggtgggttggcgttctcctccccctccggttcgggtccgggttcaggaggttatccgcgggttacggttcgtgggtgtacgcatcgagatggcggcgtaggatgttgattacggctccttcgacgtcagcctcgcctgggccacgcaagaccactccctctacgacgccttcatcacctaccggggagtattcgtctcctagatcatcctcggtcggggaacgctgaggtacggctgcttcggcttcgacgccttctcactccgaggacgcgattgggagcgccttcgagggcatcaacgactaggtgctggaccgtggcgacatcaccgtcaacgaggcccaatcccgctgcgaccgtgtacgcggcctgcttttgggtaccttggaggcccttaggagccgctgctaagggggtcgccggggggccgttgattcgcagttatcggcataacggcggatgggcgacccctaccagagggccgggaaacccccttacgggtgggttgggtgtctgaaagccttaaaaggaggttagaaaaccttccggttgggcggcttaatgggcgaaggtcttggccgataaccctggaaggcaactggaaacgggggggggcccccggggggggccttaatcgttcccgattaggaggcctccaagtattgtttaacccattaatccaaaagaggtcttaagcttcaaaaacgggttgagacgtttgaagtttgacccccccacaagtttggtaaatgtcatacggggggtggagaaagcattttgcgaaaaaatcccgctccn

SEQ ID NO: 85245 - DNA, 845 bp, Zea mays
  misc_feature: Ceres CLONE 1571511
  misc_feature: Encodes the peptide sequence at SEQ ID NO. 85246
tccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaaacgcgtcgacatctccgtcttcgaggccgagtcggcggggcccggcggctttcgtcggctttcgtcggcaacctccttcttcctttttatcgcgtttcgctgggctctttctttctcttccgccccgccgaaagggcggggccgggcgcccggcgcctggggggcccccggcggggcccatggaactttcgggccgctctccaaaaacgaagtttccaggaaggggc

SEQ ID NO: 85246 - protein, 233 aa, Zea mays
  misc_feature: Ceres CLONE 1571511
  misc_feature (103)..(229): Pfam Name: FtsH_ext Pfam Description: FtsH Extracellular
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATKRVDISVFEAESAGPGGFRRLSSATSFFLFIAFRWALSFSSAPPKGRGRAPGAWGAPGGAHGTFGPLSKNEVSRKG

SEQ ID NO: 85247 - DNA, 825 bp, Zea mays
  misc_feature: Ceres CLONE 1571514
  misc_feature: Encodes the peptide sequence at SEQ ID NO. 85248
  misc_feature (621)..(621): n is a, c, t, g, unknown, or other
ctccccgcggtggcggccgctctagaactagtggatcccccgggctgcaggaattcgtctcaccccctagaaaaaaccaagcaggcgacacccgttcggtccgtacaggaggggtccaccatgccgtgctcctcctcttcgtcgtccaaccccttccactccctcgcctccgccttccccttcctctcctccacatccccacccccatccccacccgcctcgcccgcgcccgccgctccccacctcgccgtcccgctcctcctccccgtctcctcggcttccgagtcccgccgcggggcgcagccgctgccgggcacgcggatggtcggcgcgggcgcgaccggcgggggtaacatggccagcggtggtggggggcccgcgttcgtgggccaggtgttcaccatgctcgacccatccgggaacgggctcatggccgttaccacacgcttcgagctcccgcgcttcctcaccaacaggactcctatgtggttcaaaaggatgctatcaccgtcgaagaagactgaaaatagtccagtatttaggttttttatggatctgaatgatgcagtatcctatgtaaagcgactaaatgtgccaagcggcatggtggggggcttgtcncccttgatgtagcatatgaacatttcaaggaaaaagccctcccatgttccaggttttgttccaaatgaaaaaacaagggcccgggcttggccaaaaaagcctattggaagatcccccttcccccaaaaggggggcgaaaaaaggaaaaaaacattgggaggggggggttcccgggtgttttttaaaggggccgcaaaaaaaatc

SEQ ID NO: 85248 - protein, 170 aa, Zea mays
  misc_feature: Ceres CLONE 1571514
MPCSSSSSSNPFHSLASAFPFLSSTSPPPSPPASPAPAAPHLAVPLLLPVSSASESRRGAQPLPGTRMVGAGATGGGNMASGGGGPAFVGQVFTMLDPSGNGLMAVTTRFELPRFLTNRTPMWFKRMLSPSKKTENSPVFRFFMDLNDAVSYVKRLNVPSGMVGGLSPLM

SEQ ID NO: 85249 - DNA, 840 bp, Zea mays
  misc_feature: Ceres CLONE 1571515
  misc_feature: Encodes the peptide sequence at SEQ ID NO. 85250
  misc_feature (802)..(802): n is a, c, t, g, unknown, or other
ctccccgcggtggcggccgctctagaactagtggatcccccgggctgcaggaattcgtctcacccctagaaaaagaagacgtcgatgcataacctcctcgtgcgttgtttgtctctctacttctctagtctagcccctctgtcgctctcagacgacgggtgcgccgccgccgccgccctaagccaggtgctgactgctgaggctttctttggtctcttcgccggcgacgacacccgccagtatccacggtgtcattgcaagacaagatggtttccttcgagatgaatgacctcaagagtatggacttgtcaccactctttttttaattgtcttcccaatttttgttccatttgtttctgataggagcatagatagtttgtgctaggcatgaatgtgtattgatttgcttgacgtcctttgtttctccctcataattcagaacttaacaagctagcatgtttgcaaattgtcttgtgatgaatgtgagaaagtcaccctcagggatgctactttgttttgaaggtttgcatgtctttaactgatatttgatgatttttcaatcatataaactgtgacatgcacctcatatcatgtaaaaacagtagttttaatgtgttgatccatcagggtaatatcatgtggggaacgtgctgtataatttaacctgcatttttttgtctaaatgtgtttagtgttacaattgaccatgagtggcagcatatatcatgtactgtggtgccggtagtctaccatatgtcaattatcttgaagtgtaatttggcagaagaggcaacttgctaanttctttttttttttccttcaagggggggcggggggggg

SEQ ID NO: 85250 - protein, 66 aa, Zea mays
  misc_feature: Ceres CLONE 1571515
MHNLLVRCLSLYFSSLAPLSLSDDGCAAAAALSQVLTAEAFFGLFAGDDTRQYPRCHCKTRWFPSR

SEQ ID NO: 85251 - DNA, 872 bp, Zea mays
  misc_feature: Ceres CLONE 1571518
  misc_feature: Encodes the peptide sequence at SEQ ID NO. 85252
  misc_feature (362)..(362): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
ctccccgcggtggcggccgctctagaactagtggatcccccgggctgcaggaattcgtctcacccctagaaaaaaaaaaaaactccaagcaagccataactgcaagaaagcaacggcagcaagaaaccttgtaaacatcggagcatagatcgcggcggtgatggcggccaaggggaggacggagctggacgtgggcgccgacggcgtggccgtaatcaccatctacaatccgcccgtcaactcgctctccatcgacgtcttacatagcttaaaagaaagctatgaagaagcacttcggagaaacgatgttaaagctattgtcgttacagggaaaggagggaaattttctggaggatttgatnatagttccttttggtggtgtcaaggaggccaaacaatgcaaccaaagggtgggctacatagcaatagatattctcacagatactgtagaagctgcgacaaagccatccagtggcagcaattggagggccttgcctctgggtggagggtttaaaattggccatggcatgccatgccccggattggcaacttccaacggctcaattagggtcttcccagaacttccggttagggaatttttcccgggatttgggagggaaacaaggggacttccccaaaaatgggttgggtctaaaaaaaatcttttgggaaaagggtggtggtttattttaagcccaatccaggggggggggaggggcaacaccaaccggggccccgggtgaaaaccccccaaatttccccccaaaaggaacccccgcccaaacaccnnnnnnnnaaaagagggggtttgggggaaaatttttaaaattttggggggggccgctcgtgtatttaaaaaacccttctttatg

SEQ ID NO: 85252 - protein, 117 aa, Zea mays
  misc_feature: Ceres CLONE 1571518
  misc_feature: SWISSPROT Homolog: EC 5.3.3.8 Dodecenoyl-CoA isomerase
  misc_feature (68)..(68): Xaa is any aa, unknown, or other
MAAKGRTELDVGADGVAVITIYNPPVNSLSIDVLHSLKESYEEALRRNDVKAIVVTGKGGKFSGGFDXSSFWWCQGGQTMQPKGGLHSNRYSHRYCRSCDKAIQWQQLEGLASGWRV

SEQ ID NO: 85253 - DNA, 845 bp, Zea mays
  misc_feature: Ceres CLONE 1571519
  misc_feature: Encodes the peptide sequence at SEQ ID NO. 85254
  misc_feature (648)..(648): n is a, c, t, g, unknown, or other
  misc_feature (657)..(657): n is a, c, t, g, unknown, or other
ctccccgcggtggcggccgctctagaactagtggatcccccgggctgcaggaattcgtctcacccctagaaaaaactccccaagcgtcacaccgaatcaccacagtcgagctcgagcaggaacaagccgtgagcgcctgcccccggtgctcaatatctattccacacctcatggcgccggcgctgagcaggaccctggggccgtcgtcggtggccgcgctgcgcccgagcccgtcgtgccggggtctgttacgggccgcgctcgcgccgcagggcaggggcgcctccgcgaggtgcgcggtaggggtgagatgggaggcagccaggcggaggaggatggccggggtgaggtgcgacgccgccgtcgctgagaagcctgccggcgaggaggagacggccggcgagaagtacgagtaccaggctgaggttacccgcttgatggacttaattgtacacagtttatacagccacaaggaagtatttttacgtgagcttgtaagtaacgcgagtgatgcactggataagctgagattcctcagcgtaactgatccttctgtgttggctgatggcggtgagttggagataaggattaaacccgacctagaggcggggacaatcactatcacagatactggcattggaatgactnaagatgagnctcaagactgtcttgggaccattgcacaaagtggcacctcaaagtttttgaaggctctaaaggagaaacaagactttggtgcagataatggactcattggtcaattccggtgttgggttctatttcgctttccctgttgcaaagaagggttgtgggtgtctacttaaaagtcaaaggcagaataagca

SEQ ID NO: 85254 - protein, 217 aa, Zea mays
  misc_feature: Ceres CLONE 1571519
  misc_feature (160)..(160): Xaa is any aa, unknown, or other
  misc_feature (163)..(163): Xaa is any aa, unknown, or other
MAPALSRTLGPSSVAALRPSPSCRGLLRAALAPQGRGASARCAVGVRWEAARRRRMAGVRCDAAVAEKPAGEEETAGEKYEYQAEVTRLMDLIVHSLYSHKEVFLRELVSNASDALDKLRFLSVTDPSVLADGGELEIRIKPDLEAGTITITDTGIGMTXDEXQDCLGTIAQSGTSKFLKALKEKQDFGADNGLIGQFRCWVLFRFPCCKEGLWVST

SEQ ID NO: 85255 - DNA, 744 bp, Zea mays
  misc_feature: Ceres CLONE 1571520
  misc_feature: Encodes the peptide sequence at SEQ ID NO. 85256
ctcaccgcggtggcggccgctctagaactagtggatcccccgggctgcaggaattcgtctcacccctagaaaaaatctccaacctcgagagcccaccaaacccaaagcccaggcctctccgtccccaatcccccatccggcttgccccccatgtcgtcgcagtgcccctactgccgcgcgtcggggccggcgcggtgcgcgacgacgcagccgccgctctcgcgcgccgtctccgagtgctccgcctgcgcccgaatcgtcctcgagcgccacctccacacgcaccccttcttccccctcctcccctcactccatccgctcccccttgtcacccccgacctcgccacagccatcgatcccgccccgtctccttcccccggcgacgaagatgacgagggacccctttctcccccgcggggcttcgtctccgcccttctcgggctttcttccctcgaggcgccacccccggtccttggcccgtttccggccttcaactttttttttgggaaacctttcccccaaaacctcgaagacgcgccccccccccctggttccaaaactcccgcccacaccggggggggccttcccaaaccccgcgggaaaccccccgcccgggggccccacaagggggggttttcccgggggcgaaaaaaagagagctttccccgggggggggccctttaaaccccttctcaaaaaaaaaataattgtgtgtcgaaaaaaaaattttctgcccgcccctcc

SEQ ID NO: 85256 - protein, 177 aa, Zea mays
  misc_feature: Ceres CLONE 1571520
MSSQCPYCRASGPARCATTQPPLSRAVSECSACARIVLERHLHTHPFFPLLPSLHPLPLVTPDLATAIDPAPSPSPGDEDDEGPLSPPRGFVSALLGLSSLEAPPPVLGPFPAFNFFFGKPFPQNLEDAPPPPGSKTPAHTGGGLPKPRGKPPARGPHKGGFSRGRKKESFPRGGAL

SEQ ID NO: 85257 - DNA, 824 bp, Zea mays
  misc_feature: Ceres CLONE 1571521
  misc_feature: Encodes the peptide sequence at SEQ ID NO. 85258
  misc_feature (715)..(715): n is a, c, t, g, unknown, or other
  misc_feature (716)..(716): n is a, c, t, g, unknown, or other
  misc_feature (812)..(812): n is a, c, t, g, unknown, or other
ctggagctccccgcggtggcggccgctctagaactagtggatcccccgggctgcaggaattcgtctcacccctagaaaaaatggacccgggcaacaaactggcctttgcaaaagcgcccttcagctcccggaccgcttcccctgagctgctgcccaagaacttcgacaccacttgcccaccctccctggattcttgcggctcttcctcgagctcatcgaatccttcatggagagcgccgagggaccgtccccgtactccggtgatcgagcggcaccggttcaggatggcaatggccaaactacacctgggcataattcgcgaaggccaaacctttctttgcaaataccagctaggaccttggataccaatataccttcatcgacaagagttactatatcctgcagccccagttcaacgagagtgggtttgccaccgagacctaattcgacgagaacaaaatcatctatcaagaacatgaatcctcagcacagtttcagagcaaggagttcagcccaggaaggtgatcgagtggtccttctaaatcctgggacgtcatctgaagggcagcaggataatccaagcacagcaagatcattttcttttagaaaggtcattaactcattatcggcaaaaaggacccattctcttccagtaacgcctgtaggaaactactgacaggctgcatctccctcaaaatcattagataccctgccnnactacacaaatgaaggagttgaagcaaaaattaggcgctccactttcagtacctggaaatcgcaaaaaccgaagtttgaggagggcgattcattangtgtcatcccgt

SEQ ID NO: 85258 - protein, 149 aa, Zea mays
  misc_feature: Ceres CLONE 1571521
MESAEGPSPYSGDRAAPVQDGNGQTTPGHNSRRPNLSLQIPARTLDTNIPSSTRVTISCSPSSTRVGLPPRPNSTRTKSSIKNMNPQHSFRARSSAQEGDRVVLLNPGTSSEGQQDNPSTARSFSFRKVINSLSAKRTHSLPVTPVGNY

SEQ ID NO: 85259 - DNA, 800 bp, Zea mays
  misc_feature: Ceres CLONE 1571524
  misc_feature: Encodes the peptide sequence at SEQ ID NO. 85260
ctccccgcggtggcggccgctctagaactagtggatcccccgggctgcaggaattcgtctcacccctagaaaaaagaggactccgcgtcgccaggcccgcttcgcgtgcgacgccggcatatagggtttcgccggcgccggcgatggacccaccccccgtgagccccgatcgctgggggcccagtcagggcgctggcgtcgggccctccggcctccgccgatatggcctcaatttctccgcctccagcctcctccaggcccccatcgcggccctccttgagtactccggcgtagtccagtccggccctgccctggcggcgcaccacccgtccgcggggccctcgtcgccgttgtccgcgtcggaggtcgatggtcttctctccgctgccgccgctggggacggggaggtttcgatccggattcagggcggcccaggcgacacggaggccacgggcgggccggatgcggggacctcgtccgaggatttgatcgaggcgaccgccggctctgaggttgaccaggcctccgctgcgggcaggggtgcaggtgctacggatgcggaggcaaacggtggcggggccggcacgtcggggaacgggggcggggaccgcgcgtaccagcgctacgacgtgcaccacgttgcgcgggtggttcggaccagatattgccgttcttcgctgcttctactccgtcgtctttcatacggaagcaatctttaaaggtttcttttgttacaaatttggaattgctgccggtaaaggttcaaagtccaaccaatatatttgaggaaaccaaactgc

SEQ ID NO: 85260 - protein, 191 aa, Zea mays
  misc_feature: Ceres CLONE 1571524
MDPPPVSPDRWGPSQGAGVGPSGLRRYGLNFSASSLLQAPIAALLEYSGVVQSGPALAAHHPSAGPSSPLSASEVDGLLSAAAAGDGEVSIRIQGGPGDTEATGGPDAGTSSEDLIEATAGSEVDQASAAGRGAGATDAEANGGGAGTSGNGGGDRAYQRYDVHHVARVVRTRYCRSSLLLLRRLSYGSNL

SEQ ID NO: 85261 - DNA, 780 bp, Zea mays
  misc_feature: Ceres CLONE 1571525
  misc_feature: Encodes the peptide sequence at SEQ ID NO. 85262
ctccccgcggtggcggccgctctagaactagtggatcccccgggctgcaggaattcgtctcacccctagaaaaagttcggacttccgccgcgcttcgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaggtcatgctggcaaggatcaagaggggtggtgctatcaggcaagagctcgccaagctgaagaaggcgtccacggcttaagtcccttttggtggatggcatgttagtttttggtttcatgttgcatcagcattttgttttgagtgttggcaaagccagaaatagtaatatgtttcatggggtaccctttttcaaacttcatccaagaatgggggtgctcctgggatttttttgccgggaaaggatatgaaaataccttaaggttagccttggcgaacaaaaaaaaaaaaaaaatggggaaa

SEQ ID NO: 85262 - protein, 134 aa, Zea mays; identical to SEQ ID NO: 72024
  misc_feature: Ceres CLONE 1571525
  misc_feature (44)..(120): Pfam Name: Ribosomal_L14e Pfam Description: Ribosomal protein L14

SEQ ID NO: 85263 - DNA, 828 bp, Zea mays
  misc_feature: Ceres CLONE 1571527
  misc_feature: Encodes the peptide sequence at SEQ ID NO. 85264
tggagctccccgcggtggcggccgctctagaactagtggatcccccgggctgcaggaattcgtctcacccctagaaaaaagcccactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccgacggccggggcccctccatctgggattcattcgcgcacgtcccaggaaatattgcagggaatcaaaatggagacgttgcagtggatcaataccatcgctacaaggaagacgtcgatctcatgaaaagtttgaactttgatgcctaccggttctcaatctcatggtccaggatcttcccggatggcgaaagggaaagtcaatccagaaagtgtagcgtattacaataatttgataaaatatctgctttcgcaaggcatgaactccttacatcaaccctttaccactatgatccttcctccttgcgcttgaaaaaaaaatatggagggtgggtttaaacgccgaaaaagggggggacttttttttacaaaccaattgctgacacttcttgtttttaaaaaacctccggcggaatccccgtataaaca

SEQ ID NO: 85264 - protein, 136 aa, Zea mays
  misc_feature: Ceres CLONE 1571527
  misc_feature: SWISSPROT Homolog: EC 3.2.1.21 Beta-glucosidase
MDARWAVLLALLVASGGVRVCAAAGAKGANWLGGLSRASFPKGFVFGTATSAYQVEGAASTDGRGPSIWDSFAHVPGNIAGNQNGDVAVDQYHRYKEDVDLMKSLNFDAYRFSISWSRIFPDGERESQSRKCSVLQ

SEQ ID NO: 85265 - DNA, 797 bp, Zea mays
  misc_feature: Ceres CLONE 1571528
  misc_feature: Pfam Name: CBM_4_9 Pfam Description: Carbohydrate binding domain
  misc_feature (91)..(91): n is a, c, t, g, unknown, or other
  misc_feature (109)..(109): n is a, c, t, g, unknown, or other
  misc_feature (138)..(138): n is a, c, t, g, unknown, or other
  misc_feature (611)..(611): n is a, c, t, g, unknown, or other
acccgcgggtggcggccgctctagaactagtggatcccccgaggctgcaggatattcgtctcacccctatgaaaaaaaaaaaaaaaaaaancagcggaaagttctttantgagatcagttctagctgttcgaatattntgggagtgccaatgtatactgaagtgcgtgctactctgtgggtacaagaatatggtcgtgagcgatatgtgggactggccaagtaagttgtttttgtttcttgttctctgttgataatgctctttttcggatccaatgacattattccttttctttctataaccaaagaaaccagacttctgatcagcaatggacacatttgaaaggaaagttcctccttcatgctccctttaccaaagctgttattttcatagaagggcctcctgctggaattgacattcttgtagatggtcttgtcttatctccagcaagaaagctccaagctgcaccatgcccaaaaattgagaatgttctgtatggaactaatctattgcacaataatggcttcactcgtgggctttctgggtggagtcctatggggtcatgtcgattgagtatccagactgaagcaccccatatgttacccttctatnctgaaagaccgtgcaagccagaaacatattaggtggtcattatatcccttgcacgaaacgcacagatgtttgggatgggtcccttcccaagtcataactgataaagctagattgcatgtcacttacagagtatctgcttggggtacaatttgtttcctggaagacatggacgtccccattttaaat

SEQ ID NO: 85266 - DNA, 783 bp, Zea mays
  misc_feature: Ceres CLONE 1571532
  misc_feature: Encodes the peptide sequence at SEQ ID NO. 85267
  misc_feature (714)..(714): n is a, c, t, g, unknown, or other
ccgcggtggcggccgctctagaactagtggatcccccgggctgcaggaattcgtctcacccctagaaaaaacaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctctttcttcaccagggcgactaccacctccgcctccgcaagctcgtccagagcgcgctcggccacgacgcgctgcgcgcgctcgttcctgaagtggtaggccgcgtgcagtccactctcgcttcctgggacgccggccacgtcagaagcacgttccacgccatgaagacgctgtcgttggacgtgggcatccgtgacgatcttcggcggccggctggacnaagtggcccaagccgacctgaagaagaattactccgccgggaaaaaggggtacaactcctgccccaacg

SEQ ID NO: 85267 - protein, 220 aa, Zea mays
  misc_feature: Ceres CLONE 1571532
  misc_feature: SWISSPROT Homolog: EC 1.14.13.93 (+)-abscisic acid 8'-hydroxylase
  misc_feature (198)..(198): Xaa is any aa, unknown, or other
MAFFLALVCILVLLAIASYVQYTRWQKGKGRFGGHGRSAPLKLPPGSMGWPYLGETLQLYSQDPSVFFASKQKRYGEIFKTHLLGCPCVMLASPEAARFVLVTQAHLFKPTYPRSKERMIGPSALFLHQGDYHLRLRKLVQSALGHDALRALVPEVVGRVQSTLASWDAGHVRSTFHAMKTLSLDVGIRDDLRRPAGXSGPSRPEEELLRREKGVQLLPQ

SEQ ID NO: 85268 - DNA, 837 bp, Zea mays
  misc_feature: Ceres CLONE 1571533
  misc_feature: Translation starting site: 266
  misc_feature (659)..(659): n is a, c, t, g, unknown, or other
agctccccgcggtggcggccgctctagaactagtggatcccccgggctgcaggaattcgtctcacccctagaaaaagagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcccctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacacaagcctatccgggtgatgtattcaaaccgtgatccaagcagccgcaggagtggatctgctaacattttcataaaaaatcttgacaagancatagacaataaaacccttcatgagaccttttcttcatttggtacatttctctcatgtaaaggtagccgtgggatgaagcaggccaattcaaaaggtttggggttttgtcaggatgacaaaagaagaagctgcgccgaacggctataaaaagtcttaacggaatgcttataaatgaaa

SEQ ID NO: 85269 - DNA, 850 bp, Zea mays
  misc_feature: Ceres CLONE 1571534
  misc_feature: Encodes the peptide sequence at SEQ ID NO. 85270
  misc_feature (734)..(734): n is a, c, t, g, unknown, or other
gcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggtaggtccacgtgaagcaacaactgggaggggtctgccggaacccccatcgaacgggcgtggctccgtccggaaagctcaatcggcgaaggtagaaggagcaggccgagagccacaaaggagaaaagttaagagcaagggggcgggcgccgcccccccgagcggggggggagagtgagaacatagtaccacgggggagaaaaacggtatatggccacggaaaggggttgaaggggcagcagggagcgaantgcggaagaaaggagacaggcattcccagtctcccactaggaagaacgagatcgcgccgttcgcacggaggaacactgtcacccatcgttctgcagtaaggggcacaggagcgaag

SEQ ID NO: 85270 - protein, 139 aa, Zea mays
  misc_feature: Ceres CLONE 1571534
MAATVSSCLSLVPTVHHRAGGFPSSVALTNTLQRRRRSRRYLVVASATRAEQEAAPVTIEDVDLSSHQAAADDGELAARWRVGPREATTGRGLPEPPSNGRGSVRKAQSAKVEGAGREPQRRKVKSKGAGAAPPSGGGE

SEQ ID NO: 85271 - DNA, 821 bp, Zea mays
  misc_feature: Ceres CLONE 1571544
  misc_feature: Encodes the peptide sequence at SEQ ID NO. 85272
  misc_feature (688)..(688): n is a, c, t, g, unknown, or other
tccccgcggtggcggccgctctagaactagtggatcccccgggctgcaggaattcgtctcacccctagaaaaaaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagggggagcgggtgcgtgtgcaggcgggtgatgcgctaccgctgccgatccggcacacgaacctcatcttctcggcgctgttcgccgcgtcgctggtgtacctgatgcgtcggtggcgggggaagatccgcgcctccacgccgctccacgtggtctcccccgccgagatcttcgccatctgcggcctcgtcgcgtcgctcatctacctcctcagcttcttcgggatcgccttcgtgcagtccgtcgtctccagcagcgacgacgacgaggacttcatcgtcgactcccgccacgcgcgggcgcgggcgccgccgaacgctgcgcagaacccgtgtgcgctgctggggagccccgcccgcgcgacggagaaaatgccggaagacgaccaggagatcttgggccccgttgtggcagggaaaaatcccgtcctacctggctggaatcaaggctgggaaaattgccnccggccccccgggatcaggagggaagcccttccccgaaccccggagggggaatgggacggctccccctcccaggggtttaaatacccgtccatcctggggcattgcttcaaaacttcccgttcggtaacttcc

SEQ ID NO: 85272 - protein, 224 aa, Zea mays
  misc_feature: Ceres CLONE 1571544
  misc_feature: SWISSPROT Homolog: EC 1.1.1.34 Hydroxymethylglutaryl-CoA reductase (NADPH)
  misc_feature (180)..(180): Xaa is any aa, unknown, or other
MDMDVRRRVPPPHGSVPRRQQATGAEGERVRVQAGDALPLPIRHTNLIFSALFAASLVYLMRRWRGKIRASTPLHVVSPAEIFAICGLVASLIYLLSFFGIAFVQSVVSSSDDDEDFIVDSRHARARAPPNAAQNPCALLGSPARATEKMPEDDQEILGPVVAGKNPVLPGWNQGWENCXRPPGIRREALPRTPEGEWDGSPSQGFKYPSILGHCFKTSRSVTS

SEQ ID NO: 85273 - DNA, 767 bp, Zea mays
  misc_feature: Ceres CLONE 1571545
  misc_feature: Encodes the peptide sequence at SEQ ID NO. 85274
tccccgcggtggcggccgctctagaactagtggatcccccgggctgcaggaattcgtctcaccctagaaaaagtgacaaaaaatgaacccgtgcactggcccccgttcgccgccctccccgccgtggggtccggtccgccgccctccccgcccatcccccgcccaacccgccgccggttcccgtccagccgcacgcgccttcttcctcccccggcgccttctcggtgaaccagacccgtccggccgtccctcacccgtgcgactcccgcagcgccggcccctccgtcacctccgcatcctccccgtccttgcggccatatccgtcgtctccgcatcctccttcctacgctctgtcggcgtggcctccccatcccggtgttctccgattttggggggcgtccctttgcccgctccggtctgctcctccagagtccggtccagcggagcgcactacgacacagatcggcagccgtccatccctttccagctctccagagcctccgccggcgcatccggcgactgatttgcagatgatgttgttatcttcctcaagccagctactactactagtgatatgctttcatcatggatgtgcttcacttggttgggggaaggcttctggtcttaaaaacaatgtgcaaaaaactagtgatttttcctataaggtgtggaaagataaataactgaatgggcaattcaaggcccttctgccatggcaaaatcctttgattttcccaatgtcaataccttggagccttgaataggga

SEQ ID NO: 85274 - protein, 50 aa, Zea mays
  misc_feature: Ceres CLONE 1571545
MMLLSSSSQLLLLVICFHHGCASLGWGKASGLKNNVQKTSDFSYKVWKDK

SEQ ID NO: 85275 - DNA, 790 bp, Zea mays
  misc_feature: Ceres CLONE 1571547
  misc_feature: Pfam Name: Copine Pfam Description: Copine
tccccgcggtggcggccgctctagaactagtggatcccccgggctgcaggaattcgtctcacccctagaaaaaagcgcggctgcgcctctctacctctgccaaatccaaacgagacggtcgccggaggaaggagacccgaaactcacctgagtcacctcccctcgcctcttcttattacgatctcgcgagggcggcagccgtcgcgtagccgctttcacacattcggtctccttcgccgccgcctatactcctgcagaaatagccccagagcgaaggcggttgctgcttcttcgtgttccttcgcccgccgcacacgggatccatttgaccgatcgaccgacccacacacaccgagagccagccatggggcaaaaccacagcgcgcaggacgggagcggccacggccggcgctccttccagcagcagccgtcggcgcagtggggcgccggaaggaggggggtactacgcccaggacccgaacgccggctactgcggcgcgccggtgccacaacagggaggagggtacgccgcgccttacctgcccccggcgtaccagtaccagcccaccgccgctgctccggcgccgcaagtcgcgaagccgcggcagctggaccggcggtactcgcggattgccgacgactatcactcggtggaacaggttactgatgctctagctcaagcaggacttgaatcatcaaatcttattgttggcgttgatttcacaaagagcaacgagtggacaggcaaattctctttcccatggacgtagtctacatcacattagcaact

SEQ ID NO: 85276 - DNA, 752 bp, Zea mays
  misc_feature: Ceres CLONE 1571548
  misc_feature: Encodes the peptide sequence at SEQ ID NO. 85277
ctctccgcggtggcggccgctctagaactagtggatcccccgggctgcaggaattcgtctcacccctagaaaaattttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccggcccgaggacagccccacccgcctcctcttcagcgtcggcaagtgcaccgtcaactcggcgccctacggccccctgtggcgtgctctgcgccgcaacttcgtcgccgagatcgtgtccccgcaccgcgtcaagggcttctcctggatccgggagtggggcgtggacgcccacttgcgccgcctctgcgccgagctcccggcggacggggccgtgcgggtcatgggcagctggccccctcaccatctgcagaatcctcatctggatctggcttcggggccaagatccccaacgaactcttcccggaaat

SEQ ID NO: 85277 - protein, 204 aa, Zea mays
  misc_feature: Ceres CLONE 1571548
  misc_feature: SWISSPROT Homolog: EC 1.14.13.89 Isoflavone 2'-hydroxylase
MDVNDVLLVVLAAALAAMWWRRCSKTGGVDGLPPGPPGWPVVGNLFQVILQRRPFMYVVRDLREKYGPIFTMRMGQRTLIVVTSAELIHEALVKQGPMFASRPEDSPTRLLFSVGKCTVNSAPYGPLWRALRRNFVAEIVSPHRVKGFSWIREWGVDAHLRRLCAELPADGAVRVMGSWPPHHLQNPHLDLASGPRSPTNSSRK

SEQ ID NO: 85278 - DNA, 912 bp, Zea mays
  misc_feature: Ceres CLONE 1571549
  misc_feature: Encodes the peptide sequence at SEQ ID NO. 85279
gagctccccgcggtggcggccgctctagaactagtggatcccccgggctgcaggaattcgtctcacccctagaaaaaattccgctcgcggttgcctccgcctccgccctaacccaatccagagccagggcagggcaaccaaaccctaggccctcgcgctcgtggtatccatgggctgaccgcgtcccggtggggagcccggatccagagctagggttccgtcctcggcggcaacgccatggagtgggacagcgagtccgacggcgccggcagcgtcggcgtcgacgagcaggaagaggagcaggaggaggaggagcggggaggcgagggaggaggtggcgacgccggtgggatgttcacgctcgcgattgaaggcatgctgcgcgcgtccggtccgtgcgggctcgtcgtcaaggacgcgctcgagcccgactgtcccatcatctacgccaaccgcggcttcgaggaggctacgggctaccgcgccgaggagtttcttggcaggaactgtcgattcctgcagtgtagagggccatttgctcgaaagagacaccccctaattaatgctgcagtggtttcagagattcaaagatgcataaaccatgggctttgaagtcccggggcgatttatttaattttcagaaaagaaggaatcgccactgatggaacaaggttgccatctggaccccttttttttgggaaaatgaatgaaaacccttaaccccatttatattggggcaattccaggttctttcacttggaagccctaaatggttggattttggggaacccattttgccctcggtccccagggacacaaggggaaacccgggtggagggtcccaaccacccggtttgtcgcttccacagaaaaaacttcaatttgtcgcgacacccattttttccgggcggg

SEQ ID NO: 85279 - protein, 124 aa, Zea mays
  misc_feature: Ceres CLONE 1571549
  misc_feature: SWISSPROT Homolog: EC 2.7.11.1 Non-specific serine/threonine protein kinase
MEWDSESDGAGSVGVDEQEEEQEEEERGGEGGGGDAGGMFTLAIEGMLRASGPCGLVVKDALEPDCPIIYANRGFEEATGYRAEEFLGRNCRFLQCRGPFARKRHPLINAAVVSEIQRCINHGL

SEQ ID NO: 85280 - DNA, 791 bp, Zea mays
  misc_feature: Ceres CLONE 1571551
  misc_feature (708)..(708): n is a, c, t, g, unknown, or other
ccccgcggtggcggccgctctagaactagtggatcccccgggctgcaggaattcgtctcacccctagaaaaaactgcatatacgcattactgcttgtccacctcctctccccctcagtgcagcgcatcgacatctgccaatttcatccacatcctcatcctcacccctgtgctgctacatatcgcatccaatctatttatggaaagacaccacgacccatagatcgtctctctctaccgccacctcaattgaaggttcacagatctcatacgcggattcgctatctactactgcggcagccgtcgataaaaggtcccagaactccgcacccattacatgtctccccatgaactgccttcaggtctgccatttatgaaggtccgaaagttctgcatcggctggacgtagatggaagggactacatgtgctctatctattacctcactgaaggcagcgagaaggccaccatttttggaacgtccaccaactcctcctcgacgtgatcagaaatgccctgggagagtacccacctcctcgtctggcctcgacaaaatggagtgggacgatgtccagctgtactcctcccattatcacgaccgcacctatatattaatgtacggcgacaaggactcgcgacgtggaggccatggctcgaacctgagcctctgctggccctgacatcgagcgcggccgtcggacatggtgttngcccgtcatggtccgacgatggtgaaccgtagcgtggcctacaccgctatccatctccgaaagtcgacgaagaatcctgtcaa

SEQ ID NO: 85281 - DNA, 818 bp, Zea mays
  misc_feature: Ceres CLONE 1571553
  misc_feature: Encodes the peptide sequence at SEQ ID NO. 85282
  misc_feature (763)..(763): n is a, c, t, g, unknown, or other
ctggagctccccgcggtggcggccgctctagaactagtggatcccccgggctgcaggaattcgtctcacccctagaaaaacttccttaaacccaccccggcatcgggcacgccgcacgccacgcctcaccgagtcaccttcccagccagctacccttccccctaccaattccaaatctctcacccggcttgaggatggcggcgcaggtggtcgcagcggcgggcaccccggtggccaggccgctgggcggtggatctggggccgacgcgctccggcccgcggcgaggatgccaagggagagaaggaccggtgctgtggccgcgagaggacgccgcgagtctcaggtggtatccgtcataagccgcgccccacgccccgatgccggggtgctgccggtgtcgcccgacgacgacgcggccgtaaaggaagaagcaaacttccagcaccttaaggctatccagcaacttgcaactgcagcaaatggcgtgtggtctaaaccaaatgtaaggcgcaagacaaagattgtgtgtacaatcggtccttcaaccaacacaagggacatgatatggaaactcgctgagactggcatgaatgtggctcggcttaatatgtcacatggagaccatgcatcacaccagaaaagtattgatctggtaaaggagtacaatgcatcacaggctgacaatgtgattgctatcatgcttgacacaaagggaccagaagtcgaagtggagatttgcctcaccgatatttctgggaagcngacaagaattacttttacatcaaaaagggagtggggactgatacctgtgttagcc

SEQ ID NO: 85282 - protein, 208 aa, Zea mays
  misc_feature: Ceres CLONE 1571553
  misc_feature (105)..(207): Pfam Name: PK Pfam Description: Pyruvate kinase, barrel domain
  misc_feature: SWISSPROT Homolog: EC 2.7.1.40 Pyruvate kinase
  misc_feature (190)..(190): Xaa is any aa, unknown, or other
MAAQVVAAAGTPVARPLGGGSGADALRPAARMPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHASHQKSIDLVKEYNASQADNVIAIMLDTKGPEVEVEICLTDISGKXTRITFTSKREWGLIPVLA

SEQ ID NO: 85283 - DNA, 859 bp, Zea mays
  misc_feature: Ceres CLONE 1571554
  misc_feature: Encodes the peptide sequence at SEQ ID NO. 85284
  misc_feature (859)..(859): n is a, c, t, g, unknown, or other
ctccccgcggtggcggccgctctagaactagtggatcccccgggctgcaggaattcgtctcacccctagaaaaaagcctagtagcctaccgtttcaatttttgaactcccggtccggcaaccctccccagccagcgttccactcactccggcatcgcttcgaatctccgcgcggcggcgggaccgcgtgaccgacgcgcggcgctgccccttcagaaagccgcatggacgccgccgaccccctctgcgccatctcctcgactgcgcgactccttccgcggacccttggccccgccattgggccttccccctcgaacccccgcgacgcgctcctcgaggccatcgcactcgcccggtctctgaaagggtctgaggagctggttaagcaggctacaatggtgccgaaggagcacggggacatccaggctctctaccatgatgatggagtgaaaggctggcctcctgcaaatggcagcaaagagcaacagggaagaaggccagcactggatcgtaaacgggctcggtttgctatgaaggacactggaagcaaaccgggtgcctgttgttgaccaatcttagttatcaaatatttcagaatcaatcccattcttcatggactttggatcggcttgaagaagcgaaggaggagatcaaacggttaaattggaaaggcagaaaaaccccctttgaaatttggatcctgtagaagaaccccttaaaacccccctggttttacttggggagaaaaaaagtcccccatttttcaggggaaattgggggaggttggggacccccaagatcccaaagggggggccgggggttctccaaaaggggcgcttttgtgggggggttcctctttn

SEQ ID NO: 85284 - protein, 114 aa, Zea mays
  misc_feature: Ceres CLONE 1571554
MDAADPLCAISSTARLLPRTLGPAIGPSPSNPRDALLEAIALARSLKGSEELVKQATMVPKEHGDIQALYHDDGVKGWPPANGSKEQQGRRPALDRKRARFAMKDTGSKPGACC

SEQ ID NO: 85285 - DNA, 719 bp, Zea mays
  misc_feature: Ceres CLONE 1571556
  misc_feature: Encodes the peptide sequence at SEQ ID NO. 85286
ctccccgcggtggcggccgctctagaactagtggatcccccgggctgcaggaattcgtctcacccctagaaaaaccaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaagagagcaccctccaccttgttctccgcctcaggggaggcatgcagatcttcgtcaagaccctcactggaaagactatcaccctcgaggtggagtcttctgacaccatcgacaacgtcaaggcccagatccaggacaaaggagggcatccctccggaccagcagcggctcatttttgctggcaagcagctcgaggacaggcgcacgctgggccgactacaacattcagatggagagcaccctccactttggtgttgcgtctcaggggcggcatgccaatcctccgtgaaaaccctgactgggcaagacttccccccttgaggggcaagccttcggatacccttggacaatggcaagggcccaaaacccagg

SEQ ID NO: 85286 - protein, 186 aa, Zea mays
  misc_feature: Ceres CLONE 1571556
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAQIQDKGGHPSGPAAAHFCWQAARGQAHAGPTTTFRWRAPSTLVLRLRGGMPILRENPDWARLPPLRGKPSDTLGQWQGPKTQ

SEQ ID NO: 85287 - DNA, 877 bp, Zea mays
  misc_feature: Ceres CLONE 1571558
  misc_feature (877)..(877): n is a, c, t, g, unknown, or other
ccccgcggtggcggccgctctagaactagtggatcccccgggctgctggaattcgtctcacccctagaaaagtaccgcaccgccacctggcgccgcaatccggagccggagctctacgagggcgagaggccgaggtgagatgagcgaggatgccgccgacctaccgtgcgtctggccccgcggctgcgtcagcaggttgtagacggcctaccatgagcaggacctccacaaggcggccgggcccgggccacaccttgtcggagaaggaggcgcaggccgtcgcgttctgctgagatgccgtgatcgccgagttcgagtcccgtcacgcgggacgccgccgccgtgcatcgtacatcgctgcgccggatctctgacgacaatgcctgtttctcacccactccgttgccaggggcttcgttggtcgcacccgacgcggccagttttccgtttctgcgttgccaattttgccccggatacgaaattcgaggcccttcctttgcgcggtttttgccctaggggggaacctgttccccccggggttttcccgctctagaccctttctccctccaaattttccctttcaggtttccggggcattaactttattgggaaaagtggcaagttagccttgtttcctttttccccccggtagacttgggttcaggatccccccaaattgccaaaaatttacctcggaattttccttattggccttttggggaaaacggggggggttttctccccttggaagggaagggcaaaggcccccttcctcttttttttcttcggggggcgccggggaaattttttccccccctatggcgcgggttttaaaatgtggtaaaaattggggcccaccccccaaattttttctccn

SEQ ID NO: 85288 - DNA, 945 bp, Zea mays
  misc_feature: Ceres CLONE 1571560
  misc_feature (688)..(688): n is a, c, t, g, unknown, or other
  misc_feature (945)..(945): n is a, c, t, g, unknown, or other
aaagctggagctcaccgcggtggcggccgctctagaactagtggatcccccgggctgcaggaattcgtctcacccctagaaaaaagagtctagagatctgttgtaggacgaaacgagttctttgtcctgggcctttgtcactcttctctgtgtaacgacttcctccctttcctgccgcaccacgcaatcaccggaggcggaggcggctgccggcgagcacttgggcgtctccggccaccgcctgcctcgttgtgatccaactaggaactcacccagcgctatctcccggcaggctccccgttgactcccgcgatttgttacccgctggcgctgccccacacagctcaaaaggagtagcagcgcccctggttggcggttgggagcgtcatagatgagcggggaagaaaaatgccgggcaaagggttccccccctgggtggctcggtccctcatctggttttaggggggctttttttggtgaccctacaaaccttccctggaagattgccccacgccccgggggaacgggggatggggggccgcccgcaaaagttttcccccggggcggggggggcgcggggggaatacgccccactttcaaaatctggcgccccggtgttggggggggtccaaggggcgtcctggaattttccggaaaccccccggcgggaaaagggggggtttccacnctggttggggggcttgtttggggcggaaccgggaaacgaaaactgtgtgacaaggtcgacggggggcggagtccgccgggaaataaatggtcacccctccggggggcgtttttggggcgggatttgggagggggcgcccagcccccgggtgttcccgcaaaaaagggtgggggggcggtctccctcaaggatgacgccgtcgacccccggtggggatagccccgggatgtggtattgggtaggggaactagagaatn

SEQ ID NO: 85289 - DNA, 910 bp, Zea mays
  misc_feature: Ceres CLONE 1571561
  misc_feature: Encodes the peptide sequence at SEQ ID NO. 85290
ctccccgcggtggcggccgctctagaactagtggatcccccgggctgcaggaattcgtctcacccctagaaaatttaccttgaatcttctcgtgtcattcagtttccaattgaatgctcgctcccgtggatgctggtggaccatgtcattgaatcagaagatgctggtcttctcgaaagcattttgattccatttgacctgtacaatgactctgctcaacatgcactaacttctctcaagcagagatttctttatgatgaaattgaagctgaggctgatctttgcttcgatcttcttgctcagaagcttaatgagatcatctttacatattataagagctgtgcagcaagtactcttcttgatagttcatttacatatgcatgcgatgacccccacaagtattttgtcaaacctttgcgattcgacgcgattttcaagttaaggagagtaatggttttagggaggacaattgatctaagaagcataattactccgagaaagaacaaaatattcagggaaaaaattgactttctactttaagcgctttgaaaatgggaaatcttttgtgggtgttggggaaactgccaacaactgccgggataattttgggagctttcccccccaatccaatatcaaagattttcttgaattggaattcctaacccccctatagccttaacgcgaaatccaaaaaaaacctggcattgggtttttttttaataaggcccccctcctcttttcaaaaagtggaggtggaaggccccaaaattttttttccaaaatttttctcttttgaaacaccaccatccgggtgttttcctgcccacaaaaagaaacccctctctcttttcaaaaaaaaaaggtttttttttggggaaaaattttttttttttggggaaacaaagaaatg

SEQ ID NO: 85290 - protein, 136 aa, Zea mays
  misc_feature: Ceres CLONE 1571561
MLVDHVIESEDAGLLESILIPFDLYNDSAQHALTSLKQRFLYDEIEAEADLCFDLLAQKLNEIIFTYYKSCAASTLLDSSFTYACDDPHKYFVKPLRFDAIFKLRRVMVLGRTIDLRSIITPRKNKIFREKIDFLL

SEQ ID NO: 85291 - DNA, 883 bp, Zea mays
  misc_feature: Ceres CLONE 1571565
  misc_feature: Encodes the peptide sequence at SEQ ID NO. 85292
caccgcggtggcggccgctctagaactagtggatcccccgggctgcaggaattcgtctcacccctagaaaaagctgagtctctcacctgctggcggaggcggcccccaaaagccaaattccccagcccacaccacctccacactccaggttagggtttgctgtcggcgatgtcggatcggcagccgtcggaggaaccggaggagcaggtggacctggagggggacgacgacggcatggacgacgacgacgccgggtaccgtcgccgcggaagccgggacgactcggaggagcccgaggaggatgacgacaatgacgagcgccacggcgaggccgacgacgacgccgggatggagccggagccggccggaagtaaaggcggggatgacacgggcaaggggcccgacgtcgccggtggcgggcccgaggacgaggaggagaggagcaagtgggatgacatgctcgccctgccgccccatggctctgaggtcttcattggtggcctgccccgcgacatcacggaggaggacctccgtgagctgtgcgagccgttgggagaaatatatgaggtgaggttgaccaaggataaggacacaaaggagaacaaggggttcgcctttgtcaccttcatggacaaggaggctgcgcagcgcgccctcgaggatgtgcaagacagggagtttcagggggaggacttttgcggggcttctctgtcgcaggcaaaaccacagggctgttttgtttgggaaatgtgcccaagggggcttaagcgagggaggaagcttcccacccctattcaagggggagagggtcccgggtggttattccactatttgaaaatggtttaaggggattcaccctggaccccaaacccgtatacccggt

SEQ ID NO: 85292 - protein, 225 aa, Zea mays
  misc_feature: Ceres CLONE 1571565
  misc_feature (107)..(177): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSDRQPSEEPEEQVDLEGDDDGMDDDDAGYRRRGSRDDSEEPEEDDDNDERHGEADDDAGMEPEPAGSKGGDDTGKGPDVAGGGPEDEEERSKWDDMLALPPHGSEVFIGGLPRDITEEDLRELCEPLGEIYEVRLTKDKDTKENKGFAFVTFMDKEAAQRALEDVQDREFQGEDFCGASLSQAKPQGCFVWEMCPRGLKRGRKLPTPIQGGEGPGWLFHYLKMV

SEQ ID NO: 85293 - DNA, 769 bp, Zea mays
  misc_feature: Ceres CLONE 1571568
  misc_feature: Translation starting site: 155
  misc_feature (138)..(138): n is a, c, t, g, unknown, or other
cccgcggtggcggccgctctagaactagtggatcccccgggctgcaggaattcgtctccccctagaaaaaacagcaccagaccaattaactagcttcttctagctctagctaggggctcgtctggctgcaagaaggtnaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtcctttcgcggcatgatctttcgccctcgtctactgcaccgcccggcatcttcgggggggcacatcaaccccggcggtgacctttcgggcttgttcttggcgagggaagttgtccctcacccggggcggggttttacatcatccaagcaggggcttggggcccattttggggggcggggcgtttttcaaaggggttcccaccagggggtttaaattgggggaaaagggggggggggcccaaaatttgggggggccccgggttaacccaaggggggaaaggccttaggggccccaaaaattttttgggaccctttttttccttgttttaaaacc

SEQ ID NO: 85294 - DNA, 801 bp, Zea mays
  misc_feature: Ceres CLONE 1571576
  misc_feature: Encodes the peptide sequence at SEQ ID NO. 85295
ctccccgcggtggcggccgctctagaactagtggatcccccgggctgcaggaattcgtctcacccctagaaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaaacagcgaaagcactagttgaagaactacggaagttgtctaaggaggtcgaagatagtgagcttgcagatgttgctgctgttagtgcgggcaaacactacgaaatttgggtatatggatagcagaggccatgaagcaaggtcggtccggaaaaggtgtgggttc

SEQ ID NO: 85295 - protein, 195 aa, Zea mays
  misc_feature: Ceres CLONE 1571576
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKEVEDSELADVAAVSAGKHYEIWVYG

SEQ ID NO: 85296 - DNA, 809 bp, Zea mays
  misc_feature: Ceres CLONE 1571577
  misc_feature: Encodes the peptide sequence at SEQ ID NO. 85297
tggagctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttccgccgcgcgcagggcgggcccggcgccgggcctggtggcctcggcgggcccatggtactcggccgctcca

SEQ ID NO: 85297 - protein, 219 aa, Zea mays
  misc_feature: Ceres CLONE 1571577
  misc_feature (103)..(219): Pfam Name: FtsH_ext Pfam Description: FtsH Extracellular
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFIAFAGLFFLFRRAQGGPGAGPGGLGGPMVLGRS

SEQ ID NO: 85298 - DNA, 831 bp, Zea mays
  misc_feature: Ceres CLONE 1571578
  misc_feature: Encodes the peptide sequence at SEQ ID NO. 85299
  misc_feature (703)..(703): n is a, c, t, g, unknown, or other
  misc_feature (826)..(826): n is a, c, t, g, unknown, or other
agctccccgcggtggcggccgctctagaactagtggatcccccgggctgcaggaattcgtctcacccctagaaaaagtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccaagatccaggacaanggagggcattccccccagaccagcagcgggctcatcttttgctggaaagcagctttgaggaacgggcgcacggctgggccgactacaacattccaggaaggagagcacccctctcaccttgtntgctc

SEQ ID NO: 85299 - protein, 227 aa, Zea mays
  misc_feature: Ceres CLONE 1571578
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (185)..(185): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDXGGHSPQTSSGLIFCWKAALRNGRTAGPTTTFQEGEHPSHLVC

SEQ ID NO: 85300 - DNA, 797 bp, Zea mays
  misc_feature: Ceres CLONE 1571581
  misc_feature: Encodes the peptide sequence at SEQ ID NO. 85301
ccgcggtggcggccgctctagaactagtggatcccccgggctgcaggaattcgtctcacccctagaaaaaatcctggacgcccgtccggctctgctccattcccttcgtctccctccagcagcctccggccatcgccctctgcgatgacctccacgacgccggggaccttcggaacgctggctaactccggaccggtcgcgctctcgttcccgacgaccacctccttcgcaagcttcctaggcggcggttcgagtcctagccgaataatggacagcgggggaggagtcgggctgtccaagttcaaggccatgaccccgccttccctcccgctgtcgtcgtcgtacccgccgccggcgcagtcgtacctacacgcgttctccggcctcctcgactcgcccatcctcttgactcccagcttattcccgtcgccgacgacgggcgcgatcccgtcggagcccttcaactggatggggacgccggagaacgacctaagcggcagcggcggcgtagaggctgagcagcgccagcagtacaccgacttcgcgttccagacggcggcggcggagacgtcgacgattattaccggcgcggcgcacacggcgtccttcccgcagtcgtctgtgctgatgcccccatcgggacgagtaggagactcgtacagcggcgagatgctgcagcagcagccgccgtggtactacaggtaaccgacggcgctattcgaggcgccggcggcgcaagctggcaacatgttcggcaccggcggcggctacggcgcggctcccggcttccgcgagca

SEQ ID NO: 85301 - protein, 145 aa, Zea mays
  misc_feature: Ceres CLONE 1571581
MDSGGGVGLSKFKAMTPPSLPLSSSYPPPAQSYLHAFSGLLDSPILLTPSLFPSPTTGAIPSEPFNWMGTPENDLSGSGGVEAEQRQQYTDFAFQTAAAETSTIITGAAHTASFPQSSVLMPPSGRVGDSYSGEMLQQQPPWYYR

SEQ ID NO: 85302 - DNA, 845 bp, Zea mays
  misc_feature: Ceres CLONE 1571582
  misc_feature: Encodes the peptide sequence at SEQ ID NO. 85303
ggagctccccgcggtggcggccgctctagaactagtggatcccccgggctgcaggaattcgtctcacccctagaaaaacacgccgtccccagtccccactctcccccgcccccctcgccccacgcatgagaggagagcggccggacctggaagcttctccgcggcgctgcgtcgccagctcgcagcggtgactggtgtcctttcaacttgaccttcgccaccgttagctagactcgttcgcgatctcagatggacaccctagtgacactataccatggaggaagcgtggagcaagatgtttatgggaatgttagtttttatgctatgaagaatgtgaccgtgatgttcgatgaaagaccctcttttggccagattttcgctcgggcttgtgaggagattagttgcaatttaaacgaccctagcatatcaattgagggtttattgtcccatgttacatctgggacagttgttcgaacgttgatctccattgcctctgaagatgacttggtgaaaaatgttcaaatttgtgaggacgatggttccccccatgtttgaatggggtgtgtccaaaagtttccgtttagcccgtggcaaggccccagggcggggttttctcccccaaaatcccaaaatgccggtccaaagaaaaacccccttttgtttgacgtttccaaaaaaaagggggtttttttggcccaaaaatccaaaatcggccccttaaaaagagtttaaaaaaattttcccccccctttttcccccgggctttttgggggggctttctaaaaaaccgggggggcgccccccccctcgaggaaacccccctgtttatacacgggggccaccac

SEQ ID NO: 85303 - protein, 101 aa, Zea mays
  misc_feature: Ceres CLONE 1571582
MDTLVTLYHGGSVEQDVYGNVSFYAMKNVTVMFDERPSFGQIFARACEEISCNLNDPSISIEGLLSHVTSGTVVRTLISIASEDDLVKNVQICEDDGSPHV

SEQ ID NO: 85304 - DNA, 812 bp, Zea mays
  misc_feature: Ceres CLONE 1571583
  misc_feature: Encodes the peptide sequence at SEQ ID NO. 85305
  misc_feature (706)..(706): n is a, c, t, g, unknown, or other
  misc_feature (707)..(707): n is a, c, t, g, unknown, or other
  misc_feature (719)..(719): n is a, c, t, g, unknown, or other
  misc_feature (722)..(722): n is a, c, t, g, unknown, or other
  misc_feature (745)..(745): n is a, c, t, g, unknown, or other
  misc_feature (746)..(746): n is a, c, t, g, unknown, or other
ctccccgcggtggcggccgctctagaactagtggatcccccgggctgcaggaattcgtctcacccctagaaaaagccggccacaacgacgtactagctagcttagctagctcgttcgatcgcgtgcgtcgttccacaccgacgagcggcatggaggcctccgccaaactgcccgtcgtcgtcccgaagggcgtcggcggcatggacaacgacgacgtcgcggcggcgggcggcaagaagcaggcggcggcgggcaggtgggggttcgtgcagttcttcttcgtgctcgccgtcgtcttctgcgtgctcctctacgcaccgcgcgtcctcgtgctcagcccgtacgggtacagcatcgacgtcgggctcttcgcgccgacgccgacggcctcgtcggtgccgcagcgcgtcgccggaggcaatgcggtggcccttgacaaccaggtgcgctcgccgtgctcgtccatgcgcgaccacaccatctgctgcgaccgctccagcgtgcacacggacgtgtgcttcatggccggcgacgtgcgcacggacgccgcgtcgctgtcgctcctgctgttcccgccgcaccagcaggcgcagaacggcacctcggaagaggacaaagaggagagggtgcggccgtacccgcggaagtgggagcgcttcatcatggacaaggtccccgaggtgcggctccgtgtgggcgcgccccnngcgccgaggggnaancgggccgaagaagaagaacaccnntccgacgtacggcacgacgcgccgttgctcgtcatgttcgcgggggggctacaccgggcaccttgt

SEQ ID NO: 85305 - protein, 221 aa, Zea mays
  misc_feature: Ceres CLONE 1571583
  misc_feature (186)..(186): Xaa is any aa, unknown, or other
  misc_feature (191)..(191): Xaa is any aa, unknown, or other
  misc_feature (199)..(199): Xaa is any aa, unknown, or other
MEASAKLPVVVPKGVGGMDNDDVAAAGGKKQAAAGRWGFVQFFFVLAVVFCVLLYAPRVLVLSPYGYSIDVGLFAPTPTASSVPQRVAGGNAVALDNQVRSPCSSMRDHTICCDRSSVHTDVCFMAGDVRTDAASLSLLLFPPHQQAQNGTSEEDKEERVRPYPRKWERFIMDKVPEVRLRVGAPXAPRGXRAEEEEHXSDVRHDAPLLVMFAGGLHRAPC

SEQ ID NO: 85306 - DNA, 906 bp, Zea mays
  misc_feature: Ceres CLONE 1571585
  misc_feature: Encodes the peptide sequence at SEQ ID NO. 85307
  misc_feature (63)..(63): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
aaaaaaaaaaaaaaatataaaaaaatagttttgaaaatagatattgttttgtacttgtttttntnnnccccccttattttttaagctggagctcaccgcggtggcggccgctctagaactagtggatcccccgggctgcaggaattcgtctcacccctagaaaaaggagtctccgtcaccacctcgcctgctagcctcctccgtctgctcaagacgagggaggagcagagaccgaactctgccgtctcttcctcctccctctgcacccccacgagctccatggccgccaccgccatgattgggattaccaacctacgttgccgccacgacccgctctcctcccttccccgggctacgtcgtcggccgcccggtcctgtacactgcttcctcctcgatgccgccgccattcttcttgctgctccccttcctcctccgtctctccgtgccgggcccgggtccgaccaacagcagcactgaagcgcatccctgccgccgacaccggcttcatgggtccagccaacaatgaggccaccacgcttaaacgatcatcgtcggccgaccttcgccgccgccttatcgtccccagctccaccgctggcaccggacacgccgccagtgcttccacaggagtgctgcccgccattatcggggtggcgcatctgctcgtgtcgctgggcattctgctcgccatggacaagttcctcaagcaggcattcgtcccccacgtccatcaagttccccgagtgccccttttcgggaatgtttctggtgtcctttctcgggagcctccgtagttcttcaaaaaccatttcgatggccctcccttctttcaagaaaagggcgttttccaattgggacctttccttttgtggagagccccggccccagcggtctgtgttttcaaa

SEQ ID NO: 85307 - protein, 171 aa, Zea mays
  misc_feature: Ceres CLONE 1571585
MAATAMIGITNLRCRHDPLSSLPRATSSAARSCTLLPPRCRRHSSCCSPSSSVSPCRARVRPTAALKRIPAADTGFMGPANNEATTLKRSSSADLRRRLIVPSSTAGTGHAASASTGVLPAIIGVAHLLVSLGILLAMDKFLKQAFVPHVHQVPRVPLFGNVSGVLSREPP

SEQ ID NO: 85308 - DNA, 804 bp, Zea mays
  misc_feature: Ceres CLONE 1571587
  misc_feature: Encodes the peptide sequence at SEQ ID NO. 85309
  misc_feature (750)..(750): n is a, c, t, g, unknown, or other
ctccccgcggtggcggccgctctagaactagtggatcccccgggctgcaggaattcgtctcacccctagaaaaaatgcaacaccacaagcacatcaaaaaattcccgagaattgagaaagcccactcgttagtcgttgctcccaagaccgggaatccatggagccggcctatgtcgtcaccctctccttcctcttcctcttcttgctccaccatctcctcggccgccaccgccgcaggaccaatggcaagaacaagagaacgcagctgccaccgagccctcccgccatcccggtcttgggtcacctccacctcctacggaagcctatccacgcgacgctcgctcgcctcgcggagcgctacggtccggtgttcttcctccggctcggctcgcggcaagccgtggtggtgtcgtccgcggcttgcgccacggagtgcttcaccgagaatgacgtctgcttcgcgaaccgcccgcggttccccacgctcctgctggtttccttcggcggcgccacgctcccaatgtgccgctacggcccgtactggcgcaacctccgccgcgtcgccacggtgcagctcctgtccgcgcaccgcgtcagctgcatgctccccgtcatatccgccgaggtgcgcgcaatggcgcggaggatgtaccaatccgccgccgccgcccccgccggcgccgcgagggtcgagctgaagcggaggctgttcgagctctcccacagcgccctgatggagaccatcgcgcngaccaagacgtcccgtgcccgtggccggacaacgaacaccgacatgtcctcggg

SEQ ID NO: 85309 - protein, 215 aa, Zea mays
  misc_feature: Ceres CLONE 1571587
  misc_feature: SWISSPROT Homolog: EC 1.14.13.89 Isoflavone 2'-hydroxylase
  misc_feature (198)..(198): Xaa is any aa, unknown, or other
MEPAYVVTLSFLFLFLLHHLLGRHRRRTNGKNKRTQLPPSPPAIPVLGHLHLLRKPIHATLARLAERYGPVFFLRLGSRQAVVVSSAACATECFTENDVCFANRPRFPTLLLVSFGGATLPMCRYGPYWRNLRRVATVQLLSAHRVSCMLPVISAEVRAMARRMYQSAAAAPAGAARVELKRRLFELSHSALMETIAXTKTSRARGRTTNTDMSS

SEQ ID NO: 85310 - DNA, 822 bp, Zea mays
  misc_feature: Ceres CLONE 1571588
  misc_feature: Encodes the peptide sequence at SEQ ID NO. 85311
  misc_feature (802)..(802): n is a, c, t, g, unknown, or other
  misc_feature (819)..(819): n is a, c, t, g, unknown, or other
ggagctccccgcggtggcggccgctctagaactagtggatcccccgggctgcaggaattcgtctcacccctagaaaaagtctgtatgcggcaccacggcgcccgtggggcccaccacggcgccgccggcagcgtcaccaacccccacccccacctccgccctcccaccggcactcccctcgcctgctccacgacgcttatgcgctcgcgccccgctctcgccgcccacctccggcgcctgctcctcctctctccctccgcccacctcatcatcatccgccgcgccatggcatccgccgccgccgcgcaggcgcagccaggtggcgccccgccggcgaccgcggagtacgaggaggtgctggggcggctctcctcgctcatcacgcagaaggtgcgcgcgaacagcgccaaccgcggcaaccagtgggacctcatggagcactacgtcaagattctggagctggaggagtcgatcgcgcggatgaaagtgattcacgtcgcggggaccaaggggaagggttccacatgcacattcaccgagtcaatcctgcgatcgtgtggcttccatactgggctgttcacctcaccacatttgatggatgttagagagcgatttcagctagatggggttaatatttctgaagagaaatttttgaagtacttctggtggtgctggaacaagttgaaggagaagactgatgatgatattcccatgccagcctatttcaggttcctcgcgttgctcgcattcaagatatttccctagaactagaaaaatctgctgagcaggtagatgttgctgntctcgaggtggccctangag

SEQ ID NO: 85311 - protein, 188 aa, Zea mays
  misc_feature: Ceres CLONE 1571588
  misc_feature: SWISSPROT Homolog: EC 6.3.2.17 Tetrahydrofolate synthase
MRSRPALAAHLRRLLLLSPSAHLIIIRRAMASAAAAQAQPGGAPPATAEYEEVLGRLSSLITQKVRANSANRGNQWDLMEHYVKILELEESIARMKVIHVAGTKGKGSTCTFTESILRSCGFHTGLFTSPHLMDVRERFQLDGVNISEEKFLKYFWWCWNKLKEKTDDDIPMPAYFRFLALLAFKIFP

SEQ ID NO: 85312 - DNA, 787 bp, Zea mays
  misc_feature: Ceres CLONE 1571590
  misc_feature: Encodes the peptide sequence at SEQ ID NO. 85313
  misc_feature (605)..(605): n is a, c, t, g, unknown, or other
ctcaccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgaaaaaaaagcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgcaaaaggatacactgggcgagatgtcaacgtcgacaatttcttcgctgttctgcctgggcaacaaactgctctcangggtgggagcggccaggttgtggacagtgggcccaatggatcatatatttggtttccaacagtgaccatggggggttcctggccgtccttggaaaggcctacctattccctaatctccttagggggagaacccccctaaaaagtccctggaaaaaaaaaaacatggcttgccggggaccctc

SEQ ID NO: 85313 - protein, 168 aa, Zea mays
  misc_feature: Ceres CLONE 1571590
  misc_feature (52)..(169): Pfam Name: Peptidase_C13 Pfam Description: Peptidase C13 family
  misc_feature: SWISSPROT Homolog: EC 3.4.22.34 Legumain
  misc_feature (148)..(148): Xaa is any aa, unknown, or other
MVADRLRLALLLSACLCSAWAKKKRPRLEPTIRLPSERAAADETDDDAVGTRWAVLIAGSNGYYNYRHQADICHAYQIMKKGGLKDENIVVFMYDDIAHSPENPRPGVIINHPQGGDVYAGVQKDTLGEMSTSTISSLFCLGNKLLSXVGAARLWTVGPMDHIFGFQQ

SEQ ID NO: 85314 - DNA, 743 bp, Zea mays
  misc_feature: Ceres CLONE 1571591
  misc_feature: Encodes the peptide sequence at SEQ ID NO. 85315
  misc_feature (366)..(366): n is a, c, t, g, unknown, or other
  misc_feature (368)..(368): n is a, c, t, g, unknown, or other
  misc_feature (369)..(369): n is a, c, t, g, unknown, or other
  misc_feature (415)..(415): n is a, c, t, g, unknown, or other
  misc_feature (518)..(518): n is a, c, t, g, unknown, or other
ctccccgcggtggcggccgctctagaactagtggatcccccgggctgcaggaattcgtctcacccctagaaaaaaaagggcccaaggcttctctatctagggattcatcttcctctcgtcttccctcttcctctccgaggatacaaggcgccgtcccaggtagaggtagggtcgctaccatgctggaggagctgctcatcttcacccggggcggcctcatcctgtggtcgtcctgccgggcgctcggcgccgcagccctcaagggctcccccatcgacgccctcatccgctcctgtctcctcgaggaagcgatccgccgaaaacgccagctttctccccaggacattacgcccctcagtggacttncnnacacgactcggcctgtcttcgtcgcgtataccagaggatactcacntctctacgtcgacgatctctcgcggcgtccgcaaggagttctccagatttcgaccccaagggaactcctacatgactttgggaaattttccgccactccacgnaaggccaaggcccccccagaaaataaaaaatcaagagggccctttttttccgtccaaagctgggttctaccaaaaaaaacctggtcccaggggcccccggggggaattcctggggggggcgtttttaaaaaggggggcccttggggcccagagtaaatcttttttggggggggcgttttttgaaaaaaaaaaaacccccctttttttgggggaaagggggggggc

SEQ ID NO: 85315 - protein, 164 aa, Zea mays
  misc_feature: Ceres CLONE 1571591
  misc_feature (63)..(63): Xaa is any aa, unknown, or other
  misc_feature (64)..(64): Xaa is any aa, unknown, or other
  misc_feature (79)..(79): Xaa is any aa, unknown, or other
MLEELLIFTRGGLILWSSCRALGAAALKGSPIDALIRSCLLEEAIRRKRQLSPQDITPLSGLXXTTRPVFVAYTRGYSXLYVDDLSRRPQGVLQISTPRELLHDFGKFSATPRKAKAPPENKKSRGPFFSVQSWVLPKKTWSQGPPGGIPGGGVFKKGGPWGPE

SEQ ID NO: 85316 - DNA, 806 bp, Zea mays
  misc_feature: Ceres CLONE 1571593
  misc_feature: Encodes the peptide sequence at SEQ ID NO. 85317
  misc_feature (112)..(112): n is a, c, t, g, unknown, or other
  misc_feature (113)..(113): n is a, c, t, g, unknown, or other
  misc_feature (300)..(300): n is a, c, t, g, unknown, or other
  misc_feature (336)..(336): n is a, c, t, g, unknown, or other
  misc_feature (369)..(369): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
ggagctccccgcggtggcggccgctctagaactagtggatcccccgggctgcaggaattcgtctcacccctagaaaaagcggcactcgcacgatcaatgtacacatctgccnncgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagangaaagaaaagggaggggcatcaccaaccccgccggncgaataaaaaggggaggaaaaaaaaaagccccnaaaaaaaagggggggaaaaaaaaaaaaaaaattggggnnnngtgccccttttgccttttccaaaaaaaaaaaaaggggggggggcccccccaaaaaggaaaaaaaaccccccccccccaaaaaaaacccccccccccccccggggggacccccccctttttaaaaaaaaaaaaaaaaaaaaacccctcctccaaaaaaaaatttaaaaattttttttttctttttccccagaggggggggtgttttctcccctccccccggggggggggggggggggggggggccccccccccccccccccccccttaaaaaaaaaaaacaccccctttttttttaaaaaaaaaaagaagaaagggggtgggtttgttttttattnnnnnnnnnnnnnnnnnnnttttttttttttttttttttaacaaaaaaccaaaacgcggggg

SEQ ID NO: 85317 - protein, 52 aa, Zea mays
  misc_feature: Ceres CLONE 1571593
  misc_feature (6)..(6): Xaa is any aa, unknown, or other
MYTSAXVRATTSSIVASLATPAPSSSSGSGSGRPRPRLIRNAPVFAAPATVV

SEQ ID NO: 85318 - DNA, 751 bp, Zea mays
  misc_feature: Ceres CLONE 1571595
  misc_feature (751)..(751): n is a, c, t, g, unknown, or other
acccgcggtggcggccgctctagaactagtggatcccccgggctgcaggaattcgtctcacccctagaaaaaaaagaagccaccgcttcccttccgcggcttccacaccaccttagctcggccggtggcggtctgcttccgaccgtccgccggtttgcttgcttgcttgcttcatctgcctccgccgcacctcgcctccgtccagccagccagccagcgccaagtcaagcgatccggccgcacccagcctcgacctacccggccgacccgtgagggcggtgtgtttgcccttcaacggcctcgcctcgcctcgaggtgtgagctcctccgacatctgctgcggcgccgccgtttctgcaagcagggttatcttcccttctcgccgccaggagtgagtctgtgagtgggtcgtcactgggcggggctcttccaccacctgcagggagaagggaaaaaaaaaaagggcagcagcttggattcttgctaggggggcgcggttggtcagctcgagagagaagctgaccgggtttgggcgtcgagatttcgattgacttttgaggtacccggggtatagtctacaatacaggttgcttcttcttgcacgctgctttcttggctctgtggctaccgaccttgctggctttccctcccgaattagcggctgagctccatccagaccttgcaaagattgggacctttggggggcggttcgctcactcctagcttggctcgcctggctgggtctttaacn

SEQ ID NO: 85319 - DNA, 885 bp, Zea mays
  misc_feature: Ceres CLONE 1571602
  misc_feature: Encodes the peptide sequence at SEQ ID NO. 85320
ctggagctccccgcggtggcggccgctctagaactagtggatcccccgggctgcaggaattcgtctcacccctagaaaaagcccccctctccgtcttggcctcggctcgcgcacctgcctgcttgcctgcctacctacctgcgttgttgccttcttcgcctcctccccctgtggccgcaccgcagctgctgcggcggcggcagaggtgaacagcttcccgcggccttgtcctgtccggactccggggccgggaccggcagcgcagcgggctcgcgggatctcccgacccccatgcgtcggcctcggtgacagcgtcgcagcttttcaaaagtgctcctctttggggccttgggggtctgtaactctaactgctgggtggcctctcttttcttgcctccccgctttcttttccgtgggtttgctagcggagtccatccaactataatgaattaggcacccagtacgtaatggcaacggaagtcaaacaaacttatttttcatggtcacaaggagagtcaactgaacgggatggtcctcaaggagtatctgtatcccagacacttgatcatggttccatttccttcggaagatttgaattagagtcactatcatgggagaagtggtccgtatttactaatgacaggcgcaatgaagaatttgggaaattcaatggtttagtcgcttcagaaaaagcttatttttgaggagtattacaggaagatcaggggaactaaaggcttcacaggcagcaaaaccagcaaactgaactttattctgggaatacagcggtggatgggtggtgacttcagcccaaaccccagaagagggagcaggggtgctgaattcttgaaaccctccactggaatttggaagaagcttttgaaa

SEQ ID NO: 85320 - protein, 78 aa, Zea mays
  misc_feature: Ceres CLONE 1571602
MATEVKQTYFSWSQGESTERDGPQGVSVSQTLDHGSISFGRFELESLSWEKWSVFTNDRRNEEFGKFNGLVASEKAYF

SEQ ID NO: 85321 - DNA, 847 bp, Zea mays
  misc_feature: Ceres CLONE 1571605
  misc_feature (417)..(417): n is a, c, t, g, unknown, or other
gcggtggcggccgctctagaactagtggatcccccgggctgcaggaattcgtctcacccctagaaaaagtcaagtgtcaacccaaccgtccacggtccgccctcctccttcgttcacgtcttcctcctcgcgttcctctcgtcagtacggcgacgccgcaaggctcgcaccgctgacagtcccccttcccggatcgagcctctcttttcccagatcggattctaattgggctatcgccgccgccgtgccaggtgccgagtccttagccgatcttcgccggcgaggagcgcccaccaggagttacagactgaatgacaagaatgttctctatatcatcctcagtatgtgtgaagaaatagtctgtaactacacatacctttcattgcaattaccaagaactgggaaatggacgatgantatggggcttgagcttagtttggggcctatcttggggcgggtcatcaagggaaggcaaaggctagagatgcacctctggaaccaaaagcagacccccaggtgaaagaaagcgtaccaaaagtgggttaacaacctcccgaaggctcctttcggggaaatttttccaaaaagaggcgctgaaaacctggaacaaaaattgaaaaacagggggcccgcgccctggttgccccccaaatttggggaaattttgggggggaaaaacccggggaaatccccccggcgcccagggggaaaaagggggtttttgtaaaaaccgggggggataaaaaccccccaccagtttttcgcggtttttaagaaagggaggagaggggccgccttataaaagggggaaaaaaatattttctgagagggagaaaaaacaaccttt

SEQ ID NO: 85322 - DNA, 756 bp, Zea mays
  misc_feature: Ceres CLONE 1571614
  misc_feature: Encodes the peptide sequence at SEQ ID NO. 85323
  misc_feature (658)..(658): n is a, c, t, g, unknown, or other
ccccgcggtggcggccgctctagaactagtggatcccccgggctgcaggaattcgtctcacccctagaaaaaccgctagggttttagtgttttagcctcctgcgtccctcccctgttccctcaacgcttctctcctccacctcttctcgacagccgctgccacccggaaccttctcgcagcgacgctatgtgggctctccgccgagctggtaaccccctcaggttccatgcccaaaaagttgtgagtccccgtggttgtgcgagccttgaggtgctgctaactgctgatgcaaaaaatgttgaagaacaccatgaggcagactgtcagaaagtgtgctactgtcataagccaaagccaccatccttcttattgtcattttcatctggccaatttgcttggagtaggggtttctcctctcagccaggtgcaaattctagtgacaaggatgatgagttagaggatgtattttctgatctcaatgttccaccagaagctggtaaaaaggatgctgggttgacatctgaagatacttctgatgaggatgccactgatgaaattggcttgcctagtatggatgctgatgtaaaacctgagacggagcacatttaaagggacttttggttccacccttctcaagactgtggttggaaagctccnaggcatcagtcacttcagcgccttgaaaatggggcaaaagatggcaatgcacttgatagggggcgaactctattatgtggctccttaatcttcgaaac

SEQ ID NO: 85323 - protein, 140 aa, Zea mays
  misc_feature: Ceres CLONE 1571614
MWALRRAGNPLRFHAQKVVSPRGCASLEVLLTADAKNVEEHHEADCQKVCYCHKPKPPSFLLSFSSGQFAWSRGFSSQPGANSSDKDDELEDVFSDLNVPPEAGKKDAGLTSEDTSDEDATDEIGLPSMDADVKPETEHI

SEQ ID NO: 85324 - DNA, 773 bp, Zea mays
  misc_feature: Ceres CLONE 1571615
  misc_feature (176)..(176): n is a, c, t, g, unknown, or other
  misc_feature (300)..(300): n is a, c, t, g, unknown, or other
tggagctccccgcggtggcggccgctctagaatagtggatcccccgggctgcaggaattcgtctcacccctagaaaaaatcctatcttcagtctcctcaccgcgcgctctctaccgcttgtccgtttcttcctcttccgaggtagcaacgtggtgagtgaggcagccgctgctgtngctgcactgctgctgcggaggcccaagccgaccggcggagagcacccgtccttgggcggcggaggtggaagataaggcgggcttgggatccgggtgcggagtacggagagtggtgtggggtatncgtcggcggcgccgactcgccacagggaagagccgccctgcctctggatgactatcgctccgcgctacgggaagcacctgaactccaatattgcacatcgccacaaagaaaatcctgggttactaaaaaacaaaaaatttggtccgacattgttacttaggaaacaatgggctttttctggctcccaaaaaattccccgggaaaacccctttcccatgtggccaaaaaacttctcccaaaaattttggggggaaaaattttccttgaaaaacccggtgtttttggggaaatccccccccaaaaaaaaatattttttggtgaaaaagaaaaaaacatttttccacccaaaaaggcaaaaaccttttttaaaaaaaaaagaaaaaaaattctctcttttccccaaaaagggggtttaaaaaaaacccccctttttgtggggggcccctcccaaaaaaaaaaaaaaaaaaaaaaaa

SEQ ID NO: 85325 - DNA, 801 bp, Zea mays
  misc_feature: Ceres CLONE 1571617
  misc_feature: Translation starting site: 215
  misc_feature: SWISSPROT Homolog: EC 3.6.5.5 Dynamin GTPase
  misc_feature (800)..(800): n is a, c, t, g, unknown, or other
  misc_feature (801)..(801): n is a, c, t, g, unknown, or other
tcaccgcggtggcggccgctctagaactagtggatcccccgggctgcaggaattcgtctcacccctagaaaaaaaaaaccgcgccagcaggcccagctccaaccaccgctcgtctcgtctccttcctcccgtctcgtctccgacgacctcgtctttcccccccagccagcctcgcctcaccgactccccgatccggtccctcccttcgccagctatgcacccctcctccggcgcgggggactacgccccttactacccaccttacccctccccggccgcgccgcctcccgccgcctacccgtcggtgtccgccccggcttccgcgcccccgtactcgtcgtaccccgcggacttcgcccccgcgccttcgtaccccgcgtacccgcccgccgacctcccccactatgcgccgccgccggctgcgcccgcgcccccgcagccgtactacccctacgagccggcgccggcgccgccgctgccgccgtccccgcacaacccggtgccctctccgtacccgtcgctgggatcggcggggagctacggctacggatccgggccctggctcccgggtacgggcagggagctgtacccggcccaaagccggcggggcgggggggtccgaaccaacggagcgtacgcctttccacggggggggaacccgccccgaagcccgtacgggttccgggggccaccgcgccccgagggccggggctcggggaacccccggctggtttggattgactaccggggagggcccatttggctcagctgcgccaaaaaggggggggggggcgcccccnn

SEQ ID NO: 85326 - DNA, 1208 bp, Zea mays
  misc_feature: Ceres CLONE 1571622
  misc_feature (1208)..(1208): n is a, c, t, g, unknown, or other
ggggggatttggggggtggaccaaccaacaccatcccacaccacccttacgcatattttttaaacagataataaaaactggcgctccccgcggtggcggccgctctagactagtggatcccccgggctgcaggaattcgtctcacccctagaaaaaggatgaggtgccccacggtgctctgctcatgtccgcttccatgtacgctccggctgcgacccccgtcccgcagacctccttcgccgtgctgcggcaacaacactcgcagctcatccgtctcggcgtcgcctcccgcgccgcccacgcgcggcgccttctctccttccttgcccgggaccccgactcccacttcccgtaagcgagccgcctcctggcgcaccacccggacccgcacccggcgctctttaacccgctctgatccgcgctcctcacgcaccacgctcgagcagctcctgacccacatgctgtacactgttccctgcaccagggacgacttccttttcacggccaatcctccccgagctggccagagcgtttccaactgggtcgggccagcttcagaagcgctggctccgtcagaggctgcggtgattaccgccgcccaaaccatcaactacgtgatatatccacgccatgccttcgccccgggcttaaaccgtcttccctaatgtacacaaaaccccccgacacctctcgtcctctacccgaggaggaccgtttgtctttatgggtcaaatcatgtgtttcgatatggccctattgtccactaatgggtctagggtgtttagttgctgtgcaccaccaccacccttaccctcgatgttctgtatacaactgggtatttcctccggtaacataccttctagatgacacagtgtattctttccactacctaaatcacttctcgcctctcggatgattcccacattacaaaaacggtgcccaacagtgccattttgtagggcggcttataatctcttgcgctctttctccagaggtggaattcgcctcaaaacaaagtgctctatctggaaataatttgtatccacgagcaataagaactccaatatattactctagcaaccctcatctgttacacatggtcattctttccattatttagagggagatgatattaacctacgctgtgtgaagagttcgtcagtaccgcttgttattgatggtctagtaagtaccttcaacgctatttn

SEQ ID NO: 85327 - DNA, 811 bp, Zea mays
  misc_feature: Ceres CLONE 1571623
  misc_feature: Encodes the peptide sequence at SEQ ID NO. 85328
  misc_feature (811)..(811): n is a, c, t, g, unknown, or other
ctggagctccccgcggtggcggccgctctagaactagtggatcccccgggctgcaggaattcgtctcacccctagaaaaaatatttcccgatagtacacggaagtccggcgacaatggagtctccctcttagcagacgtacgtggactggcttctccggttcttgtatacaacacatctttcgcccgccatacttgggtacttgccatcttcttccgcgactccaaacacagtgttacgcggcccacctgcacctgcaatgcaacgatcggtccctctcgagcagtagacgcccggttccttgtactttggcacccccatcacgtcgtctggtcaatctaaagcttggacttgcagcctcctcatcggtcgatcgatcggagtgacgtgctggggattgtaggtgcaagcgcgcgcgacattgcagctaccgagaagaaagcagaggggcgatcgagcagttgacgggcgtgcagcaatggcgggacttcacttcttgctcgtgccgctggtggcgcaaggccacatcatcccgatggtggacctggcccgcctcctcgccggcaggggagcgcgagtcaccgtggttaccacgcccgtcaacgccgcgcgcaaccgggccgttgtagaaagcgcccggcgggcggggctcgacgtcgaggtcgcggagatcgcgttccccggcccggggcacgggctgccggagggtctggagaacatggacctgctcacgaggaaggagcacttcttgcccttctttccagcggcgtggaagatggacgcgccgctgggagagtacgtgcggtcgctgn

SEQ ID NO: 85328 - protein, 111 aa, Zea mays
  misc_feature: Ceres CLONE 1571623
  misc_feature: SWISSPROT Homolog: EC 2.4.1.238 Anthocyanin 3'-O-beta-glucosyltransferase
MAGLHFLLVPLVAQGHIIPMVDLARLLAGRGARVTVVTTPVNAARNRAVVESARRAGLDVEVAEIAFPGPGHGLPEGLENMDLLTRKEHFLPFFPAAWKMDAPLGEYVRSL

SEQ ID NO: 85329 - DNA, 2600 bp, Zea mays
  misc_feature: Ceres CLONE 1571625
  misc_feature: Encodes the peptide sequence at SEQ ID NO. 85330
aagcaggggtgtgcatgtgaccccaagaggccaggacaggtaggcgcacatgccacatcccccgcgagcaactactaccatggcatcctcccctccacctcctcgccaggaagaggaccagcaacgggaagaagggcaccaccatggcgacggaggcgacgacgaccagatcaccacaccgctcctggtggaagcggcgacgacgtcgtcgccgtcgccgtcggagggagacgatccagagaactcgccgatcgagcaggtggcgctgacggtgccggtgggcgacgacccgtcgacgccggtgctgacgttccggatgtgggtgctgggcacggcgtcgtgcgcgctgctgtcgttcctgaaccagttcttctggtaccgcaaggagccgctgaccatcacggccatctcggcgcagatcgcggtggtgccgctgggccgcctgatggcggcggcgctccccgcgcgcgccgtgctccgcggcacccgctgggagttctcgctcaacccgggccccttcagcgtcaaggagcacgtgctcgtcaccatcttcgccaactccggcgccggcaccgtctacgccatccacgtcatcaccgccgtccgcgtcttctacggcaagcacatcaccttcttcgtctccctcctcgtcgtgctcaccacccaggtgctggggttcggctgggcgggaatattccggcggtacctggtggagccggcggcgatgtggtggccgtctaacctcgtgcaggtctccctcttcagggcgctccacgagaaggagcggcgcgtgaagggaggcatgacgcggaaccagttcttcctggtggcattcgtctgcagcttcgcctactacgtcttcccgggctacctgttccagatgctcacctccctgtcgtggctctgctgggcgttcccgcgctccgtggtggcgcagcagctggggtcggggctgagcgggctgggcgtgggcgcggtggggctcgactggtccaccatctcctcctacctcggaagcccgctcgccagcccctggttcgccaccgccaacgtggccgccggcttcgtcctcatcatgtacgtcatcacgcccgccgcgtactactggctcggcctgtacggggcgcgcagcttccccatcttctccgacgggctcttcaccgccgccgggcagacgtacaacatctccagcatcgtggactccaacttccggttcgacaccgaggcatacgagcgcaacggcccgctctacctcagcaccttcttcgccgtcacctacggggtcggcttcgcgtccctcaccgccacggttgtgcacgtcttcctcttccacgggagcgagatctggcagctgagcaggtcagcgttccaagagaagaaggtggacgtgcacacgaggctgatgaggaggtacaggcaggtccccgagtggtggttcatctgcatcctcgtcgccaacgtcgccgtcaccatattcgcctgcgagtactacatcgagcagctccagctgccctggtggggcgtcctgctcgcctgcgccatcgccttcttcttcaccctcccgatagggatcatcacagcgacgacgaaccagactccaggcctgaacatcatcaccgaatacatcatggggtacctgtacccgggccgtcccgtcgccaacatgtgcttcaaggtgtacggctacatcagcatgacgcaggcgctggccttcctgcaagacttcaagctgggccactacatgaagatcccgccgaggaccatgttcatggcgcaggtggtggggacgctgatcgcggcgctcgtgtacatcgggacggcgtggtggctcatggacagcgtccccaacatctgcagcacggagctgctccccgccgacagcccctggacgtgccccatggaccacgtgttctacgacgcgtccgtcatctggggcctcatcggcccgcgcaggatcttcggcgacctcggcacctactcggcggtcaactggttcttcctgggcggcgccgtcgcgcccctcctcgtgtggctcgcgcaccgggtgttcccgagccagagctggatcctgctcgtcaacatgcccgtgctcatcggctccaccggcatgatgccgccggccaccgccgtcaactacaccacgtggatcattgccgggttcctgtcggggtacgtggtctacaggtaccggcgtcactggtgggagcgccacaactacctgctctctggcgcgctcgacgctggcctggcgttcatggccgtgctcatctacctgtgcttgggcttggagaacgtcggcctcaactggtggggcaatgatctggacgggtgccctctcgcctcttgtcccactgccaaaggtatcgttgttgagggctgcccggtgtatacatgaggaattgagaacccatgcattcggagaagagaacatggcaatgcaagtggacaagtgtctcaagagcaatgtaaataatttatcttttcaaacaatttagggatgggaaattggtgttcctttcattgtaaaatggctggtaattacggctattccagctcggaatcaaatttattccgtggtacaacgaaaaaaaaaaaaaaaa

SEQ ID NO: 85330 - protein, 781 aa, Zea mays
  misc_feature: Ceres CLONE 1571625
  misc_feature (85)..(744): Pfam Name: OPT Pfam Description: OPT oligopeptide transporter protein
MPHPPRATTTMASSPPPPRQEEDQQREEGHHHGDGGDDDQITTPLLVEAATTSSPSPSEGDDPENSPIEQVALTVPVGDDPSTPVLTFRMWVLGTASCALLSFLNQFFWYRKEPLTITAISAQIAVVPLGRLMAAALPARAVLRGTRWEFSLNPGPFSVKEHVLVTIFANSGAGTVYAIHVITAVRVFYGKHITFFVSLLVVLTTQVLGFGWAGIFRRYLVEPAAMWWPSNLVQVSLFRALHEKERRVKGGMTRNQFFLVAFVCSFAYYVFPGYLFQMLTSLSWLCWAFPRSVVAQQLGSGLSGLGVGAVGLDWSTISSYLGSPLASPWFATANVAAGFVLIMYVITPAAYYWLGLYGARSFPIFSDGLFTAAGQTYNISSIVDSNFRFDTEAYERNGPLYLSTFFAVTYGVGFASLTATVVHVFLFHGSEIWQLSRSAFQEKKVDVHTRLMRRYRQVPEWWFICILVANVAVTIFACEYYIEQLQLPWWGVLLACAIAFFFTLPIGIITATTNQTPGLNIITEYIMGYLYPGRPVANMCFKVYGYISMTQALAFLQDFKLGHYMKIPPRTMFMAQVVGTLIAALVYIGTAWWLMDSVPNICSTELLPADSPWTCPMDHVFYDASVIWGLIGPRRIFGDLGTYSAVNWFFLGGAVAPLLVWLAHRVFPSQSWILLVNMPVLIGSTGMMPPATAVNYTTWIIAGFLSGYVVYRYRRHWWERHNYLLSGALDAGLAFMAVLIYLCLGLENVGLNWWGNDLDGCPLASCPTAKGIVVEGCPVYT

SEQ ID NO: 85331 - DNA, 773 bp, Zea mays
  misc_feature: Ceres CLONE 1571627
  misc_feature: Encodes the peptide sequence at SEQ ID NO. 85332
ctcaccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacaaccgcttctccccctactgcggcagctgcaagtaccccggcgaagaccttcttcccacaacgtcgggccttgggggggatcggggttacaagggttaaccggttaaccttttaacccccaaactgtggggaagaaaaaccctcccagggtttgcccccccccccg

SEQ ID NO: 85332 - protein, 152 aa, Zea mays
  misc_feature: Ceres CLONE 1571627
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYNRFSPYCGSCKYPGEDLLPTTSGLGGDRGYKG

SEQ ID NO: 85333 - DNA, 768 bp, Zea mays
  misc_feature: Ceres CLONE 1571630
  misc_feature: Translation starting site: 101
  misc_feature (768)..(768): n is a, c, t, g, unknown, or other
ctccccgcggtggcggccgctctagaactagtggatcccccgggctgcaggaattcgtctcacccctagaaaaactgcccaatccgtaatccaggatgaaatggctgcgccccagcacgtccgcgccgctcccctcgcacgcgcgctccgcgctaccgccaccgccaccgccaccgcctccgtccccgtacccgttcccgtccccgccggcatcaagtctcaggggacttcccgccgcgcgctgctcggcctatcggagcctcagctccgccagcttgccatcgatctcggccagcaaagctaccggggcaagcagctgcacgacctcctctacaaatcaagagccaagcaaatccaagaattcaaccacgtgcccaaggcgttccgggaggcgttgcttggcgctgggtggagtgttggccggtcgccagtgcaccacgccgtcacagcctcggatggcactaccaagatacttctcaagttggaggataaccggttgatcgagacagtggggattcctgtcgatgatgacaacaaaggctcttctaggctcactgcctgtgtttcatcacaggtcggctgcccccttcgttgctcattttgtgccacggggaaggggagggtttgcaaggtacccttcaccacatgagattgttgaacaggtgttgggcatcgaggagacgttcaaacacagggtgacaaaatgttgtgttcatgggggaatggggtgagcccatgatgaaacctcaagtcagtttctagaagcan

SEQ ID NO: 85334 - DNA, 814 bp, Zea mays
  misc_feature: Ceres CLONE 1571632
  misc_feature: Encodes the peptide sequence at SEQ ID NO. 85335
  misc_feature (346)..(346): n is a, c, t, g, unknown, or other
  misc_feature (366)..(366): n is a, c, t, g, unknown, or other
  misc_feature (367)..(367): n is a, c, t, g, unknown, or other
  misc_feature (385)..(385): n is a, c, t, g, unknown, or other
ctccccgcggtggcggccgctctagaactagtggatcccccgggctgcaggaattcgtctcacccctagaaaaatcctcccttcgcatcgaggaatcgcgggcccaccgcggcaccaaggccccccgcattccgtcccgccgcggcgtcgctcccttgttctctcccgagccgtccgcgaaccaacccgtgctacctccgattcttcgcctcgtcgttctttctagaacctccgctccgcctaatcccttgaccgggtcaagcccgaacgagactagggaggttccagcgccgccggtgggggagatggcgctggagctgagcctggcctcggctcgccgccgggncggggcggcggcttggcgcnnccgccgcccctcgccccncccgggaaggagcagcaagtggccggcgtggggattctactgcagatctccatgctcgtgctctcgttcgtcctcggccacgtcctgcgccgccaccgcttctactacctccccgaggccagcgcctcgcttctaaaggggcttagttgttggtggcctcgctaatatttcaaaaacagagaccaacacaaggacgtgggtcaacttcccatgaagaagtcttcttccttggtcttattacctccgaaaatattccaatcgggatttcagggttatgtccgaaaccatttctttggcaaccttgggggctatacgaaacttttggaaattcttgggacattcaattgccttctgtttgtaaaaggaaggtcctgagctatcttttggtgggggtgaacaatttttaatggtacaaaatgtcccttggga

SEQ ID NO: 85335 - protein, 37 aa, Zea mays
  misc_feature: Ceres CLONE 1571632
MLVLSFVLGHVLRRHRFYYLPEASASLLKGLSCWWPR

SEQ ID NO: 85336 - DNA, 897 bp, Zea mays
  misc_feature: Ceres CLONE 1571636
  misc_feature (645)..(645): n is a, c, t, g, unknown, or other
  misc_feature (779)..(779): n is a, c, t, g, unknown, or other
ggagctcaccgcggtggcggccgctctagaactagtggatcccccgggctgcaggaattcgtctcacccctagaaaaagtgtctagtgtcttccgtctcgatcccgcgggtgggactcgccggcgacaaaaacgaaaagcgacttgccctccgcggcctccggccttcccactccactcgccctcctctcctagcgtcggtgagccggtgcgctgcagtccccgctccccttccgcgtcgccgcgatggaggtcttccgggagcacggggacgacggagtgccctaggattccatcacgccgccaagcatcagtcccgcagccagggatttcttctccgaccccgaccttcatgtgagtcgcggccttcctcctcgaagcggatccggcggattggaggggccaaccatagcagattcgaaattttctagctcagcaccataaaagggcagacccagtgtcggaggatctcacatgagtggattctgggtaagggataaaccaagggaaagtctttcccccacaaatgcggagaggctgttttgaacccgtgacctggtacttcttgcgggtgtaagcatttcgctgcacttggagacgcttatttggagtatttgaagtatgagttggctctctgtcctgtcangtatgtgcctgtgcttcataaaaaagagctacattttcttctactaggggctttggagactgcccagatgaagagtagattttcttggtctctgtgcccattgtctgcgtcatggctcagatggggagatgccnatgtcgtggctattgggggaataatcggaacctggtcttttgctggaaatggagggcagcttttcctccaggagggaaagggatcaggagtccatgggcatagtttatggctttcgga

SEQ ID NO: 85337 - DNA, 749 bp, Zea mays
  misc_feature: Ceres CLONE 1571638
  misc_feature: Translation starting site: 229
  misc_feature: SWISSPROT Homolog: EC 1.2.1.3 Aldehyde dehydrogenase (NAD(+))
ctccccgcggtggcggccgctctagaactagtggatcccccgggctgcaggaattcgtctcacccctagaaaaaaaccaacctcctctgcctgccgcttctcctgctgcgggcgggcactgctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgccgcgcaggacagtgcctgcagatgggatgcacaggctgttgccaggtgtccttcagaggttcagcactgcagcagcagtagaggagcccatcacgccgtcagtccatgtgaactacacaaagctcctcattaatgggaactttgttgattccgcatccggcaagaccttcccaactctggaccctcgtacaggggaggtgattgctcatgtggctgagggtgacgcagaggacattaaccgtgcagtagctgcggctcgcaaggcttttgatgagggccatggccgaagatgactgcctatgagaggtcccgtatcctactgcggtttgctgatttgatagagaagcccaatgacgagcttgctgccttgggagacttgggaccacggggaagccttttgagccaagcagccccagattgaagttccccagga

SEQ ID NO: 85338 - DNA, 798 bp, Zea mays
  misc_feature: Ceres CLONE 1571639
  misc_feature: Encodes the peptide sequence at SEQ ID NO. 85339
  misc_feature (731)..(731): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
ccccgcggtggcggccgctctagaactagtggatcccccgggctgcaggaattcgtctcacccctagaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctgacaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcaccctttgaggtcgagtcttctgataccatcgacaatgtcaaggccaagatccaggacaaggagggcatccctcccggacagcagcggntctcgcctgagcgcataagctggtcggactgcggnnnnnnnnnnnnnnnnnnnnnnnnnnnnnnnnn

SEQ ID NO: 85339 - protein, 167 aa, Zea mays
  misc_feature: Ceres CLONE 1571639
  misc_feature (82)..(150): Pfam Name: ubiquitin Pfam Description: Ubiquitin family
  misc_feature (6)..(74): Pfam Name: ubiquitin Pfam Description: Ubiquitin family
MQIFVKTLTGKTITLEVESSDTIDNVKAKIQDKEGIPPDQQRLIFADKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITL

SEQ ID NO: 85340 - DNA, 771 bp, Zea mays
  misc_feature: Ceres CLONE 1571641
  misc_feature: Encodes the peptide sequence at SEQ ID NO. 85341
  misc_feature (538)..(538): n is a, c, t, g, unknown, or other
  misc_feature (584)..(584): n is a, c, t, g, unknown, or other
  misc_feature (597)..(597): n is a, c, t, g, unknown, or other
acccgcggtggcggccgctctagaactagtggatcccccgggctgcaggaattcgtctcacccctagaaaaacccaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacnggcgcacgcttgccgactacaacatccagaaggagagcaccctccnacttggtgctgcngcctcaggggagcatgcagatctttcgtgaagaacctgaaccggcaaaactatcaccctcgagggggaagccttcagacaccatcgaacaacgtcagggcccagatcccagaaacagggagggcttcccccccagacccagcaagggggtcaatctttttgctggaaaaccagc

SEQ ID NO: 85341 - protein, 157 aa, Zea mays
  misc_feature: Ceres CLONE 1571641
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (129)..(129): Xaa is any aa, unknown, or other
  misc_feature (144)..(144): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXRTLADYNIQKESTLXLGAAASGEHADLS

SEQ ID NO: 85342 - DNA, 756 bp, Zea mays
  misc_feature: Ceres CLONE 1571642
  misc_feature (738)..(738): n is a, c, t, g, unknown, or other
ctccccgcggtggcggccgctctagaactagtggatcccccgggctgcaggaattcgtctcacccctagaaaaaatcggcccccatccggccatccgccatcccccaaccccgttcttctccctccgtccgaccgtccctcgacagtgccgaggcgcaacctagcagccgcccacgcggcgcgacatccactggcgcaagcgcaatccgcaagggccccccggcgcgccgccagcctcctggctcggccgcccccgcggctaacccaggggcggaaaggccggccagccgcccacaccccatccggccagccaggcggaaacgaccgtaagagggaagccgcagccggccgctgactccgatcccacctctagtcaaccccaggcagaccgatcctcttcgtctgaccacgacggccatctcgcacgcctacttccactcaaccacataagtcttttctgccaggcctaacctttcccctgcgccgcctctactggttttgcacagtgccgtgacgtgggaagacgtggagatccaacgaaaattagatttatttcttccttcttcggtccaacaggttcctcagcttgcgtaagatccgtctgggttgtccgccctccattggactacccaaggtgcggcgcatccaccaggtggaagatatctgcgtaagtcaaaacatagaataagagtggactgctattagttttccataggatggaatccttgtggaagctgnactacttgctcgacccgg

SEQ ID NO: 85343 - DNA, 1129 bp, Zea mays
  misc_feature: Ceres CLONE 1571645
  misc_feature: Translation starting site: 277
  misc_feature (29)..(29): n is a, c, t, g, unknown, or other
  misc_feature (1129)..(1129): n is a, c, t, g, unknown, or other
aattaaaataaaatatatattttgtatgnggccggtcgcttgcgtgcgtttctgtgtgtccctaccccttattaagatggagctccccgcggtggcggccgctctagaatagtggatcccccgggctgcaggaattcgtctcacccctagaaaaagggcctggaagaagctgcgaccttctttgtgtgttttttttggcgacgagatctgacgacagtggcggcggttcgaggttcggtgcgacagcgcggcgtcccggaatcggcggcggcgaagatgtcggtgagccacgcggaggacatcgagatatcgctgtgtgacggcaactcggaggacgagcggcggcggcgtaagatcggctcgctgcggcggaaggccatccacgcgctcaagaagcgagggaggcgccgcgtcgacttccgcttccgccggccgccatctccatcgaggacgtccgcgatgccgaggaggagcgcgccgtcgcctccttccgggaccgcctcgccgcgcacggccttcctccccgacaagcacgatgactaccacatgaattctcaggttccctcaagggccaaggaagttccgaagcccgataaggcaaatgccaaatgtgggttcgggagaatgcttgaaaaatgggaaggaagggaattttccggaacttgaacacccaattcccttcgaagggaattttttgaatttttcccccaaaaaaaacttggggaattggaatgtgttgccttgtcccgccttaaaccttaaccccctttccaaaggggggccttaacccccaatgggggtggtgggggaacacccggacgagaaaagggcccgcggggccccccggttggtataccctttttggagaaaagggccttaagaggggaaaaagggtgtggaaattcccccaaaaacaaaacactcaatttggcaggaaattaccccgcttccttgtgggtggattctcgctttaccctttcaaaggtgacccacttgtgttcccgagggagatttctttgagaaagagagccctcttttcggaggggagaagaggtttcccccctggccgtggccaccaattgggggcttgccccaaaaagagcccacctttttacctctccaccccccn

SEQ ID NO: 85344 - DNA, 906 bp, Zea mays
  misc_feature: Ceres CLONE 1571650
  misc_feature: Encodes the peptide sequence at SEQ ID NO. 85345
ccccgcggtggcggccgctctagaactagtggatcccccgggctgcaggaattcgtctcacccctagaaaaaaggacaaccagagctgccacagctcgacgagccgccctccagtcggccggccgtccggcgatatatctccccgaccgtcgtgccggcctgtgcgagagagttgacacctatatatatatatatagagagagagagtcatggagacggtggcggcgagttacggcggcggcggcgagaagagggagctgcagcagcagaagaagcaggcgggcgggtgcgggcaccagcaccacttccagatgccgttgcactacccgaggtacaggcgggaggactacgagggcatgcccgagtggcagttcgaccgcctcctctccgagtacggcctgcccgtcgccggcggctccgtccagcagaagcggcgccttcgcccaggggcgccttccctctgggggcgccgggcaacaaaaaaagtctaaattataataaacttggtagcaggcagtccagcagaatttaagagtatcccgagcctcatttagccttggtatgtaaaagtgaaatcaatggctaatatattgctaggaaccagagacggtggaaggaatataaaggtacccttgttttggttttggaccccggggctgggctttttttggacttggtgggaaatttcgaatagcttggggtgaacgggagtgagatgtaatcgtatggagcctgtatagtggtgtggtgaaggtgaggagtatgtttacgacatctggtagtctttgcatgcgaacgcgacgactcgttctctgcttggtggggtgtttttctttcttcgcggggttttggtaatggcctttaaaaaaaacacgcgcggagggtttatatctctcgaggctcggg

SEQ ID NO: 85345 - protein, 93 aa, Zea mays
  misc_feature: Ceres CLONE 1571650
METVAASYGGGGEKRELQQQKKQAGGCGHQHHFQMPLHYPRYRREDYEGMPEWQFDRLLSEYGLPVAGGSVQQKRRLRPGAPSLWGRRATKKV

SEQ ID NO: 85346 - DNA, 659 bp, Zea mays
  misc_feature: Ceres CLONE 1571651
  misc_feature (202)..(202): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (458)..(458): n is a, c, t, g, unknown, or other
  misc_feature (521)..(521): n is a, c, t, g, unknown, or other
  misc_feature (614)..(614): n is a, c, t, g, unknown, or other
  misc_feature (629)..(629): n is a, c, t, g, unknown, or other
  misc_feature (633)..(633): n is a, c, t, g, unknown, or other
ctccccgcggtggcggccgctctagaactagtggatcccccgggctgcaggaattcgtctcacccctagaaaaaagagcattgcttccgtgtggtgcggttgatagctcggatcttctgctggccgagttcgtcttggaggagaagagagagagagagagagagagagagcgccgggatcggagccaggaagcatccagcancgatggcgggcggaggggtggcggcgctgggcgtgaagacggagcgcgcggcgcagtacaggggggcgcatgacgctcgccgtcgcccacgacctgccctcgtgggccgccccgtcggggggggcccatctttggggttacaaaaatcggggattttcccggggggggggcattcccgggggcccccattctcccgggggaagaaaaaaaaattttttttccccccgcggggggggggggnnnagtgggggggggnttcccccccccccccccccaaaaaaaaaaaaaaaaaacccccccggccggggggggggggggnaggggggggggggaagaaccacccccccccccccccttttttgtgggtggggtggccaaaaaaaaaaaaccccccccccccccccccccgggnggcggggggaggggngggnttttttgtttcttttttttttttttc

SEQ ID NO: 85347 - DNA, 847 bp, Zea mays
  misc_feature: Ceres CLONE 1571655
  misc_feature: Encodes the peptide sequence at SEQ ID NO. 85348
ggcggccgctctagaactagtggatcccccgggctgcaggaattcgtctcacccctagaaaaaccccaccaccaagactctaggcgcagcagctcctccacgcttcgctgccgggtcaagctcctgtcatggagatcacggccagctgcgacgacggcgcggtcaccgctggcgccgtttctggtgtgctgctcgcgtctgttctgtctctgttcggcgcgtttctggtatacttctacgcgccgttctggagcgtgaggagagtcccggggcctccagccaggttccccgtcggccacctccatcttcttgccaggaacgggccagacgtcttccgtgcgattgcgaaagagtatggcccaatcttcaggtttcacacccaaaggcaaccactggtgatcgtggccaatgccgagctgtgcaaggaggtcggcatcaagaagttcaaggacatccccaaccggagcaccccgccgccgtcgatcggttccctgcaccaggacgccctcttcctcacaggtgcacgcactgggtcatccttctaggtagaccgaaatgctagctagctccatctcagatagagaaggcatgggaagtttttgttgattgtgaggcacttacttgtatgatctacgatggcaggaactcaacttggtcggcgatgaggagcacggtggttccgctctaccagccagcgcgggtttgccggcctcatcccggtgatgcagtcgtacttcaaccccctggcgggcgaaattctccccctgcccggaacaggactgggttccccttttggcagtttcttgttcggaagggccatcaaaattattgggagggacgggccttc

SEQ ID NO: 85348 - protein, 138 aa, Zea mays
  misc_feature: Ceres CLONE 1571655
  misc_feature: SWISSPROT Homolog: EC 1.14.99.9 Steroid 17-alpha-monooxygenase
MEITASCDDGAVTAGAVSGVLLASVLSLFGAFLVYFYAPFWSVRRVPGPPARFPVGHLHLLARNGPDVFRAIAKEYGPIFRFHTQRQPLVIVANAELCKEVGIKKFKDIPNRSTPPPSIGSLHQDALFLTGARTGSSF

SEQ ID NO: 85349 - DNA, 816 bp, Zea mays
  misc_feature: Ceres CLONE 1571656
  misc_feature: Encodes the peptide sequence at SEQ ID NO. 85350
  misc_feature (496)..(496): n is a, c, t, g, unknown, or other
  misc_feature (532)..(532): n is a, c, t, g, unknown, or other
  misc_feature (550)..(550): n is a, c, t, g, unknown, or other
  misc_feature (559)..(559): n is a, c, t, g, unknown, or other
  misc_feature (580)..(580): n is a, c, t, g, unknown, or other
ctccccgcggtggcggccgctctagaactagtggatcccccgggctgcaggaattcgtctcacccctagaaaaactccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacngcggtggcgggcgccgtgatggcggtggcggctacngcggtggcggcggctacngtggcggcngcggctacggtggtggtggcngcggctaccgcggtggcaaccgtggcggcggctacggcaactccgacgggaactggaggaactgagcggggggggccgcgcggccaagttattcctgttccctaccgggatgttttccctagtccaagagggtttatcctccttccggggccgggttttttttttccccacccggggtttttgaattgaaaggccccccctgtggcccaattgtttagggcctgggttcaccccct

SEQ ID NO: 85350 - protein, 155 aa, Zea mays
  misc_feature: Ceres CLONE 1571656
  misc_feature (10)..(81): Pfam Name: RRM_1 Pfam Description: RNA recognition motif. (a.k.a. RRM, RBD, or RNP domain)
  misc_feature (48)..(150): Pfam Name: GRP Pfam Description: Glycine rich protein family
  misc_feature: SWISSPROT Homolog: EC 5.2.1.8 Peptidylprolyl isomerase
  misc_feature (107)..(107): Xaa is any aa, unknown, or other
  misc_feature (119)..(119): Xaa is any aa, unknown, or other
  misc_feature (125)..(125): Xaa is any aa, unknown, or other
  misc_feature (128)..(128): Xaa is any aa, unknown, or other
  misc_feature (135)..(135): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYXGGGRRDGGGGYXGGGGYXGGXGYGGGGXGYRGGNRGGGYGNSDGNWRN

SEQ ID NO: 85351 - DNA, 798 bp, Zea mays
  misc_feature: Ceres CLONE 1571657
  misc_feature: Encodes the peptide sequence at SEQ ID NO. 85352
  misc_feature (394)..(394): n is a, c, t, g, unknown, or other
ctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcnctgacgtgcgccgacttcctgcgcgcgcccggcgtgcggacgcccgtgatcgtgcgcttctcgacggtgatccacgagcggggttccccggagacgatccgcgacccgcgcgggttcgccgtgaaattctacccccgcgagggcaactgggacctgctggagaaaaactttcccggtcttcttcatccgcgaaggattaaggttccccgacgtgatcccagcggtcaaagccaaaccggcggtcccacgtgcaggaatactggggggggggtccaaacttccgggccgcccctccccgaaaggcttggaaaccttccttttttcctctttaaaaaaaaggggggggtgggccggtccgaatttaccgccccattggaaaaagggttccggcggtgaaaacacgg

SEQ ID NO: 85352 - protein, 214 aa, Zea mays
  misc_feature: Ceres CLONE 1571657
  misc_feature (18)..(213): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYPREGNWDLLEKNFPGLLHPRRIKVPRRDPSGQSQTGGPTCRNTGGGVQTSGPPLPERLGNLPFFLFKKKGGVGRSEFTAPLEKGFRR

SEQ ID NO: 85353 - DNA, 776 bp, Zea mays
  misc_feature: Ceres CLONE 1571660
  misc_feature: Encodes the peptide sequence at SEQ ID NO. 85354
aaagctggagctcaccgcggtggcggccgctctagaactagtggatcccccgggctgcaggaattcgtctcacccctagaaaaaaccgttggcacgccatctaatcagcgaagaggagacgacgactgctctgcctttcttccctacaggaacaggacgaatcaatcaatcattcccctctgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggcaggaagcgcctatcattattcgtacatctgcgttggcgatagagttgcatggttgattggctgggctttgatacttgaatacacgatttggtggatcagccgtttgcccgtgggcatttcttctaatcttagcctttattttttgggaggaaaggaatagtcctgccatgggatttttagcaccgacatggagatccccatggcttggatgggcccttgtaaaaacccttggtggcttcctttcccccggttttcccggcgtcaaca

SEQ ID NO: 85354 - protein, 146 aa, Zea mays
  misc_feature: Ceres CLONE 1571660
MGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGDRVAWLIGWALILEYTIWWISRLPVGISSNLSLYFLGGKE

SEQ ID NO: 85355 - DNA, 827 bp, Zea mays
  misc_feature: Ceres CLONE 1571664
  misc_feature: Encodes the peptide sequence at SEQ ID NO. 85356
  misc_feature (495)..(495): n is a, c, t, g, unknown, or other
  misc_feature (496)..(496): n is a, c, t, g, unknown, or other
  misc_feature (503)..(503): n is a, c, t, g, unknown, or other
ccccgcggtggcggccgctctagaactagtggatcccccgggctgcaggaattcgtctcacccctagaaaaaaacctaacagaagcaaccgaatatcccctcgcctttcaactcgtcttcctcctcatgtcgtcgcctcctatccctctatatcttctattctaagccacctcgatcggaccctagatagatgcaagaaaagaaaagagaagagcctctgtggatagtggtgggtgctggatcactgggcggagcagcttctcatatcggatcgatcgattaattaatatatactataaacatacaatcaattacatacatatacgccaagagaagaggaacgccggcccgtttcacttgtctccttcctccgatccctcccggcggccggccgggctcgggcgtttttccccttttgtttcccatggaggacgccaagatggggaaacgcgcccacatccgcgcggtgctcgccatcctccagtggtggggatnncacgtcnacgtcatcatcatcaacaagtgggatcttcaggtccccgtccctcgcgcttgctcttggttaaatcctggtcttctttttttgtttcaattcaattccagagatgggcaggtatgtagttattatataatcattcaggggattttgggggtggatccgtccggacaaccaaagaattcgccccctttttagttcttgcctttcaacccaaccgttcaaaaggggcgaaataaacgccccccaggagggtgcccgccttttttctcccaggggtttgggagggaaaataaagggaaaacaccccttttttttttttggccgcacg

SEQ ID NO: 85356 - protein, 89 aa, Zea mays
  misc_feature: Ceres CLONE 1571664
  misc_feature (24)..(24): Xaa is any aa, unknown, or other
  misc_feature (27)..(27): Xaa is any aa, unknown, or other
MEDAKMGKRAHIRAVLAILQWWGXHVXVIIINKWDLQVPVPRACSWLNPGLLFLFQFNSRDGQVCSYYIIIQGILGVDPSGQPKNSPPF

SEQ ID NO: 85357 - DNA, 805 bp, Zea mays
  misc_feature: Ceres CLONE 1571665
  misc_feature: Encodes the peptide sequence at SEQ ID NO. 85358
  misc_feature (642)..(642): n is a, c, t, g, unknown, or other
ctccccgcggtggcggccgctctagaactagtggatcccccgggctgcaggaattcgtctcacccctagaaaaagcccccggtgagctgccactgccagcttccccgtgcgcgagctgtgctgctgctcggcggcgcgcccactccccggccgctccctcgtcactccgcctgccggtaatcggtctctatatatataggtggttcgaggtgatcggcagaaccacacaggcaaagatggcgagcgtgcacaaggccaccacccttgttctcatgttctgcctgctagcgctggggagagcggagtacctcaagtacaaggacccaaagcagcccgtcgctgttcgcatcaaggacctgctgggtcggatgactctcgccgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtataccgatcatctacggtatcgatgcagtgcatgggcacaacaacgtctacaaagctactatttttcctcacaacgtcngggcttggagctacccagggaccctgacctcgttaaagagaattggagaaagcactgctctttgagttagagctactgggatttccttacgccctttctccctgtatagcgggtctgtagaagatcaaagatggggaacgttgctatgagagctacagtgaga

SEQ ID NO: 85358 - protein, 156 aa, Zea mays
  misc_feature: Ceres CLONE 1571665
  misc_feature (136)..(136): Xaa is any aa, unknown, or other
MASVHKATTLVLMFCLLALGRAEYLKYKDPKQPVAVRIKDLLGRMTLAEKIGQMTQIERENATADALAKYFIGSVLSGGGSVPAPQASAQAWAAMVTEMQKGALSTRLGIPIIYGIDAVHGHNNVYKATIFPHNVXAWSYPGTLTSLKRIGESTAL

SEQ ID NO: 85359 - DNA, 810 bp, Zea mays
  misc_feature: Ceres CLONE 1571667
  misc_feature: Encodes the peptide sequence at SEQ ID NO. 85360
  misc_feature (768)..(768): n is a, c, t, g, unknown, or other
ctccccgcggtggcggccgctctagaactagtggatcccccgggctgcaggaattcgtctcacccctagaaaaagccgccactccgccgctcctctccgcttccaagatgtcgaagcgaggacgtggaggttctgctggtaacaagttccggatgtcactgggtctaccagtggcagccactgtgaactgtgctgataacactggagccaagaacctttacatcatttctgtgaagggaatcaaggggcgccttaacaggcttccttctgcctgtgttggtgacatggttatggcaactgtgaagaagggaaagcctgaccttaggaagaaggtgatgccagctgtcattgtgaggcagcgcaagccatggcgccgaaaggatggtgtctacatgtactttgaagacaatgctggagtgattgtgaacccaaagggagagatgaaaggctctgccatcactggacccatcggaaaggagtgtgctgatctgtggcctaggattgccagcgcggcaaatgcgattgtctagtggaatcagttgatcgaaatttacttcaaataacatttgtttgtgttgcgaattgggaagagagtttttagttagacgagcttttgatggccctaaagatgttttcccgggatgatgtttgtgctgctggaccgtttcctgttagcttcgatggcatcctccccatatcgataaactgttgcttagcctgacaatcggaagagtttaaaacactctgcccagctaagctaagctcccntccgtcatcggcatggcgactaccactactaccatcctcttc

SEQ ID NO: 85360 - protein, 140 aa, Zea mays; identical to SEQ ID NO: 84187
  misc_feature: Ceres CLONE 1571667
  misc_feature (19)..(140): Pfam Name: Ribosomal_L14 Pfam Description: Ribosomal protein L14p/L23e

SEQ ID NO: 85361 - DNA, 811 bp, Zea mays
  misc_feature: Ceres CLONE 1571669
  misc_feature: Encodes the peptide sequence at SEQ ID NO. 85362
ctggagctcaccgcggtggcggccgctctagaactagtggatcccccgggctgcaggaattcgtctcacccctagaaaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaaccacttcctgacggctgctgctgggtgccggtggatggcgccacggcgctggaactggcgcgcctcggcccccgggaactgctctcgctgtggcgctcgcctggaccgggaattgggtcacaatcccccggcccgggggtcccggggcgtcttcctccggcccccgggttacttaagttcccggccccagggccgggggaccccgggggggaataaccccggtgttaaaaagccccccccccacaggttggcgcggggggcccttttcccccccttttattggaggaaaaaaaccgccccccttttttaggggaagaaaaagaaaaaaagaaggtgggggcttttcccaaaaaacaaaaattaccctgtgaaaaccccccgggggggcccccccccaagaaaaacaattttgtcccccccccccccgccgaaaaaaaaataaatatatatttgggggccacaaaacaccaggggagggggggg

SEQ ID NO: 85362 - protein, 96 aa, Zea mays
  misc_feature: Ceres CLONE 1571669
MPSGSAFSGSVNLKHVKLGYQYLVKPLPDGCCWVPVDGATALELARLGPRELLSLWRSPGPGIGSQSPGPGVPGRLPPAPGLLKFPAPGPGDPGGE

SEQ ID NO: 85363 - DNA, 950 bp, Zea mays
  misc_feature: Ceres CLONE 1571670
  misc_feature: Translation starting site: 292
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (40)..(40): n is a, c, t, g, unknown, or other
  misc_feature (41)..(41): n is a, c, t, g, unknown, or other
  misc_feature (51)..(51): n is a, c, t, g, unknown, or other
  misc_feature (52)..(52): n is a, c, t, g, unknown, or other
  misc_feature (55)..(55): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (105)..(105): n is a, c, t, g, unknown, or other
  misc_feature (127)..(127): n is a, c, t, g, unknown, or other
  misc_feature (131)..(131): n is a, c, t, g, unknown, or other
  misc_feature (135)..(135): n is a, c, t, g, unknown, or other
  misc_feature (136)..(136): n is a, c, t, g, unknown, or other
  misc_feature (154)..(154): n is a, c, t, g, unknown, or other
  misc_feature (165)..(165): n is a, c, t, g, unknown, or other
  misc_feature (173)..(173): n is a, c, t, g, unknown, or other
  misc_feature (174)..(174): n is a, c, t, g, unknown, or other
  misc_feature (193)..(193): n is a, c, t, g, unknown, or other
  misc_feature (231)..(231): n is a, c, t, g, unknown, or other
  misc_feature (448)..(448): n is a, c, t, g, unknown, or other
nnnnntttttggggnnnnnnngggnggnnnnggggttgtnngggggtgggnnggntnnnnnnngnnnncnnnggnnnnnnnngggnnnnnnnggggggagggggntgcaaaactggaagctccaccncggntggnncggccgctctagaactangtggatccccncgggctgnncaggaattcgtctcacccnctagaaaaaaaaaaaaaaaaaaaaagctaaaaccctangctccaaaaaaaacgaactagaaacgaccgcgaagccacaggtcgaaggcggcggcggcgatggggagcgacacggagacggagaagaaggcctcggtggcgctgatgtccatcgcgaaacccctcgctggaaagaagctctgcaagcggaccctcaagctcgtgcgacgagcctccgaggcgaagtgcctcaagcgcggagtcaaagaggtagtcnaagagcattcgccgcgggaacaaaggattgtgtgtgatcgctggaaatatttctcctattgatgtgattacacatgtttccgataactatgtgagggaagctaatgtttccttacgtatatgttcccatcaaaaagaggaatctttgcgacccgccaggaaccccctaagaaggccgactttgtttgcgtcctggggttctgaccaaaacccaaaccaaggggggaaactcaattgggaaagggttgaaaggaataaaactgaaaagtccggacctattgaccccaagttttttaaacggaaaaattcccttaaagggttacattcctgcaaaaggtttttgggaggaacccacctttttttcttgaagaaaacccggggcaaatattcccccggtggcaccccgtctctttctctcgggggggggaggaaaaaccccgggcccccaagatttttcccgggggaaaaccccccccaccccaaatattgtgttttttttgcct

SEQ ID NO: 85364 - DNA, 1146 bp, Zea mays
  misc_feature: Ceres CLONE 1571671
  misc_feature: Translation starting site: 264
  misc_feature (772)..(772): n is a, c, t, g, unknown, or other
  misc_feature (1146)..(1146): n is a, c, t, g, unknown, or other
aaaaaaaattatatttgatgaaaggagaaaatgcgtaaaggatgttaaaggcgtagggtgtcccccctagaagagggagctggaactcaccgcggtggcggccgctctagaatagtggatcccccgggctgcaggaattcgtctcacccctagaaaaagcgccagcagcaggctagctctgctccgccgctcactgctcgctagctactggaccgcgcctccctctctccatcgcgccggcgcgcacggctagggctagcgagatgcctccgctcgcattcctccgccgctatctccccgcgaggcttctcgcgcgagcgtgcgatggtggagtctgggggagcccgggcgtggcgcgggacgaggaggccggaggcagcggcggactgagcggccggtcggcgggggcgccgtccggggagtgctacgcgtgcacgcagcccggggtgccggcattccactccacggcctgcgaccaagtgcactcgccggactgggacgccgacgcggggtcctcgctggtgccggtccaggcgcagcatcaggcccagccggccggcggcgggcggcgcaagcacgcggccgccggtggcttgtttcggggccccgttgcctgagacccggcggcagcaaagccgcggtgtcaagccgcctggggaacccggcctggagaatcccttagcttcggggccaggcagccccgcaccgtccgcctttggggcggccttgggaaaacccccaagcgtcaccatttcctttatcctgaaccggncgaggcctttctttgcccaattcacagagtgcccagctcgcaccccgggcccacgcgggccccccttggcccccttctcataacctttggggaaacaagcccggggggcacttccgagccaagcacgcgcgggggttaatccccgggggcactctcgcgggaaacccgtggccgccccgataactattcgggagggaacacttttgtggcggcaacattttgggtccccagggcatagtttcacgacccctgtggcccttaaacgatactcaccctcgccaaagatcccccccccgctcgatccgagggtggcgagaacaaacgcctcggttctgtgggaacaaccccccgcggttatttctgtcggcggcacn

SEQ ID NO: 85365 - DNA, 1253 bp, Zea mays
  misc_feature: Ceres CLONE 1571675
  misc_feature (1191)..(1191): n is a, c, t, g, unknown, or other
gggggagaggatatgaagttttagctcccccggtaaccacacttaatctattccccccccccggccgcgtaggttggagctccaccgcggtggcggccgctctaaactagtggatcccccgggctgcaggaattcgtctcacccctagaaaaatcaagtgtcaacccaaccgtccacggtccgccctcctccttcgttcacgtcttcctcctcgcgttcctctcgtcaatacggcgactccgctaggctcgcaccgcagacgctcccccttcccggatctagcctctcttttccaaaatcggattctaattggactagcgtagccgcctttgcgatgtgccgaggccttcagacgatctacgccggcgaaggagcgcccacgtggagttacagacggcatgaccagaatgtcctctatatcatcttcagtatgagttgaaaaaacaaccttttacaacccaaactttttaatttattttaccacgcagccgcaatttgaccgatccaaaattctgttatggagccaaaatacgccaccatatacttccgtgccagaccactccccccacaggacgtgccgtcctagatcgtgcgccttgctagctaaatgtaaaaattaataagctcttatgatgggaataatacagcaaataacaacaaaaggttgagtctataattctgcttcgtgttgattgtcttccgcttctcttgggggcgagcatttcgtacaaccccatacttcgatccacctcgtttaaagaaccaaaatgtggtaagatgtatagattgtcgtctcctggtcggtgagttgtgtggcacgttctctacccgctttgatctgacgcaaccatacagcaatatcattatatgcgcaaaattaatcttgtattcgcgcgcataactacgaaagtaaccgagaaaaatatgaataagtatttgccgacgtacaaaatctggtactatgtacgccgtgtgggctattcattctcgacaagacaaagaggtgggtgtagaaaacgagggcttcttgggtgcgcgcgccagatgtacatacccgcaggctcttcctttgctccaatctccgggtgaaaagtagcttctcagcccctaacaatctctgctcgccaggctacaattaattcccacgccacatcagaggtggataaaacaggctcagcatccacacgcaantatttactaaaattttaaactctatgtttcgctgttttcacgttagttagtttataaccggt

SEQ ID NO: 85366 - DNA, 792 bp, Zea mays
  misc_feature: Ceres CLONE 1571676
  misc_feature: Encodes the peptide sequence at SEQ ID NO. 85367
gcggtggcggccgctctagaactagtggatcccccgggctgcaggaattcgtctcacccctagaaaaaaataccaccagtaccactccattccgcgctacctgtaggacggtacagctgctacacaggtgcgacatacaactaccactacccacgcccctcatatatggattccagctctacgccgccgtgccccggttccactgtctcctgggctaccccgctcccaggtccgcggcggcagccctgcagcccctgaggctgggcaggaagaggtcggcttcgctgggtatccgcttcgactacctacgctcccccacacaacctgatcattgtgactaactaccacccttatgctgttcacagctcctttcgcactggcaccacctgctaaccaccaggtgactgccgtgcttaaactggaggcgcgccgactcccgtctgcagacagatgaccacgtcgggttgcatactcgccgacacgctggtctaccgtgccgtaggtcacatcgtccgcgtgcgcatactgctcggggtctacaaagaggtgccctagaccatatcatcgtatacatacctacgtcaccgttgcttagatttgaatcaccacccgcagatcgcgcgcctgacctgcagtgcctagcagcggccactttgtaacatatgaccttgcgtacatgtacattgcacccagctcgggtcgatgaacatatagcttcctgtggttcgtctcaatctatctatctccctcacttttttttccctttatctcatcattttcttttctcctgaa

SEQ ID NO: 85367 - protein, 112 aa, Zea mays
  misc_feature: Ceres CLONE 1571676
GGGRSRTSGSPGLQEFVSPLEKNTTSTTPFRATCRTVQLLHRCDIQLPLPTPLIYGFQLYAAVPRFHCLLGYPAPRSAAAALQPLRLGRKRSASLGIRFDYLRSPTQPDHCD

SEQ ID NO: 85368 - DNA, 869 bp, Zea mays
  misc_feature: Ceres CLONE 1571679
  misc_feature: Encodes the peptide sequence at SEQ ID NO. 85369
ctccccgcggtggcggccgctctagaactagtggatcccccgggctgcaggaattcgtctcaccccctagaaaaagttttgagttaaaccttcacggaacagagggaagctagagagcctcctcggattctctacgtgctgccgcgcgagaggggagagagtttccctttttccaatcaccctctcactggagtgcggcagcagtccagtctccattcccccagttcgtgctccctcccatagtcgtcggccgccgccgccgccgctgttcgtcctctcgctccttctccgcggcgacctagcgagagttcgtgcgcgtgtttggtaagggaggaggaagaaatggctcttctataaggacaaaaatcagcttttcttgagagcttctgagaagtgtccctgggcttacagcttagtcagatccttgggcacaaggatatgtgggtcaaagaaactacatggcgtgtttacccttcttatgctcatggttttcaatggtttcaggggcatttggtgggaatcactattgggaaaggaaatgtggaactttcccccccacaaacgaaattaatgggcttttcctcaaagccaaaaaaaaattccccctggttcccctcgcctggatccaaaaccatccaaaggttgacgggccccttgcaaaatcccccaaacccaaagggggggggtggggggtcccaaaaagaacagcgtacttttcggggggggccaaatttcttttcccccaaggggggggaaagtggggtaaaaaaaaagggggaagggtgtttaattttcggggggccctaaaatctccaattatttttgcgtgtgggggaaaaagaggaccctttttaaacaccctttcccaa

SEQ ID NO: 85369 - protein, 30 aa, Zea mays
  misc_feature: Ceres CLONE 1571679
MLMVFNGFRGIWWESLLGKEMWNFPPHKRN

SEQ ID NO: 85370 - DNA, 881 bp, Zea mays
  misc_feature: Ceres CLONE 1571681
  misc_feature: Encodes the peptide sequence at SEQ ID NO. 85371
ctggagctcaccgcggtggcggccgctctagaactagtggatcccccgggctgcaggaattcgtctcacccctagaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggttgatcgcggtgtcggagcccatatcgttcaagaaccccaaggcgccccgtgttcccgcgccctggcgccggggcacgttcccacgaccgagattgacggtggacgttggaccagccggctaacgccattcaatgaaggccgtaccccctttcgttggaaggtggggccgcccccttggtccgcccgggcgggcggggcgcccccgggaaaaaaacggggggcggggggggcccccggccggagaacaccgcttcacacctttttcaaa

SEQ ID NO: 85371 - protein, 194 aa, Zea mays
  misc_feature: Ceres CLONE 1571681
MAVALLAALVASAAMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFKNPKAPRVPAPWRRGTFPRPRLTVDVGPAG

SEQ ID NO: 85372 - DNA, 824 bp, Zea mays
  misc_feature: Ceres CLONE 1571685
  misc_feature (639)..(639): n is a, c, t, g, unknown, or other
ctggagctccccgcggtggcggccgctctaaaactctgggatcccccgggctgcacgaattcctctcacccctagaaaaaacaccaccacagcaccatcttgaccagcacgcccacttgtgtccgattatttgagcccgagggcaaggcacgggccttggtgctgctcccgttcttatccgcaccccacctcatgcataccctcctccacccttcccctctctcggccctacctccctccgtcatcttctcctgatcatgccaaaagctggaccaacctgaaaaatatctagcgggagataaacacgaacaactcggtgaatacttggaaaaaaacgtcccccacaccccccactgttgtgaatactacaaatagcattactacgaatagagccaatctgcacgtaactgccagtcaattgctactacgtggaccccacttcacgtatcgagctgcgcaacctcgcttacgatatactacaccatgatagctcgctggcccgacaactccccggatctcatgcagtacagacgcgcccagaacgtgtgcttcacctcagtcttgcacgagacatacatcggtaactagtacgtgatgagggtacgggatgacgtggacgcatccccaggagaactcccngacgcccatggagtaccagagcgatgacgacggtccagacatcgcaggagcataggcgcccgaatgatgccgcccacacatctaagctgtagtcggctcacgagatctgcattacaccccccgccacagtactccatggactaatggtcggggcgcctgatccgatggtctgaatccatagccaa

SEQ ID NO: 85373 - DNA, 789 bp, Zea mays
  misc_feature: Ceres CLONE 1571687
  misc_feature: Encodes the peptide sequence at SEQ ID NO. 85374
  misc_feature (701)..(701): n is a, c, t, g, unknown, or other
  misc_feature (731)..(731): n is a, c, t, g, unknown, or other
acccgcggtggcggccgctctagaactagtggatcccccgggctgcaggaattcgtctcacccctagaaaaagatctcccaccaccaccactgaacccgctgcttcccctcctccacacctctcggtttcgggaaacctctcccccgttcccctcgaagcctacgggctcggggggcttcgatcgaatcgaatcggatcggatcggaagcatggagatctcgctcgaggcgtcgtgggtgggcgtgcagcggcacgggcaggacctggcggaccgcctcgcgcagggcttctcggggctcctcctccacgcgcagccgccgcagctgcccccatggtcgccggcggcgctgttgccgcccaagctcgtcatccccttcgacctcgacctccccgttgtccccttcgtcgccgggatgcgccgcggggtcgggaccgtggacctccccgccgtggccgtctcgtcgctcgtcgagatcggcggcaggctcgggcaggcggagtccgagctcggtgcggcggttcagcatctcgcgcgccaggtgcctgtgcctgtgcccttccggaaatgggaatgcgcacagccgccgaccgtggtgacgggggatgttgcgctcgctgtggggacagttgggtccgcgaacgtcgctttggtaaaggctgtagacatagggtccctccaggtggcagcggctgctgctgncggcggcactgggagtgccactgcaagtantgtgggcgccggtggggccatggacgacgatagactggttgatgaggaagaccgattt

SEQ ID NO: 85374 - protein, 193 aa, Zea mays
  misc_feature: Ceres CLONE 1571687
  misc_feature (164)..(164): Xaa is any aa, unknown, or other
  misc_feature (174)..(174): Xaa is any aa, unknown, or other
MEISLEASWVGVQRHGQDLADRLAQGFSGLLLHAQPPQLPPWSPAALLPPKLVIPFDLDLPVVPFVAGMRRGVGTVDLPAVAVSSLVEIGGRLGQAESELGAAVQHLARQVPVPVPFRKWECAQPPTVVTGDVALAVGTVGSANVALVKAVDIGSLQVAAAAAXGGTGSATASXVGAGGAMDDDRLVDEEDRF

SEQ ID NO: 85375 - DNA, 817 bp, Zea mays
  misc_feature: Ceres CLONE 1571690
  misc_feature: Encodes the peptide sequence at SEQ ID NO. 85376
ctccccgcggtggcggccgctctagaactagtggatcccccgggctgcaggaattcgtctcacccctagaaaaagctcctcctgccgtcctcgctcctccccacctcccgcggcctcccacgcgacatgattgcattgcgggctgccgcggagctcagctctcctgtcctgccaccaccacgccgctgacgatgccttcctctcgcctgcctctgcctgcgcacaaccgaaacggctagcccgcccttcctcccctcccctttgcttccgcaccaagatttgggcgggcgttccttcttccgataaagtgccgagccagggtgactgttccgaggagcgtggcgtggacccatggggaagaagggcaagtggttcggcgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaagaggccccctgctgctgctgctgccccagcacaggcgtcggtgctgccacctggtgcgccaaccgaagagctcgccgcaatcaagatccagacccgccttccgaggttaccttggcagggaaggcactaagagcactacgaaggctggtacaattgaagtcattggttgaagggtatttccagtaagcgtcaatctgcaggcactctgcgc

SEQ ID NO: 85376 - protein, 146 aa, Zea mays
  misc_feature: Ceres CLONE 1571690
MGKKGKWFGAVKKVFSPESKEKKEERLRRKSAASNPAPVDLTPSTSLEVNVSVPPPPAPPPVPRQTDEVRVPEAEQEQSKHVTLEEAPCCCCCPSTGVGAATWCANRRARRNQDPDPPSEVTLAGKALRALRRLVQLKSLVEGYFQ

SEQ ID NO: 85377 - DNA, 777 bp, Zea mays
  misc_feature: Ceres CLONE 1571696
  misc_feature: Encodes the peptide sequence at SEQ ID NO. 85378
tcaccgcggtggcggccgctctagaactagtggatcccccgggctgcaggaattcgtctcacccctagaaaaaaaaaggtgcgggcttcttcttctcctaccattacttgcttcagagctcagcacatctccggtaggccggggtcttttcttctgccagccatgggttcaggtctcttcaagccttgtgttcatccggacttccgtgttgttttctctaagatgtctttcggtgacaagattggctttctattcgttcatgcatttgacaagagaaacctgtggcacaagatgcctgttctgatcggtttactgtacctgaacacccgtcggaccctcctcgaaaaatacaacctgctagctgttgggagttctcatggtgctctgattgaccccaaggatcagttcatgtaccgcaccggagatggcaagtacaatgaccccgataatgctgaggctggtagccaatacacattttttgggagaaacatgaagccggttgatcaagagtatgagttgatgagcccagatccatttgttgtggcgacaaagctgttagccaggagagaatacaaggacacaggaaaacagttcaatatactagcagctgcatggatacagttcatggttcatgactggatggatcatatggaggataccaaacagattgaaatcacagctccaaacgaagtggccaataagtgcccactcaaatcattcaagttctatgccacaaaagaactgcctacgaattctgatggaacaataaagactggt

SEQ ID NO: 85378 - protein, 205 aa, Zea mays
  misc_feature: Ceres CLONE 1571696
MGSGLFKPCVHPDFRVVFSKMSFGDKIGFLFVHAFDKRNLWHKMPVLIGLLYLNTRRTLLEKYNLLAVGSSHGALIDPKDQFMYRTGDGKYNDPDNAEAGSQYTFFGRNMKPVDQEYELMSPDPFVVATKLLARREYKDTGKQFNILAAAWIQFMVHDWMDHMEDTKQIEITAPNEVANKCPLKSFKFYATKELPTNSDGTIKTG

SEQ ID NO: 85379 - DNA, 1265 bp, Zea mays
  misc_feature: Ceres CLONE 1571699
  misc_feature: Encodes the peptide sequence at SEQ ID NO. 85380
  misc_feature (17)..(17): n is a, c, t, g, unknown, or other
  misc_feature (18)..(18): n is a, c, t, g, unknown, or other
  misc_feature (65)..(65): n is a, c, t, g, unknown, or other
  misc_feature (76)..(76): n is a, c, t, g, unknown, or other
  misc_feature (850)..(850): n is a, c, t, g, unknown, or other
  misc_feature (878)..(878): n is a, c, t, g, unknown, or other
  misc_feature (1035)..(1035): n is a, c, t, g, unknown, or other
atgtttatttgtatacnnttaacaagccattgattggcgatctttcttaccaccgagggggaganaaataaataanaaaagctggagctccccgcggtggcggccgctctagactagtggatcccccgggctgcaggaattcgtctcacccctagaaaaacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatgggtccggggggtttattctggaccaccataacctttcagcttgagggccaccccacagttttccccaagttgcctatctaataaaaggggaacccctcccccttttggaaagaagttttttcaaaatcccggttgtaggtttcccaagaaattttgttgccaagttggccttccacaatgggggagggaatttatggcctccgcagcccttcgcctattttcggaaagacgaaaacgtgggggggccttcttcccaacacaaatacttctggccttcttcctgtgggccactcttttcgcgggaagatagtttacccagacaggggtgtgggagtctagactaggcgaaaaccacctagtggggcgcgctccgttcttctccccacatganataacttctatgtggagaagagaccctntctgtctctgagcggcgcactctcttccggtcttcttagacaaatctgtgctattgcttatcctcaacagaaaaggcacaagccgcctcgtatgtgatgggggggccccctccgtggtagggacaacgaagcccttgtacgcacccgcataagactnttgcctcgtcgtccgtgtggaatctgtgtacgccggacagatacccccctgcaggttctccttttcgaagcgtcgaaaatcgagcggtgactatcttctaaaatttgtcacccacatgtggtgtatagaggcacacctggacctatttgttataatctgtgaaacgagtccagttgcgactataccccttacccctgacggtgcatctgcgagagaggagaggcagaggt

SEQ ID NO: 85380 - protein, 100 aa, Zea mays
  misc_feature: Ceres CLONE 1571699
  misc_feature (4)..(93): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMGPGGLFWTTITFQLEGHPTVFPKLPI

SEQ ID NO: 85381 - DNA, 1270 bp, Zea mays
  misc_feature: Ceres CLONE 1571700
  misc_feature: Encodes the peptide sequence at SEQ ID NO. 85382
  misc_feature (15)..(15): n is a, c, t, g, unknown, or other
  misc_feature (695)..(695): n is a, c, t, g, unknown, or other
gggggttctggtttntttttgcgtgtttttaattgaagtaaaggtcttttataatttatgcctgagaacagaggggaggtgggactccccgcggtggcggccgctctagaactagtggatcccccgggctgcaggaattcgtctcacccctagaaaaagtgggaaattgaagcggaggaagatagagagaaaaagaggagacgagagagggagagagatgctgcaggtggaggaggcgctggcggcggtgctgtccgcggcggcgggccacgcggagccgcacgccgtgccgctgcagggcgcgctagggctcgtcctcgcggaggacgtctgcgcgcccgatccgctccctcccttccgcgcctccatcaaggacggatacgccgtcgtggcctccgatggggccaggggagtatcctggtggtcacggagtcgagggcgggcgacgacgccctcggagtggttgtagtacccggggacttaccccccacctctaccaccgggaggggccggttcccgattgggcagccaatgcccgtacttggcggggaggaagggaaaacgggagcaaacttcccctgggtatggttctgggaaagggggtcccaaaggagggggtaaagaaattttcctttagcgcccggggtgccgttcaccctatatggagacagggggaggcaatttcacagccatanatggcaggggggaaatgtgttggtacccactctggggaaggcacaagggcgaattttcctcaatattatattgggcagctgacagaagagtgtcctccagcaggctactaggaaagtacgaaatttccaactggagagagtgtctccccgccggtgtgatagtgataaaagaatagtcgcgtgggggcgcgctgttgatctgggttgtggataaaaaacaaatggtggcgagggcggggtggtggcatttatacgttctctgggagcgcgcttcaaacgtgatgtggagtagtttatgcgaagcggagggagtggcgaatagaaaatagaaggcgcaatgaggcagattattctgatctcccctccattcgggggccgaccaggttagtaactgttatgggggtgaatgtgctgtctgtagtctgacttgtagtctacccctcatgttatgaaatactagggggtctttttaagaatatacgtgctgtgctgtagcgagactttgtttctccaccaggagtatatcgattggacatgtgggatatctaatgtgctggcttctcataatatactcc

SEQ ID NO: 85382 - protein, 83 aa, Zea mays
  misc_feature: Ceres CLONE 1571700
  misc_feature (1)..(84): Pfam Name: MoeA_N Pfam Description: MoeA N-terminal region (domain I and II)
MLQVEEALAAVLSAAAGHAEPHAVPLQGALGLVLAEDVCAPDPLPPFRASIKDGYAVVASDGARGVSWWSRSRGRATTPSEWL

SEQ ID NO: 85383 - DNA, 821 bp, Zea mays
  misc_feature: Ceres CLONE 1571702
  misc_feature: Encodes the peptide sequence at SEQ ID NO. 85384
  misc_feature (821)..(821): n is a, c, t, g, unknown, or other
ccgcggtggcggccgctctagaactagtggatcccccgggctgcaggaattcgtctcacccctagaaaaagtcgccctcccctcgcgcaccgctcgcaaaacctctcctgctcctacgcccgccccaaaccctagccccgacagcgcggcagctcgtggctttggccgcgtcattcccgtctgcgggtggggcggggacaatgagccgcgacgcgttccgcgcggccgtgaccaacacgctggagcgccggctcttcttcgtgccctctttcaagatctacagcggcgtcacggggatctacgactactgacccccaggttgcgctgtcaaagctaacgtcctcccattctggcgccagcattttgtattggacgaagggatgcttgagggcgactgtccatgtgtgacaccagaagttgtcttgaaagcctcttggacatgttgataaatttacagaactttatggtttaaggagataaaacaggcaactgctcccgtgcggatcatttgctggaaggactttctgcaggattagcttgaaaataattacaatttgtcaccagaagatggcgataagaaatcattaggaggtcttgccacccccggatggaatcttcccgggcccaatcatttgggcggccaagatttaagggctggataaggattggttggcccccccaacgccaaaaaaaatccctttgggggttcccttaccccttttttaaaggtccccggttgtacaaatttgtcatttttggtacccctgggggatttatgggccccccctggggttttttcttagcgccccaataaaaacccn

SEQ ID NO: 85384 - protein, 36 aa, Zea mays
  misc_feature: Ceres CLONE 1571702
  misc_feature: SWISSPROT Homolog: EC 6.1.1.14 Glycine--tRNA ligase
MSRDAFRAAVTNTLERRLFFVPSFKIYSGVTGIYDY

SEQ ID NO: 85385 - DNA, 809 bp, Zea mays
  misc_feature: Ceres CLONE 1571704
  misc_feature: Encodes the peptide sequence at SEQ ID NO. 85386
ctggagctcaccgcggtggcggccgctctagaactagtggatcccccgggctgcaggaattcgtctcacccctagaaaaaatcgccatggccgaggacggcaagtccaatgatcaaatcctcagtgagctcgacgcactcagccacacgctctaccaggcgcacaccaagcgccgcaccacctcgctcgcgctccgtcgctctgccgtcgacgaaaatgcaggcggcgctgacgctgtcgctgtccgcaccgcggcgcgcccgctctcccgccgcatgtccatgtcgccgttccggtcgaggcctaagctggacaataacttgaacgacgacgacgacgaagacgacgacgcgggcgtggcgctgccgtccaagagccagagcttcgctgcggtgacaacgtcgccgaccgtggtcggggagaaaaagggcattcgggggatgggaagccgatgcgcgcgttgtcgcgcatcggcatgcatcggatgggctgcctcttctccgtgggaggtggtgggccgcgcagggccttcccacgtccatggatgggctgcgcctcgcgggggccgttccaagaaaggaaaacccgccgaacgcgggcgtgcagaccatgcccgtcccgcggggcagcaggggggcgggccgaatttcaaaggagaaccctcctttcgtcccggtggcaaccttctacctggaaagggggggcggggcccccaccggggtaaggccccccttcaaggttcggaagccccccgggccggtttcccctcctgggtcctggggcgggcccccccctgggggaagggccgc

SEQ ID NO: 85386 - protein, 241 aa, Zea mays
  misc_feature: Ceres CLONE 1571704
MAEDGKSNDQILSELDALSHTLYQAHTKRRTTSLALRRSAVDENAGGADAVAVRTAARPLSRRMSMSPFRSRPKLDNNLNDDDDEDDDAGVALPSKSQSFAAVTTSPTVVGEKKGIRGMGSRCARCRASACIGWAASSPWEVVGRAGPSHVHGWAAPRGGRSKKGKPAERGRADHARPAGQQGGGPNFKGEPSFRPGGNLLPGKGGRGPHRGKAPLQGSEAPRAGFPSWVLGRAPPWGKGR

SEQ ID NO: 85387 - DNA, 962 bp, Zea mays
  misc_feature: Ceres CLONE 1571705
  misc_feature: Encodes the peptide sequence at SEQ ID NO. 85388
  misc_feature (1)..(1): n is a, c, t, g, unknown, or other
  misc_feature (18)..(18): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (65)..(65): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
ngtgttgttgtggggggntgtggggaggttttctcgttggtggcggtgtttgctggtcttnnannaagttnnnnnnnnngaaactgggactccccgcggtggcggccgctctagaactagtggatcccccgggctgcaggaattcgtctcacccctagaaaaaacgccacacaccaccaccggacgctagctcaccaccaacctcagcacatcgaggagaagaggagtggccatggcttcgtcggtggccaccgcggcgagcacattcctgggcacccgcctggcggacccggcgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcagttcgaactggactcgctggaccagaacctggccaagaacgaggccggcggcatcatcggcacccgggttcaagtcctccggacgtcaagtccaccccggctccagccctacagcgaaggtggttcggcctcccagcggtttccggcgagtggcgaagctcatcccaccggccggaatgggcccatgcctcggccaccccttcgggggccccttcaccggtcgaagtgggcttcaaccggcgttcacccttggcaaggaatgcctggcaaagggggggaacctgggtgggaatggggtccctcccttaccttggggaccaagcccgcttgcccggttcaaccaatttccaaaccctccattctgggaattcaaaatggctttggtggaaccggcgtacccttggaagtttcccaggcggcaaaccccccaaaacttcggaacccccgggagaaaaaac

SEQ ID NO: 85388 - protein, 243 aa, Zea mays
  misc_feature: Ceres CLONE 1571705
MASSVATAASTFLGTRLADPAPQNGRIVARFGFGGGKPKAAVPKKVAKTSISSDRPLWFPGAVAPDYLDGSLVGDYGFDPFGLGKPVEYLQFELDSLDQNLAKNEAGGIIGTRVQVLRTSSPPRLQPYSEGGSASQRFPASGEAHPTGRNGPMPRPPLRGPLHRSKWASTGVHPWQGMPGKGGEPGWEWGPSLTLGTKPACPVQPISKPSILGIQNGFGGTGVPLEVSQAANPPKLRNPREKK

SEQ ID NO: 85389 - DNA, 832 bp, Zea mays
  misc_feature: Ceres CLONE 1571706
  misc_feature: Encodes the peptide sequence at SEQ ID NO. 85390
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (789)..(789): n is a, c, t, g, unknown, or other
gagctcaccgcggtggcggccgctctagaactagtggatcccccgggctgcaggaattcgtctcacccctagaaaaactnnnnntggaaaaagaaagaaaataaaaaacgcactcgagctcgagccctcgcccgctcagtcacaaagcctcagatctcagtcacctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgccattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaagacaagtttgggggaggaaatgaagaaaaacgcctcacctgcaggagttaccggctcttttctaccgaggatggagactggctcctacggggcacatggggttgaatgttgttggttggggggggaaaagggcatttgatttggcaaatctgggtcgcggggaaaactggttaaaaattctggagcccctctaaaggagacccagaggaaccggggccccctggttggaaaaaaggggaaaaataaattcgtacattgggcggggaatttttccccttacagggggtggcgcctgggattttttttcccaggnttagtcccccctgaaagcactcgcttgagagcaaaaataaaag

SEQ ID NO: 85390 - protein, 124 aa, Zea mays
  misc_feature: Ceres CLONE 1571706
  misc_feature: SWISSPROT Homolog: EC 2.7.1.20 Adenosine kinase
MAATEGVLLGMGNPLLDISAVVDDAFLTKYDIKLNNAILAEEKHLPMYDELASKSNVEYIAGGATQNSIRVAQWMLQTPGATSYMGCIGKDKFGGGNEEKRLTCRSYRLFSTEDGDWLLRGTWG

SEQ ID NO: 85391 - DNA, 806 bp, Zea mays
  misc_feature: Ceres CLONE 1571710
  misc_feature: Translation starting site: 165
ctccccgcggtggcggccgctctagaactagtggatcccccgggctgcaggaattcgtctcacccctagaaaaactcacacaccatcgaaacacaaaccagcagcaggcagagcaacgactagctgccaggcaagccggccggggtgctagcaagagtgcaacaatggccaccgcgctctccttcaaggccttggcactggccgcgctcctctccgtggtcgtcacctctggcgctcgcgccgagcaacagctcaagcgcaacgcaaccaccgcctcgcaggacagatccttgttgtcctacagcagtggctggctgccggccaaggccacctggtacggcgcccccaccggcgccggccccgacgacaacggtggtgcgtgcgggttcaagggcaccaaccagtacccgttctcgtccatgacgtcctgtggcacgagcccatcttcaaagacagcaagggctgcggctcatgctaccagaatccgggccttgaaagcaaccacccagcctgctccggcgtggcgcagacggggatcctcccggacatgaactaccacccggtgggcaaagtaccacttcgacctgaccggcacggggtttcaggtccatgggccaactgggggcctcaaacaaaaaagtccggacccccgggatcatcgacattgcatttcagggggggtggccgggcaaatttcccggggcctgaaacattaaccttccccggtccagaaaagggtttccaacccccttgtttcctgggcccggggctccttcttgggccgaaaaacacagggaagggggaga

SEQ ID NO: 85392 - DNA, 1039 bp, Zea mays
  misc_feature: Ceres CLONE 1571714
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (106)..(106): n is a, c, t, g, unknown, or other
  misc_feature (112)..(112): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (156)..(156): n is a, c, t, g, unknown, or other
  misc_feature (160)..(160): n is a, c, t, g, unknown, or other
  misc_feature (161)..(161): n is a, c, t, g, unknown, or other
  misc_feature (180)..(180): n is a, c, t, g, unknown, or other
  misc_feature (210)..(210): n is a, c, t, g, unknown, or other
  misc_feature (223)..(223): n is a, c, t, g, unknown, or other
  misc_feature (254)..(254): n is a, c, t, g, unknown, or other
tttacgtttcncnnaggagggattattaaaaaatttttagggaaanaaggggnnnnnnnnnnnnnnnnnnnnnnnnnnnnnnnnnnnnnnnnnnnnnnnnncttcnccttcntcttggtgcnnnnnnnnnntggaaaagctggggacctccaccgngggnntggccggggccgctctagnaactagtgggatcccccggggctgcagggnaattcgtctcacnccctagaaaaaaaaagctggctcatcaccgnatgggccacgggctaacacaagcaagcaagcaagtcactggagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgaggcgctgcttcttcgcggattccccttcttccctggtgggttctgggccggttcctggtttccggttaacttcgggggggtttcggggtgtttggggtttggggggtttcggggcaaaaaaaaaaaaccccaccgggaaccccgccccgcccgggtggggtggggggcccaaaggggaacccccccggaaaaaaaaggtctttttttggagacaccctgtgtttggggcccgttttctccccccccgccccctaggtaaaaaaaggtccccccccatttatttttgggggggggggccacctggggggacccccttttatggggggggggggagaaaatacccccccccacaaaaggggggggcccccccgggcgcgccgggggtgttttttgccccaaaattgttttttgtgggggccccccgaacacatcggtggggtggtgggttctccccccctcctctggggggccccttgtttaaaaaaaagggggggggggggggtgtttggtccccccccgcgcgggtgttttaaaaaaaagggggggggtgtttctccccaaacaaaaa

SEQ ID NO: 85393 - DNA, 841 bp, Zea mays
  misc_feature: Ceres CLONE 1571715
  misc_feature: Encodes the peptide sequence at SEQ ID NO. 85394
acccgcggtggcggccgctctagaactagtggatcccccgggctgcaggaattcgtctcacccctagaaaaaaatctccggaagaaggggaagcaagcatcagaaatcctaaataggggggcgcaccaagaactccactgagaatccccaatcatttctcggtgcatttggccccgctccaccatcaccgaaatctccaagaaaactcatcccgaatccgcccccgcccccaaatcggccctacaccgcaccagatcacagctcataattccagtgagaattcggaaaggaggggagcaatgacggaggtggcgctcctccggggcccgaccaacctcgcttccaccgcaagccgcgcccccgcctccccctccccctccccctcctcctcttcactgcagtatttagccaaagccgacagcgacgtgctccaaggaagcggcagcccggagcgcactgcgggatctgcggggagccgacgactccttgaactgcgcggacaagaggcggcggatgaggaagaggagcggtggtccttcttggcgctgctctttgagctactgcggaagtcgttgctcgggtgcaaggaccggggggggcggctaaagccaacaccggcggctgcgggatggagattgggttgccccacggacgggcagcaccgtggcgcaacgtcacggtttcaataggtatccaacggtattccttagggcttgccccgtttgtaatttccgaagccccgaaaatgggcccccgcgcgttggcccccccaattggccaaattgacaaagggtggaccttccggggagggttttcaaaccaaggaaactcagagtgggca

SEQ ID NO: 85394 - protein, 129 aa, Zea mays
  misc_feature: Ceres CLONE 1571715
MTEVALLRGPTNLASTASRAPASPSPSPSSSSLQYLAKADSDVLQGSGSPERTAGSAGSRRLLELRGQEAADEEEERWSFLALLFELLRKSLLGCKDRGGRLKPTPAAAGWRLGCPTDGQHRGATSRFQ

SEQ ID NO: 85395 - DNA, 1213 bp, Zea mays
  misc_feature: Ceres CLONE 1571722
  misc_feature: Encodes the peptide sequence at SEQ ID NO. 85396
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (17)..(17): n is a, c, t, g, unknown, or other
  misc_feature (29)..(29): n is a, c, t, g, unknown, or other
  misc_feature (45)..(45): n is a, c, t, g, unknown, or other
  misc_feature (46)..(46): n is a, c, t, g, unknown, or other
  misc_feature (52)..(52): n is a, c, t, g, unknown, or other
  misc_feature (55)..(55): n is a, c, t, g, unknown, or other
  misc_feature (59)..(59): n is a, c, t, g, unknown, or other
  misc_feature (1008)..(1008): n is a, c, t, g, unknown, or other
  misc_feature (1063)..(1063): n is a, c, t, g, unknown, or other
  misc_feature (1213)..(1213): n is a, c, t, g, unknown, or other
ttttttttattnngngnggctcactcctngtggttttttgtggtnncacatngancttncccccctccctacgacaggaatgctggaactccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagaggcagataacataaaattgaacttcagcaccgcttctgcgacccccgacaagtacaagagcttcatcgcttctgttcgtggtggcttgggggcccccccccagggagcaacaggcagcgggaattcccctgtgctggttcgacgtaaaacgtacccggctccgccgctcggaattcattttccaaaaacattcatcttctgagtataaacataaggccaagggccggctccccgttaagcccttggaaaaaattgggatggtccccaccaagaaaggccctaacgcttcccaggcggcctttatacaatatacgaaaaggggggacaagcccagccctaaagtaggccctctaccccctcccaggaggaaagaatgtcgagagggagcccccgggcctaaagagtgtttatcacctctgcaattcccgaggacacgaagaatactctggagttttaaacgcgagatccgacgtgtgcggggtgtacttgtgatggtgcgggggtgaatatatccaaatcgtttttcacatcggcgtcactctccctgtggtctctcataagcgccgataacaaccaccgggatccttgagctatgtggcccttgtaccccggagtgcgnagaaatatgaggcgctaaagatgaaatatacacccgttggtgggtgtgatcacangccagggaaataaatagaagccgcgaacatccaaagaaatatatatttcctcaccggtagccggaaaggtgcgccacgctttttagtcatgatgcgcactatagggcacacgcccggggttcgcgccgcacaagagagggcggaaaagcn

SEQ ID NO: 85396 - protein, 46 aa, Zea mays
  misc_feature: Ceres CLONE 1571722
MKGGTQAISLMVHLAVPWLCLASWAALLPALASGNVGAAAPILRGR

SEQ ID NO: 85397 - DNA, 708 bp, Zea mays
  misc_feature: Ceres CLONE 1571725
  misc_feature: SWISSPROT Homolog: EC 2.1.1.14 5-methyltetrahydropteroyltriglutamate--homocysteine S-methyltransferase
ctccccgcggtggcggccgctctagaactagtggatcccccgggctgcaggaattcgtctcacccctagacttctttcccttcttagcagcatccttccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatctctgagcagtgtgactgcctatggttttgatcttgtccgtggaacccaaactctgggcttgtcacgagtgctgggttccctgctggaaagtacctctttgcctgtgtttgtggatggaccccaacatctgggcctgaagaatcttgctacatctctcaacaactctccagtcctccttgaggctgtttgttgggaaaggaaaaaccttgtggaaaaaaaattccctggcccggctcaaaggaaacccgcgtttggggaattttttgggaaacaaaaaacataaacccctttgaacacggaaaaaaataaaaagccttggggccttggccctttttggccctccccccaaaaaagggtgtttttaaaaggggtaaaaaaccccccccttgccaaaaa

SEQ ID NO: 85398 - DNA, 835 bp, Zea mays
  misc_feature: Ceres CLONE 1571726
  misc_feature: Encodes the peptide sequence at SEQ ID NO. 85399
acccgcggtggcggccgctctagaactagtggatcccccgggctgcaggaattcgtctcacccctagaaaaaagtccccagtcccccactgggagcggcagccagcacgaggaaggagcagcgcgagggcaggcgccatgggggtccgctcggcggccacgaagctgcacatcccaccatccgccgcccgccgccccacgttcctgccattcgtggccgtcctcctcctctgctctgcctcctatctcatcggcgtctggcagcacggcggcttcgccactccatccgacaaacccgccgccgtctccaccgctacggccgtcgcctgcaccaacatcgccgccgccccgaagaggaggacccggtccggcgccagctccccgtccctcgacttctccgcgcgccacgcggccgcggcggacgacgcgctcgacgctagcaccgccaacgccgcctcctcggccgcgccggggaggtcgtcgtacccggcgtgccccgccaagtactccgagtacacgccgtgcgaagacgtggagccggccctgccgttcccgcggggaccgcctggtgtaccgcgagcggcactgcccggcgtccgaaccagaaccgcttgcggtgccttgtgcccccccccgcccggttacccgcaccccgttcccggggggcccgccaaccccggaaagtcccctgggttcgccaaaacccccccccaaaaggacctcccccgcccaaaaaggggggtggccaaaaattggattcccccggttaaacggggaaacaaggttttagggtttctccccgggcggggggggaaacaatgttttctcccccaact

SEQ ID NO: 85399 - protein, 232 aa, Zea mays
  misc_feature: Ceres CLONE 1571726
MGVRSAATKLHIPPSAARRPTFLPFVAVLLLCSASYLIGVWQHGGFATPSDKPAAVSTATAVACTNIAAAPKRRTRSGASSPSLDFSARHAAAADDALDASTANAASSAAPGRSSYPACPAKYSEYTPCEDVEPALPFPRGPPGVPRAALPGVRTRTACGALCPPPPGYPHPVPGGPANPGKSPGFAKTPPQKDLPRPKRGVAKNWIPPVKRGNKVLGFLPGRGGKQCFLPQ

SEQ ID NO: 85400 - DNA, 750 bp, Zea mays
  misc_feature: Ceres CLONE 1571728
  misc_feature: Encodes the peptide sequence at SEQ ID NO. 85401
  misc_feature (644)..(644): n is a, c, t, g, unknown, or other
  misc_feature (683)..(683): n is a, c, t, g, unknown, or other
  misc_feature (718)..(718): n is a, c, t, g, unknown, or other
ctccccgcggtggcggccgctctagaactagtggatcccccgggctgcaggaattcgtctcacccctagaaaaactctctctttctcactcgtcacaagctctctttcatcgcatccaccattccacttccaccccacgaggatccagcctgcctgtccctctcgccgcacgccacaaccgtagtcgctcgccggcgtatctagcctagccggggcctgggcctccgcgctcgtgctcccgggaaacaacgaccgacgcgtcctcatagtcatagaggcagctaaggcagccacgcattcgtcgctcgctcgaccggcgatggcgagaggtggcacggcgggcgcgggcgcgggcggggaggggagggcggctagcgaggcgctgacagcggactcagccgacgaggaggggcgccgcgggagcagctccagcgccagctccgacgccgcctccagcttctcctgcacgtactccccggccccgcccgacgagtggcacaaggtggccatcatcaagacctgcgtgtctgtgtcggccgacgccccgggcggcggcggcggcaaggatcagaagccgcgcggcgtcgtcgccgcggccgacaggcacggaggagcatcagagatggagatgatggaggagcggntctccaagctgctgctcggcgatgacatgtccgggagcngcaagggcgtctgcaccgcgctcggcatctcaacngcgtcacatactctgcgcgacggtggtcagcc

SEQ ID NO: 85401 - protein, 143 aa, Zea mays
  misc_feature: Ceres CLONE 1571728
  misc_feature (109)..(109): Xaa is any aa, unknown, or other
  misc_feature (122)..(122): Xaa is any aa, unknown, or other
MARGGTAGAGAGGEGRAASEALTADSADEEGRRGSSSSASSDAASSFSCTYSPAPPDEWHKVAIIKTCVSVSADAPGGGGGKDQKPRGVVAAADRHGGASEMEMMEERXSKLLLGDDMSGSXKGVCTALGISTASHTLRDGGQ

SEQ ID NO: 85402 - DNA, 763 bp, Zea mays
  misc_feature: Ceres CLONE 1571729
  misc_feature: Encodes the peptide sequence at SEQ ID NO. 85403
  misc_feature (685)..(685): n is a, c, t, g, unknown, or other
ggagctccccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagagtggcgacgtctatgctggggtgccaaaagattacactgggcgagatgtcaacgtcgacaatttcttcgctgttctgcttggcaacaaaactgctctcaggggtgggagcagcaaggttgtggacagtggccccatgatcatatatttgttttctacagtgaccatggaggtccctggcgtccntggaatgcctacgtatccataatctcttgggtgatgacctcgtagatgccctgaagaaaaaacatgcctgccggaaca

SEQ ID NO: 85403 - protein, 179 aa, Zea mays
  misc_feature: Ceres CLONE 1571729
  misc_feature (49)..(175): Pfam Name: Peptidase_C13 Pfam Description: Peptidase C13 family
  misc_feature: SWISSPROT Homolog: EC 3.4.22.34 Legumain
  misc_feature (173)..(173): Xaa is any aa, unknown, or other
MVADRLRLALLLSACLCSAWARPRLEPTIRLPSERAAADETDDDAVGTRWAVLIAGSNGYYNYRHQADICHAYQIMKKGGLKDENIVVFMYDDIAHSPENPRPGVIINHPQSGDVYAGVPKDYTGRDVNVDNFFAVLLGNKTALRGGSSKVVDSGPMIIYLFSTVTMEVPGVXGMPTYP

SEQ ID NO: 85404 - DNA, 789 bp, Zea mays
  misc_feature: Ceres CLONE 1571732
  misc_feature: Encodes the peptide sequence at SEQ ID NO. 85405
  misc_feature (674)..(674): n is a, c, t, g, unknown, or other
ccgcggtggcggccgctctagaactagtggatcccccgggctgcaggaattcgtctcacccctagaaaaagaccgcttcttcgcaaacctccccctctcccatcgacttcctccgtcgtccgtcgcactgccacggatcaccctcttccttcgtcttcctccacaaaacctacagcgctggtgcgccgaggagctagctagctagcccggccggccggccggcgccatgcctcccgtgaaggccgaggacctggttgtgcacgccgtcaaggagcagttcgccggcctcgactactgcatcaccagccccccgccatggatcacgacggtgctcgttggcttccagcactacctggtcatgctcggcaccaccgtcctcatcgccaccatcatcgtcccgctcatgggcggcggccatgccgagaaggcgatcgtgatccagaccatcctgttcctctccgggatcaacacgctgctgcaggtccacttcggcacgcggctccccgccgtgatgagcggctcctacacctacatctaccccggcgtggccatcatcctgagcccgcgatacgcgctcctcatcgaccctctcgaagagatcgtgttcacgatgaggtcgctccagggcgcgctcatcatcgccggggtcttccagggcgtcgtcgggttcttcngaataagggaaagccttttatagggtccctgaaccccccttcgggggggtccccttcgttcacgctaacggggctgggaacttcttccttcttccggttccccgggggggaccaa

SEQ ID NO: 85405 - protein, 156 aa, Zea mays
  misc_feature: Ceres CLONE 1571732
  misc_feature (150)..(150): Xaa is any aa, unknown, or other
MPPVKAEDLVVHAVKEQFAGLDYCITSPPPWITTVLVGFQHYLVMLGTTVLIATIIVPLMGGGHAEKAIVIQTILFLSGINTLLQVHFGTRLPAVMSGSYTYIYPGVAIILSPRYALLIDPLEEIVFTMRSLQGALIIAGVFQGVVGFFXIRESLL

SEQ ID NO: 85406 - DNA, 788 bp, Zea mays
  misc_feature: Ceres CLONE 1571733
  misc_feature: Encodes the peptide sequence at SEQ ID NO. 85407
acccgcggtggcggccgctctagaactagtggatcccccgggctgcaggaattcgtctcacccctagaaaaaaaaatcgccagcgagagccatgccgcctcctcccctgccctcgccgagcctgaccgactgaccccacctcgccactgttctttcccttccacctgggccccacagcgcccccttaccgtcgccaccaaatccccaaatcccggaggcacgaggagggaattcgtcgcctgaccgatcggccgatccactgccgtcggcaccccaatccgccgctgccgccatgttcaacaagatcatcaagaggggaaaccgcaagggcgcgcgcggggacaacgcggaggccgccgcgcgccccgcagcgccctcctcgtcctccgggagcagcggcggcggcgcgggggcagccgcgcccgtcaccgtcaaccacgcctcccgggccacagcgccttcgccgtcctcgcccacttcgccgcacgtggcgccgtctgcgcttgcgaccaacccggcgggggcggcgtcgccgccaactctcgaagcggtcccgctccttcgcgacgttcgcggccgcggatcgccccggccttcttcctccgcaaagctccgcatcgtcggcgccgctctttgaacctttcggaactccctcaagccccccgcggggaaaaagagggccaaacgcccagggctctccttcgaagctccctcaaattacgttgcaggcttccaagcttaagggctgggggggggggccaaagagaacccaaagggggccttcccgg

SEQ ID NO: 85407 - protein, 114 aa, Zea mays
  misc_feature: Ceres CLONE 1571733
MFNKIIKRGNRKGARGDNAEAAARPAAPSSSSGSSGGGAGAAAPVTVNHASRATAPSPSSPTSPHVAPSALATNPAGAASPPTLEAVPLLRDVRGRGSPRPSSSAKLRIVGAAL

SEQ ID NO: 85408 - DNA, 826 bp, Zea mays
  misc_feature: Ceres CLONE 1571736
caagctggagctccccgcggtggcggccgctctagaactagtggatcccccgggctgcaggaattcgtctcacccctagaaaaagcccaacgcacgaactgtaagaaaccctagcggagcaactgacacactcgcctacatcctcggccgccagctcgccaccatcgcctcccggtcggccgcgccacctcccggaagattggataacaatatcatgccattaggtggataacatttgacgtgctcctggtttgttcatttccgggcatcatcaaaatgtcaggaccgctgaattcaaacattagtggggccccctcgaaccttagagattccacaggaaggccatttacatcatcgttttctggtcaatctggatcacttccaggttttcatcactcaggttcacacaacattcatggaaatcttaatcttgcaaatatctctggatcattagcaccacgaaataattcaatggcaggcattccgtctgcaggggttcaacaacccagtggtggcatttccagtggccgtttccctccaaataatcttcaagcttccttgtctcagattcctcatgggcattctgggattagcaacagaggaggtatgaatgttggggggaaatcctggatttggtagtagcatgaatgctatttgtggtttcaatacaaggtttatcctcaaacttggctaatgtgggtaaccgcaattctgctcctgggttggcagcctctccagtcttaggaaatttaggcccaagaatagcaggttctgggaataatttgggtggggagccatatttgggaaaaggtaaaaccctgggagg

SEQ ID NO: 85409 - DNA, 813 bp, Zea mays
  misc_feature: Ceres CLONE 1571740
ctccccgcggtggcggccgctctagaactagtggatcccccgggctgcaggaattcgtctcacccctagaaaaagagctccgtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcaattttttttttactgtcaaggataagcaagtgacctctgtgtgcataccaccaccaccatacgtagcatacacaggcacagatgggagagcataaaggggacgttctcttgcacaagtatgagatgggggaaattgcttggccaaaggcactttggcaagggttaacatgctcgtaaccacgcgacttccgaaagtggccccgatcaaaggga

SEQ ID NO: 85410 - DNA, 787 bp, Zea mays
  misc_feature: Ceres CLONE 1571742
  misc_feature (623)..(623): n is a, c, t, g, unknown, or other
  misc_feature (624)..(624): n is a, c, t, g, unknown, or other
ccccgcggtggcggccgctctagaactagtggatcccccgggctgcaggaattcgtctcacccctagaaaaaagaacaaaggagccgccaagacggcaaggcgccaaggcgaccggacaggcctaggcgaagcgggcgcagctcctgccggtggtgggtagtggccctagcaataaacatcttgcccaaccggctctcgctacgcgcctacgcttcgtcaacaccggaaccgcccccaccccgccccgagcgccaattgcaccgccgctcccggccaaaccggccaagtcaacggcgcatccacttctccttaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctgccggtttcgtcgaccgctggtcaacctggccggtcggtcccgggggctcttcacctccgtgctgcctgccaccgtcgctttagtcaagtcttggccaagattttagctatctccgggtcaaaaggctttaccgattcttggatggnntgggctcttgggggcgaagaaccgggtcctgtttcctcccctgtgctccagcattgtccgtagcacaacggttccccatctccaggtgaaaggggtccggggcccctgggttttgtggccccccggaaaccgttccggaaaactaccttttggcccctgcggt

SEQ ID NO: 85411 - DNA, 814 bp, Zea mays
  misc_feature: Ceres CLONE 1571744
  misc_feature: Encodes the peptide sequence at SEQ ID NO. 85412
  misc_feature (568)..(568): n is a, c, t, g, unknown, or other
  misc_feature (588)..(588): n is a, c, t, g, unknown, or other
  misc_feature (610)..(610): n is a, c, t, g, unknown, or other
  misc_feature (626)..(626): n is a, c, t, g, unknown, or other
  misc_feature (633)..(633): n is a, c, t, g, unknown, or other
  misc_feature (700)..(700): n is a, c, t, g, unknown, or other
ctccccgcggtggcggccgctctagaactagtggatcccccgggctgcaggaattcgtctccccctagaaaaagggccagggcgcctctccctcctcccttcgtttgcgtctcaccacttatcattcatcactgctacttcgttcgagagggatacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtggcgcccgangtgggcaggggtcgtcgtcngcgacacaatgctcagcaggcngcgcagctccctcccnccgccgncgctggcggggtggtccctcgcaacgaggcgcccgccgtcgtaccgagaactgttgtggctcctgcngcgcccgaagacgagcagctggcggtggacacccgtgacttgatgcacctctgggcgctccgtcaggaaaaaggacgtgggcccgtccgggatccccatgatggaaccgcacct

SEQ ID NO: 85412 - protein, 105 aa, Zea mays
  misc_feature: Ceres CLONE 1571744
  misc_feature (48)..(48): Xaa is any aa, unknown, or other
  misc_feature (55)..(55): Xaa is any aa, unknown, or other
  misc_feature (62)..(62): Xaa is any aa, unknown, or other
  misc_feature (70)..(70): Xaa is any aa, unknown, or other
  misc_feature (92)..(92): Xaa is any aa, unknown, or other
MSALLDLLMGIFRQQTLGGAALELAALAAPLWLAALVGLLIGWAWRPXWAGVVVXDTMLSRXRSSLPPPXLAGWSLATRRPPSYRELLWLLXRPKTSSWRWTPVT

SEQ ID NO: 85413 - DNA, 816 bp, Zea mays
  misc_feature: Ceres CLONE 1571746
  misc_feature (660)..(660): n is a, c, t, g, unknown, or other
ggagctccccgcggtggcggccgctctagaactagtggatcccccgggctgcaggaattcgtctcacccctagaaaaatctactactactctcctcgattgcttgctgctgctgctactcctaggcgccaggcgccagcaccgcgaagcatctcgcctcgccgtcacctccggccaattcttctaacgcgccaactaacaacagcccagctccaaagccggagcgagggggcgcgatgtcgtcgccgacggccgcgccagcgccgaccgcgccaccggccccgccggccccctccgcgccaccgccgtcgtccccctccgtccctcccccggcgacccctgccgtgtccccgccgtcgccgtcttccaccccggcgactccctctgcgccctcgccctcctccccttcctctccggcgacgcccgccaccccgtcgccgccatctgacaccccgtcgccgccatcggacaccccttctccgccatcggacaccccgtcgccgccatcggacaccccttctccgccatcggacaccccttcgccgccgtcatccagtggagggggaaggtccccgccgtcgtccgggggtgagcgatccacgccgtcgtcccaactcgcgcccaagtcacactcggcccgggggcgaagggcggctggaanctccgggccgtccaacttcgctcgtcgtggagcgttggcgtccggggaaatctgggcggcttgctggctcccaagctttcttttggcctctggctgcccccggaaaaaagaagccgcccggggggtccgccggccgactaaaagaattacggaaat

SEQ ID NO: 85414 - DNA, 884 bp, Zea mays
  misc_feature: Ceres CLONE 1571749
  misc_feature: Encodes the peptide sequence at SEQ ID NO. 85415
  misc_feature (685)..(685): n is a, c, t, g, unknown, or other
ctccccgcggtggcggccgctctagaactagtggatcccccgggctgcaggaattcgtctcacccctagaaaaagccatcaccgacgctgactcccacaccggccgccgcgcgagccccggcaccatctccgcacgagcagaaatgggggatgcgtgtttctcaacacagctaattgatggagatggggtcttcaacgtctctggattggagaacttcatgaaggatgccagattgggtgaatgcgggctctcctatgctgttgtatcaataatgggcccgcaaagtagtgggaaaagtacacttttgaatcatctttttggcacctattctagggagatggacgccttcagaggaaggtcacagactaccaaaagtatatggctgagcgaaggcccagaatattgaaccgtgcaccccttgttatggatttgcgaaggaactgatccgaatggagaaggggagagggatgacaccagcttttggagaaagcaaaggggcattggttttgcctttggggccggtttcacaaactttggtggggaattaaaaaatggtgggggggtcatgaaccctttgggtaagaagaaaccggggcctgccaaaacccacccccgtccttttttgaaaaaaactggggttttccccaaggttgcatgcaaaaggaaggggtttgttttcacagntccccccccggaaaaaaaaaaaacatattggggtcggtaattgggaacatttccccgggggacgggaatataaaagggagaaccccccccccaaggaaaaaaaaattctggggaaaaccaaaatttctttttagggggagaaaaaatatttttgccaatatcacaattgtgggggaaatcattatatttccacaaaaaa

SEQ ID NO: 85415 - protein, 87 aa, Zea mays
  misc_feature: Ceres CLONE 1571749
MGDACFSTQLIDGDGVFNVSGLENFMKDARLGECGLSYAVVSIMGPQSSGKSTLLNHLFGTYSREMDAFRGRSQTTKSIWLSEGPEY

SEQ ID NO: 85416 - DNA, 881 bp, Zea mays
  misc_feature: Ceres CLONE 1571750
  misc_feature: Encodes the peptide sequence at SEQ ID NO. 85417
ctccccgcggtggcggccgctctagaactagtggatcccccgggctgcaggaattcgtctcacccctagaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatccgcgtcttctctccgtctgaattcaactcgtcggctacatgtcccaacccatggccagcagaaggaaccctattctctgcccagcacccctcaaagtttccggttcgccaacctactcctgcaaactacatcttcctgggggcaaggggcgcccattcccggcctgcgggtctcttcaaaccaagggccccggactttctcccttgcgcccttctttagcggggggggccctccgacaacccccggggggttgaatcgcgggtggggccggacccccttatcgggtgcgcgaaaaccccgcgagggggcccccgggttcccccgccccctcgaggcctgggtgccttggctccgtgtgtgtgtgtgaggggacaccgcggccccccgggcttgccccccctgtattagggtggcccctttcgcggaaggtggggggcccccgctcccgccggcggggggggcccgcgaaacaaatcgtcagtgcggccctgtgt

SEQ ID NO: 85417 - protein, 153 aa, Zea mays
  misc_feature: Ceres CLONE 1571750
MAVALLAALVASAAMLAGTASASPAEGIQPLSKIAVHRATVEMQPSAYVRATPSLLGEQGEDTEWVTVKFGWKEPSEDDWIRVFSPSEFNSSATCPNPWPAEGTLFSAQHPSKFPVRQPTPANYIFLGARGAHSRPAGLFKPRAPDFLPCALL

SEQ ID NO: 85418 - DNA, 787 bp, Zea mays
  misc_feature: Ceres CLONE 1571752
  misc_feature: Encodes the peptide sequence at SEQ ID NO. 85419
ctccccgcggtggcggccgctctagaactagtggatcccccgggctgcaggaattcgtctcacccctagaaaaactctcgaaaccctagtcccctgctccattctcagccgccgcctatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggctcttatcaagatgcgtgagattgctgaagcttaccttggtagcacgatcaagtgtgctgtggtcacagtccctgcctacttcagtgactcacagaggcacgccacaaaagatgctgggggtgattgctggcccttaatgtgctgcgtatcatcaacgagccaacagctgcagctatcgcctatggtcgtgacaagaggctaccagtgtcggggagaagaatgccctcatctttgatcctgggaggtggc

SEQ ID NO: 85419 - protein, 204 aa, Zea mays
  misc_feature: Ceres CLONE 1571752
  misc_feature (9)..(205): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMALIKMREIAEAYLGSTIKCAVVTVPAYFSDSQRHATKDAGGDCWPLMCCVSSTSQQLQLSPMVVTRGYQCRGEECPHL

SEQ ID NO: 85420 - DNA, 740 bp, Zea mays
  misc_feature: Ceres CLONE 1571753
  misc_feature: Encodes the peptide sequence at SEQ ID NO. 85421
ctccccgcggtggcggccgctctagaactagtggatcccccgggctgcaggaattcgtctcacccctagaaaaaatgctgtgcgggcgcggcacggcagcgacggcgacatctgcatctgcatctcccacctcgtctccctcccgcatctgccctgcctcgatcccgccgccagccatctaaaggagccgggagccatgtctccctccggcgagctgctggcgtccatctcctccgctctcgccgtggccttcttcttcctctcctgcgtcgagctcggcgacaccgccgccaccgtcagcgtcttccggctcatcctggactacctcgccggcgccccgctcagatcccgcgccgcggtcctcaatcaccacgccgcggtgctcccgctccctgccggcgcagacctctcccgatccggcctcgtagcgccgctcctcgaccttccgctctccttcctcagagagtacgtggtggagaaaaaaacagctggggggattgctcatcttgctcccgacatacacagtgataaggatagtgctgatgacaaaggtcagagctaatgtgtactgactgagctggagaagttgcttgtgcaccaacaagtcccatatccagtgtactctgctgtggatgacaacaattgtgaggacctgctggcagatatcataaaattgcctcttcaggcacatcagcctctgctagcacagcagttactaaactgaggtgtcccccgcagat

SEQ ID NO: 85421 - protein, 121 aa, Zea mays
  misc_feature: Ceres CLONE 1571753
MSPSGELLASISSALAVAFFFLSCVELGDTAATVSVFRLILDYLAGAPLRSRAAVLNHHAAVLPLPAGADLSRSGLVAPLLDLPLSFLREYVVEKKTAGGIAHLAPDIHSDKDSADDKGQS

SEQ ID NO: 85422 - DNA, 851 bp, Zea mays
  misc_feature: Ceres CLONE 1571754
  misc_feature: Encodes the peptide sequence at SEQ ID NO. 85423
ctggagctcaccgcggtggcggccgctctagaactagtggatcccccgggctgcaggaattcgtctcacccctagaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgacgacgtcggccttgcccccggcggggaccccttcgtggcgtggcacgagtgcgccttccccgtctgccgggactgctacgaatacgagcggccgggagggcacgcagaactgccccccagtgcaagactcgattacagcgcctcaaggggctgcccagcggggtgaccgggggaccaaggaggaagaacggcgtccaatgaacctggaaaaaccaagttcaacttgggaacgggccctgaactccccagttctgggggcccgaatcccatgggtctttgggggcccatttaaaccttaccggcccctgggaaaggtgaaccccttaagggggggggccccacaaagagtttttccagggctctaaaccccccaaaggggtcccaccctccccccccccaaaaagggggccagaaagtgggggggaatagaaacatcccccccccgggggagaac

SEQ ID NO: 85423 - protein, 98 aa, Zea mays
  misc_feature: Ceres CLONE 1571754
  misc_feature: SWISSPROT Homolog: EC 2.4.1.12 Cellulose synthase (UDP-forming)
MEASAGLVAGSHNRNELVVIRRDGDPGPKPPREQNGQVCQICGDDVGLAPGGDPFVAWHECAFPVCRDCYEYERPGGHAELPPSARLDYSASRGCPAG

SEQ ID NO: 85424 - DNA, 1053 bp, Zea mays
  misc_feature: Ceres CLONE 1571755
  misc_feature: Encodes the peptide sequence at SEQ ID NO. 85425
  misc_feature (1)..(1): n is a, c, t, g, unknown, or other
  misc_feature (58)..(58): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (725)..(725): n is a, c, t, g, unknown, or other
  misc_feature (753)..(753): n is a, c, t, g, unknown, or other
ngggggggggggggggggtaaacaacaaaaacaaaaaaaaacccaaaaagaaaaattngttctcggnnnggaaaactggaactccccgcggtggcggccgctctagactagtggatcccccgggctgcatgaattcgtctcacccctagaaaaactgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccggactactacatcaaccttcctgcgctcacgtcacgccgggaaacggcaccaaggaccaggatccggcctggctcaaagcgccttcaaacgttgggcgaaggaactgcccccggtccttcgaaacagccctcctacagcctttcttgcccaaaaacctaatgtccggggggggccctaccgattccggacgggggggcccgtttcaaaaggcctccaaaccccnacccggggccaaacggatcaattccggncatatatcaaaaccatgggggtaccggggagggaggcccttgtggaaccccacgggccccaaagtaaaaattggcccaaaggacggtttccggggggcttctctgggctcatcgcgtcaaaaacagaaaatttcgtggtggtctcggcccactataacttcagagaccgtggctctcagacgtctttccctcgaagagagaaaggtccctggttaatggggcacaaaattcgatattttcccccccccttgtgcccaaatgtaaaattggaaaagaaaggttctttttttaataacaaag

SEQ ID NO: 85425 - protein, 238 aa, Zea mays
  misc_feature: Ceres CLONE 1571755
  misc_feature (158)..(158): Xaa is any aa, unknown, or other
MDPSSAGSGGNSLPSVGPDGQKRRVCYFYDPDVGNYYYGQGHPMKPHRIRMTHSLLARYGLLNQMQVYRPNPARDRDLCRFHAGLLHQPSCAHVTPGNGTKDQDPAWLKAPSNVGRRNCPRSFETALLQPFLPKNLMSGGGPTDSGRGGPFQKASKPXPGAKRINSGHISKPWGYRGGRPLWNPTGPKVKIGPKDGFRGASLGSSRQKQKISWWSRPTITSETVALRRLSLEERKVPG

SEQ ID NO: 85426 - DNA, 794 bp, Zea mays
  misc_feature: Ceres CLONE 1571757
  misc_feature: Encodes the peptide sequence at SEQ ID NO. 85427
  misc_feature (573)..(573): n is a, c, t, g, unknown, or other
  misc_feature (574)..(574): n is a, c, t, g, unknown, or other
ccgcggtggcggccgctctagaactagtggatcccccgggctgcaggaattcgtctcacccctagaaaaaggacagctccagactccagagccgcctcttcgccctctcgccatcggcaggctacggtggctgcttccccgagcctgcaggtagaccaccttgtgttgattcctcgagtcttcacctggtgcttccgtttgcagcttcatttttaactaagatgtcacaagccaaggaagtgaggtacactgcacggtctattacacctcctgctgatagaaatggcacttcaaggtcgcctcctccaaagagacgcagcccttcaaggtcacctccacctaagagtgcttcacggtccccacgtccaaggagtccaaagagacgcagcacttcaaggtctcctcctaggagacgtggtagatcaaggtcaagggataggagtcggtccaggagcccagatgatagaaatccagggaataacctttatgtaactggattgtctactcgtgtaaacggaagatgatcttgagaagtctttagtaaagaaggaaagggttagaactgtcatgttnngtctgatcctaggacaaaagaatcccgtggctttgccctcgtgactatggatacctcttgaggtgcaagacgctccctcaagtatctgcaccgcactgtactttgaggtcgcctggcacctgtagagaggtttaacatggtgctgggctgcctctacgtccacctggttgggtcaagctgtgcagtctccaaccatggttgtctccaaagatgtgcagct

SEQ ID NO: 85427 - protein, 100 aa, Zea mays
  misc_feature: Ceres CLONE 1571757
MSQAKEVRYTARSITPPADRNGTSRSPPPKRRSPSRSPPPKSASRSPRPRSPKRRSTSRSPPRRRGRSRSRDRSRSRSPDDRNPGNNLYVTGLSTRVNGR

SEQ ID NO: 85428 - DNA, 866 bp, Zea mays
  misc_feature: Ceres CLONE 1571762
  misc_feature (866)..(866): n is a, c, t, g, unknown, or other
acccgcggtggcggccgctctagaactagtggatcccccgggctgcaggaattcgtctcacccctagaaaaacaactcactctacagcaacgaggatatcttcctgagggagctcatatctaatgcctctgatgcgttggataagattaggttcctttctcttactgataaggaagttctaggtgaaggggacactgcaaagcttgagattcagattaagttggacaaagagaagaaaatcctctccattcgggataggggtattggtatgaccaacgaagatcttattcagaaccttggaacgattgctaaatctggcacttcagcttttgtggaaaagatgcagtctggaggtgacctcaatcttattggacagttcggtgttgacttctaccccatatacttgcttgctcaccatcttcaaatggtcagccagcagatcgataataaacagtatcttttgggaatcaaaagctgatggatcgtttgacctcttccaaggatacataggaatgggccccttggcccggggaactgaaattaggattgcccccggccaaaatgaaggcccaaggagtacttggaaagaagaataaagctcaaaggatttgtggtaaaaaaaagtaccctatatttttttaaactttccccttttttttttttgggggcctggcccaaagaagggttgttatgtttaaaactctgccccacttgttttaaggggttccacccaacaccttaaaaaaaaagaaaaaattggggagtctcctcccataaccctctccgggttgggataagagaacctctaggggaataaccccacataacagggtgttccaaaatatttgtggaaaaaaacagccccn

SEQ ID NO: 85429 - DNA, 787 bp, Zea mays
  misc_feature: Ceres CLONE 1571763
  misc_feature: Encodes the peptide sequence at SEQ ID NO. 85430
  misc_feature (744)..(744): n is a, c, t, g, unknown, or other
  misc_feature (771)..(771): n is a, c, t, g, unknown, or other
ctccccgcggtggcggccgctctagaactagtggatcccccgggctgcaggaattcgtctcacccctagaaaaaaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatatcttgctgaattcattcctgtactgtaatctcttgcacggagcacacacctgtagatctgtattctctgtacgtgatcgctcaaattgcaaaggtccgtctctccgatcccttctctgataaaatcgaagagaattcttgcagccggccaccttcccaagaacaatggcatcaagtggcgcgggtactctggcctgtcagacggctccgacgccaatgacgtcaagggtggcctcgtcggcggctactacgacgctggcgacnacatcaagttccacttcccgatggccntctccatgacgctgct

SEQ ID NO: 85430 - protein, 135 aa, Zea mays
  misc_feature: Ceres CLONE 1571763
  misc_feature: SWISSPROT Homolog: EC 3.2.1.4 Cellulase
MYSANHWGGSFEIADGAAEDDHSRNMDLDRGALSARQHHELDETQQSWLLGPPEAKKKDKYVDLGCVVVKRKLLWWALWCVVAAFVLIGLPIIIAKSIPHKKPGPPPPDQYTEALHKALLFFNAQKYLAEFIPVL

SEQ ID NO: 85431 - DNA, 923 bp, Zea mays
  misc_feature: Ceres CLONE 1571765
  misc_feature: Encodes the peptide sequence at SEQ ID NO. 85432
ccttctcttattttgttttttgctgagtaaataaaattgtaacctaactttgatctctttggcgcccccccaaaagatgtgaaaactggagctccccgcggtggcggccgctctagaactagtggatcccccgggctgcaggaattcgtctcacccctagaaaaagtctcctcaccgcgcgctctctaccgcttgtccgtttcttcctcttccgaggtagcaacgtggtgagtgaggcagccgctgctgtgctgcactgctgctgcggaggcccaagccgaccggcggagagcacccgtccttgggcggcggagggtggaagaataaagccaggcttgcggatgccggggtgcgtagtaacggggagaggtggggtgggggtatccagcagcagcgccgagctcgtcgccgggcccacaaacgcgtctaccaagcccttcacggcgctctacttcccgcaactgctcgaccacttcaccttcacccccaacacgtccacagtcttccgccacaagtacctcctcaactacaccttctggcgccagccctgcgccggcgccggcgactacggccccggcccgctgttcgtgtacacgggacaacgagggcgacatcgaagtggttcgccaccaacaccggggatcaaggtttcgacaatcaccgcccaccgttcgggcgcccttccctgagcattcattcgaggcaccgggtttctaacgggggaagtcgtaagcccgtatcggaaaaccgacctccgttcaaggtccgggcccaaaaaacccttgggaactaacctgcacggctccaacgtcaagggactgctgtggccggatacttttcctcctgtgccattatatctagaggggggcccttgcaaatgcgagaggaaccccccctgggcaccccctaaagggtcccgacct

SEQ ID NO: 85432 - protein, 115 aa, Zea mays
  misc_feature: Ceres CLONE 1571765
  misc_feature: SWISSPROT Homolog: EC 3.4.14.2 Dipeptidyl-peptidase II
MPGCVVTGRGGVGVSSSSAELVAGPTNASTKPFTALYFPQLLDHFTFTPNTSTVFRHKYLLNYTFWRQPCAGAGDYGPGPLFVYTGQRGRHRSGSPPTPGIKVSTITAHRSGALP

SEQ ID NO: 85433 - DNA, 842 bp, Zea mays
  misc_feature: Ceres CLONE 1571768
  misc_feature: Encodes the peptide sequence at SEQ ID NO. 85434
ctccccgcggtggcggccgctctagaactagtggatcccccgggctgcaggaattcgtctcacccctagaaaaagacgacgacgtacgccggccgtaagtgagccgagagcccccgatataccagctagctagataaccagccagcgcgagcatggaggcggcggcggcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggcgccggacctccgcggctacggcggcaccgccgcgccgcccgacgtcgcgtcctactccgccttccacgtcgtcggcgacgtcgtcgccctgctcgacgcgatcggcatccacaacaaggtgttcgtggtgggtcacgactggggcgccatcatcgcgtggtacctctgcctgttccggccggaccgggtgccggcgcttgtcaacaccagcgtcgccctcatgcgccacatcttcgttcggggccgccgccgccggcgttaagcccattgacttatttccacccgcacttagggggcccccctactacattctgccggtttccaaaaaaaaaaatttgtcgtccggcccgggccgggcccccgggaaaaaaaccgattggatccgggccctctggaacggggccaaacaaccccgttggggggttgtccccccctttgaaaacccacccagggggcgcccggtttgggggaaacctatccttgggaccccaaagag

SEQ ID NO: 85434 - protein, 151 aa, Zea mays
  misc_feature: Ceres CLONE 1571768
  misc_feature: SWISSPROT Homolog: EC 3.3.2.10 Soluble epoxide hydrolase
MEAAAAAVRHRTVEANGISMHVAESGPDGGDGAPAVVFLHGFPELWYSWRHQMAHLAARGYRCVAPDLRGYGGTAAPPDVASYSAFHVVGDVVALLDAIGIHNKVFVVGHDWGAIIAWYLCLFRPDRVPALVNTSVALMRHIFVRGRRRRR

SEQ ID NO: 85435 - DNA, 772 bp, Zea mays
  misc_feature: Ceres CLONE 1571769
  misc_feature: Translation starting site: 503
  misc_feature (622)..(622): n is a, c, t, g, unknown, or other
  misc_feature (754)..(754): n is a, c, t, g, unknown, or other
ctccccgcggtggcggccgctctagaactagtggatcccccgggctgcaggaattcgtctcacccctagaaaaaaccccattctccctcttcctccagagtccagacggcgtgcttccgcctgccgccgccggcgagctgcttgcccgcagcatgactccgcatcctggccgcctcgtcctacctccggcggctccttctccctgaaccccgccgcgcgccaggccccacgcctccttccgcagtcacacgagcacgcgggcgtcctctgccgcaccgcgccgcctccagacgcctcgctcgtcaggccactccacctccgcctgcgaacgtccggcccggctccggcgagttcctccgcaattccggatctgctggagcgccagcaaggcggcctctccaactctccggagtccggaacagcaagggttctgatctcccatgccacagttttataacgttgaaggattcaaaaatctacagaactagatgatacttgcataatgcagccctcagatatttggaaggcgcatgctggttcatcacagtcagagggttcgggtctggatatggagaggaacggatgcaatcataattattgtccatctcctctccaacaattngctcagctggtcagcactctgaaagcagcgctgcatacttttcttggcctacatctactctaatgcacaggtcagctgaaggccgtgctaattactttgggatcctacagaagggtgtacttaccagacatnctggtcgctggccaaagg

SEQ ID NO: 85436 - DNA, 887 bp, Zea mays
  misc_feature: Ceres CLONE 1571770
  misc_feature: Encodes the peptide sequence at SEQ ID NO. 85437
ctccccgcggtggcggccgctctagaactagtggatcccccgggctgcaggaattcgtctcacccctagaaaaaataatcagtgctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcaacggtgctgtacctgacgctccagccgcgcgcggggtacctggggggactacgcgtggcttccgcaccaacccccaatggccgcgtcccgtttcgcgaacgttccttggagcaactccccccttgtggggcggggctttcaacaaaaagccaacgtcccgggtgtaattaacccccccccgccttggaaacccggtccgggggcctggtggggaaagaaaaaacattgcccttgcccagatatgcgtcaaaaacttttaattccccgccttgtcaagcgcgaacactggaagttccctccccaccccccaaggagccaaaacatcgcgtattcttttctctgggcgattgaaaaaaaaccgtcgtgggcgcatagaaagggggtgggtcgccccccaggaaaaatgataaaaccctgggggggggaaagacgacgcctggtttgcaggcagaatagaatttgtttttgagaaaaaatgttatagatccccgggacgggaggc

SEQ ID NO: 85437 - protein, 123 aa, Zea mays
  misc_feature: Ceres CLONE 1571770
MGSSAQLRRLKPLYQLVVNNILTIVAVPLAAAVLLKAAELGPEEILARARALRPAHMLLAGFLPAVATVLYLTLQPRAGYLGGLRVASAPTPNGRVPFRERSLEQLPPCGAGLSTKSQRPGCN

SEQ ID NO: 85438 - DNA, 843 bp, Zea mays
  misc_feature: Ceres CLONE 1571774
  misc_feature: Encodes the peptide sequence at SEQ ID NO. 85439
acccgcggtggcggccgctctagaactagtggatcccccgggctgcaggaattcgtctcacccctagaaaaaaaccctactctgccttgtcttctcccatcattcccaagcgtgagcaaaaccccaccaccgaagactgcccgccgccgacgcccgcctccatcctctcctccagttcctcctagcgccgccgcccgactccctcctccagcgccggcgcccaaatccctcctccagtgccgtcgccgactctccgcccgcgtccatcctccggttccagcttacattggtccatcctctcctctgccccctcctccatccttcatcagattcagacggtgaagcacccagtcccagttcaggttcaaacagacgctccgcacgagctggagatggaggtggaggtggccaaatattcacggggggcagggtgctgacctgaaagcgctgggggacaagaagttgaaagggcagctcagtgtaaaagagaagctatatggccaatctggaaaagctgctggaaatgccgaaaagtgggctatgcctaatgatggaggtatttttagagcctggccatttggaggaaaacataaggattttcccaagaggatattattgacagaggggggatcttttggagttccagaaaaaccattttgaaatggaccttacccgggaccccgggccccttttaattatggggaaaccccttcaaaaggggccgcctttaatggtcttgtagggggggaccaaaaaaggccacccctggccaaggagggggaattgggtggggatattgggatcctttattcaaaggggagttttggagggggggggggggaa

SEQ ID NO: 85439 - protein, 39 aa, Zea mays
  misc_feature: Ceres CLONE 1571774
MPNDGGIFRAWPFGGKHKDFPKRILLTEGGSFGVPEKPF

SEQ ID NO: 85440 - DNA, 758 bp, Zea mays
  misc_feature: Ceres CLONE 1571777
ctggagctcaccgcggtggcggccgctctagaactagtggatcccccgggctgcaggaattcgtctcacccctagaaaaaaccagagcagaggccgccacaccctcacgtcccttcccggcttccccacccctcctcctcctcctcctccgcttccctcgcgcggcgcggaacaagtccaaggggacggcaggaaggaagaggaggcttccagattcttgcggaactcccgcgccacccctctccacgccaccaccaccgccttctcctcatagccagccagcctcccgcgtagggtttccgcgcgccaccatctccactccaaccccagcacccacccgtcctaccgccgtcgcatttggacctctgcgtctgcctgcagccctgttcgccaatcgccaccgacaccccctcgtcgtaccggtttggggatttcgttttccctttctcactgttgccggttgtatcggggatctgggagggaagtgtttgtcttggtgctgattgtttctgacgatttgggcgtcattatccaggtcgagtggtgttggtgatgtcgggtgattagattggggggcgggaatgtggttaaggggaaaaccgtttaattggtgtttggggcgaacgaggtcatcggggtgttgggatggagcgtccacggaccagaaaagggcccgtgcacagggtgggagctccctcgagatcgtggtctttttgaatccgtgggcgcggacctcgctaagatggagggatcgccgc

SEQ ID NO: 85441 - DNA, 765 bp, Zea mays
  misc_feature: Ceres CLONE 1571778
  misc_feature: Encodes the peptide sequence at SEQ ID NO. 85442
  misc_feature (543)..(543): n is a, c, t, g, unknown, or other
ctccccgcggtggcggccgctctagaactagtggatcccccgggctgcaggaattcgtctcacccctagaaaaactctctctttctcactcgtcacaagctctctttcatcgcatccaccattccacttccaccccacgaggatccagcctgcctgtccctctcgccgcacgccacaaccgtagtcgctcgccggcgtatctagcctagccggggcctgggcctccgcgctcgtgctcccgggaaacaacgaccgacgcgtcctcatagtcatagaggcagctaaggcagccacgcattcgtcgctcgctcgaccggcgatggcgagaggtggcacggcgggcgcgggcgcgggcggggaggggagggcggctagcgaggcgctgacggcggactcagccgacgaggaggggcgccgcgggagcagctccagcgccagctccgacgccgcctccagcttctcctgcacgtactccccggcccccgcccgacgagtggcacaaggtggccatcatcaagacctgcgtgtctgtgtcggccgacnccgcgggcggcggcggcggcaaagaccagaagccgcgcggcgtcgtcgcccgcgccgacaggcacggagagcatcaaagatgaagatgatgaaagagccggtctccaacctgctgctccgcaaggacatgtccgggaacgggcaagggcgtctggaccggggctcgccattttcaaagccgttcaccaaactctgggcgaacgggggttccgcccagctctg

SEQ ID NO: 85442 - protein, 47 aa, Zea mays
  misc_feature: Ceres CLONE 1571778
MKMMKEPVSNLLLRKDMSGNGQGRLDRGSPFSKPFTKLWANGGSAQL

SEQ ID NO: 85443 - DNA, 762 bp, Zea mays
  misc_feature: Ceres CLONE 1571779
  misc_feature: Encodes the peptide sequence at SEQ ID NO. 85444
  misc_feature (762)..(762): n is a, c, t, g, unknown, or other
ctccccgcggtggcggccgctctagaactagtggatcccccgggctgcaggaattcgtctcacccctagaaaaagtgccagcagagacgaccggccccggccccgcccccgccgcagctgcccgaagccgccaaacaccaccagtcccccaccacatccgccagaaccctctccctccctccctccctccctccctcactcatcggcgcgccgccaatggccgtgtggtgaagcgcacccgacggaagaagcaggcaccaacagccaagccccctttgccctcgccctcgccgccgccgtccgcggaaggttgagatcccaggattcagactggtgccattcgatttgatttggcgcggggtactttcctatggccgcctccatcgcggcctcgcccttctttccagggtcgccggcgccggccgctcctaagaacggccttggggagcgcccagagagcctggacgtccgcggcgttgcggcgaagccgggagcctcgtctaatgccgtgagggcgggcaagacgcgcgcccacgctgccgtccccaaggtgaacggtggcaagtctgcggtggcggatgtggagcacgagaccataactgtacccttcgtcgggtgccgaggaactttctacaaaccagcttccccgactgggagcatggctcctggctggccatcacaaaccatctttcttgggcccgcggaaaagccagtggacgaatgctttgaactgggaagcccaaggccggcctggaacatgcn

SEQ ID NO: 85444 - protein, 130 aa, Zea mays
  misc_feature: Ceres CLONE 1571779
MAASIAASPFFPGSPAPAAPKNGLGERPESLDVRGVAAKPGASSNAVRAGKTRAHAAVPKVNGGKSAVADVEHETITVPFVGCRGTFYKPASPTGSMAPGWPSQTIFLGPAEKPVDECFELGSPRPAWNM

SEQ ID NO: 85445 - DNA, 785 bp, Zea mays
  misc_feature: Ceres CLONE 1571780
  misc_feature: Encodes the peptide sequence at SEQ ID NO. 85446
ctccccgcggtggcggccgctctagaactagtggatcccccgggctgcaggaattcgtctcacccctagaaaaagcagtttactagttgtacacccataatgacccattctaccgtcatatacatacaccgttggcacgccatctaatcagcgaagaggagacgacgactgctctgcctttcttccctacaggaacaggacgaatcaatcaatcattcccctctgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggcaggaagcgcctatcattattcgtacatctgcgttggcgaaagagttgcatggttgattggctggggcttgatacttgatacacgattggtggatcagcccgtgcccgtgggatttctccctatctagccttatttttgggaggacaggatagtcctgcatgggatttagcacgacatgagatcccatggctggatggtcgttgtagatcctttgggcttctttcctcgttttc

SEQ ID NO: 85446 - protein, 135 aa, Zea mays
  misc_feature: Ceres CLONE 1571780
MGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGERVAWLIGWGLILDTRLVDQPVPVGFLPI

SEQ ID NO: 85447 - DNA, 758 bp, Zea mays
  misc_feature: Ceres CLONE 1571781
  misc_feature: Encodes the peptide sequence at SEQ ID NO. 85448
  misc_feature (588)..(588): n is a, c, t, g, unknown, or other
ccccgcggtggcggccgctctagaactagtggatcccccgggctgcaggaattcgtctcacccctagaaaaatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattagcaaggagattgttgacctgtgccttgatcgcatcaggaagcttgccgacaactgcactggtctccagggcttcctcgtnctcaacgctgttgggtggaggaaacggctctggccttgggttcctccctctagagcgccggtctggtgactacggcaagaaatccaagcctggggttcactgtgtacccttcccccaaagttctacttcgggtagtgagccatacaacagggtactgtccacccactccc

SEQ ID NO: 85448 - protein, 159 aa, Zea mays
  misc_feature: Ceres CLONE 1571781
  misc_feature (49)..(158): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTISKEIVDLCLDRIRKLADNCTGLQGFLVLNAVGWRKRLWPWVPPSRAPVW

SEQ ID NO: 85449 - DNA, 839 bp, Zea mays
  misc_feature: Ceres CLONE 1571784
  misc_feature: Encodes the peptide sequence at SEQ ID NO. 85450
ggagctcaccgcggtggcggccgctctagaactagtggatcccccgggctgcaggaattcgtctcacccctagaaaaagtccagccctccgtttatagatagccagcgagcgagcgagcgagctgagctgagctctagtgatagactggtaggtcctagctgcgcgcacgtgcactaggagggagccatactgcgcgcgcggcattccgtccatcgtcggtcgattggtatggcgggtcgtcggggcgactcggcgcctgcggcgccgttgctggagaacaaggcggcgccggcgtcggaggcggaggcgggcggcgggtaccaccaccacaactactactactacgtggacgggtgccccgggtgcgccgtggaccggcgcaaggcggcgagcccgggcatcccctacgccaacttcatctacgtctggatcgtcaccctctgcacagccctacccatctcatcgctgttccccttcttgtatttcatgataagggacctgaacgtcgctgaaagaaccgaagacatcggcttctacgccggcttcgtaggtgcctcgttcatgttcggtagatgcttgacttcaaccgcctggggaatagcggcggaccgcatcgggaggaaaaactgtcgtcgggttcggcatctcctctggggccgtgttcaacccgctgtttggccggagcgtcaactactgggatggcatcccccacacggttcctggtttggggctttgaacggcttgcttgaaccaaaaaaaggcttatgccattcaaaatctgccggcccggaaacattaaacctttagcgctattccctgtttacaccccggcagtggg

SEQ ID NO: 85450 - protein, 192 aa, Zea mays
  misc_feature: Ceres CLONE 1571784
MAGRRGDSAPAAPLLENKAAPASEAEAGGGYHHHNYYYYVDGCPGCAVDRRKAASPGIPYANFIYVWIVTLCTALPISSLFPFLYFMIRDLNVAERTEDIGFYAGFVGASFMFGRCLTSTAWGIAADRIGRKNCRRVRHLLWGRVQPAVWPERQLLGWHPPHGSWFGALNGLLEPKKGLCHSKSAGPETLNL

SEQ ID NO: 85451 - DNA, 858 bp, Zea mays
  misc_feature: Ceres CLONE 1571785
  misc_feature: Encodes the peptide sequence at SEQ ID NO. 85452
  misc_feature (660)..(660): n is a, c, t, g, unknown, or other
  misc_feature (661)..(661): n is a, c, t, g, unknown, or other
  misc_feature (828)..(828): n is a, c, t, g, unknown, or other
  misc_feature (856)..(856): n is a, c, t, g, unknown, or other
ctccccgcggtggcggccgctctagaactagtggatcccccgggctgcaggaattcgtctcacccctagaaaaaatcctcagtcctcatccgccactcagtcgaacgcccctgcgcacgctccagctgctatgctcctccgcccgcgcccctccttcttccgagccgtcgtgccgccgccgctcacccgtgcctgtgtcccctcccgtcgcacgctttcagcttctgcagaggcgggaacagcctcccccaaagatgcagcgtcagcgccggttccggcggccacgcgcaagaaccccaggaaggccgggtcgccacctatggggatcgtgaagacggcgctgtttctgccacccggggtggagcgggatgccttggtgcccgcggacatggtcctaccggggtcgaacatcgtggatcgtccctacacacggcacaccagggtgaagggtgctgagttcttcaagagcagcgcgcgcgcacgggactgcccccatgacgaccgggcccgagggtcgccctccctttgggcggtcccaaaggttgggcagggcccctcccttttttaagagggcccttctcccccccgccccaaaggggaaaaaaccccccccctcttttttttaagaaagaaggcgggggggggtttttcccccgagannacaccgatttgttttgggggcgctttttatttttttgaggagggacccctcccaaaagaagagagacgcgacgcgggggcccccccctgggagttttttctcatcaaagtgtcgctcgcccccccccctttttcccccccggggatattagaaaagagggggtgtgngtgttcttggtgggaagcaccacgtctncg

SEQ ID NO: 85452 - protein, 145 aa, Zea mays
  misc_feature: Ceres CLONE 1571785
MLLRPRPSFFRAVVPPPLTRACVPSRRTLSASAEAGTASPKDAASAPVPAATRKNPRKAGSPPMGIVKTALFLPPGVERDALVPADMVLPGSNIVDRPYTRHTRVKGAEFFKSSARARDCPHDDRARGSPSLWAVPKVGQGPSLF

SEQ ID NO: 85453 - DNA, 809 bp, Zea mays
  misc_feature: Ceres CLONE 1571786
  misc_feature: Encodes the peptide sequence at SEQ ID NO. 85454
  misc_feature (654)..(654): n is a, c, t, g, unknown, or other
ctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgcgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcacctacgaacacgtntttctctcccgcccgggctccctggtgtccgacatcatcatgtacggcgcccaccgactcgtgcttcgcgccctacgggcgacaactttcgcaagggggcgaaggctgttcaccgtgcacctgctcaacgccagcaaaggtgcggtcccagcgct

SEQ ID NO: 85454 - protein, 187 aa, Zea mays
  misc_feature: Ceres CLONE 1571786
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYEHVFLSRPGSLVSDIIMYGAHRLVLRALRATTFARGRRLFTVHLLNASKGAVPA

SEQ ID NO: 85455 - DNA, 1263 bp, Zea mays
  misc_feature: Ceres CLONE 1571788
  misc_feature: Encodes the peptide sequence at SEQ ID NO. 85456
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (67)..(67): n is a, c, t, g, unknown, or other
  misc_feature (908)..(908): n is a, c, t, g, unknown, or other
nnnttttnttttcccccccacccccccatcgaccccgcccctcccgctccgtcccggtatttatttntattaaaatggaactccccgcggtggcggccgctctagaactagtggatcccccgggctgcaggaatgcgtctcacccctagaaaaaccccagtgccactgtctcgtcggctcgtcgctccgtagaccccgcgcctccgcctccccgccactcgccggaggctgccgccatcgttatgccatggccgtcatcctctcctccgcggcgccaacgatactgactcgtcccacgcgccctcggaggcagccgaggagcggcctccgcgggggcctcgcgcgcctctcagctgcgctcggcctcgcgcacgcgggcgccggcgccggcgccgcactcgccgcgccgctctcctacgaggagatgctgcgcctctcgtccgactccggcggtgatgttgggcggggttcgcgctcccggagcttggcctccgacgggctcgttagactttcgtcaacgaaaaacccctccttcgtcattcccgggcagggggtccccggcccttcgggagtggccgcctttccttccctttagcgcaagactttcctcccggcaggaatgggcggccatgtttcccaaagctcccctaacttcccggtcccttggttccgggctcaaagaggcgcgggcgcttatcacaaggccggggcttgtcgctcccggagggggaaaacacctcataaccccacgcccgaaatccctatagtcgtgaaaaacagctcacaatcgggcccccgctctctcctcacagggggtaatttgctacatcctagaaaagaaaagggagttccgtgggggtataacgctcgccaccgtggagaacacgcctcaaaacaggggaaagagnggcttctataaagaagagataagaaagaggtgcctctgcgtttggacgcgaggtatacaccctctcttataaaagagagggggagggcgggatgggaacaactataagataaagcgaggtgtattttcctgtggcaaaataacaaaattgtctcgaacccgcactgttatagggtttgctcgtgagcgggcccccccgcgaaaaataaacaaaccgccacccactcgcgatatttccctctccttgggccccacaataattttgtaatatgcggagaaaacgttcgcgacaaacagtgagtaggcgcgggaagcttttttagtggaaaagacccaagagggggctgtaacctagg

SEQ ID NO: 85456 - protein, 115 aa, Zea mays
  misc_feature: Ceres CLONE 1571788
MAVILSSAAPTILTRPTRPRRQPRSGLRGGLARLSAALGLAHAGAGAGAALAAPLSYEEMLRLSSDSGGDVGRGSRSRSLASDGLVRLSSTKNPSFVIPGQGVPGPSGVAAFPSL

SEQ ID NO: 85457 - DNA, 836 bp, Zea mays
  misc_feature: Ceres CLONE 1571790
  misc_feature: Encodes the peptide sequence at SEQ ID NO. 85458
  misc_feature (718)..(718): n is a, c, t, g, unknown, or other
ggagctccccgcggtggcggccgctctagaactagtggatcccccgggctgcaggaattcgtctcacccctagaaaaagtcctcgcatcccgcgccacaccatcccaatcccctccctccccctcgcgtctccagtctccacacctttcacacgcgacgccggagagacagagcgcgcgcgcgcgcccgaaagatgtcgacgtgcgcagcggacctggcgccgctgctgggcccggcggcggcgaacgccacggactacctgtgcgggcagttcgcggacacggcctccgcggtggacgccacgtacctgctcttctcggcctacctcgtgttcgccatgcagctcggcttcgccatgctgtgcgccggctccgtccgcgccaagaacactatgaacatcatgctcaccaacgtgctcgacgccgccgcgggggcgctcttctactacctcttcggcttcgccttcgccttcggcacgccctccaacggcttcatcggcaagcagttcttcgggctcgagcacctgcccaggaccggcttcgactacgacttcttcctctaccagtgggccttcgccatcggcgccgcgggcatcacgtcggggctcatcgccgagcggacccggttcgtcgcctacctcatctactccgcgttcctgacggggttcgtctaccccggtggtgtcgcactgggttctggtcccccaacggctggggcnggcgcagccggcacgtccgggctggtgcttcttggggtcgggggtcatcgactttcgcggggtccgggggtggtccaaaggggcggggggggatcccggggcttggggggcgcggtct

SEQ ID NO: 85458 - protein, 214 aa, Zea mays
  misc_feature: Ceres CLONE 1571790
  misc_feature (36)..(214): Pfam Name: Ammonium_transp Pfam Description: Ammonium Transporter Family
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLEHLPRTGFDYDFFLYQWAFAIGAAGITSGLIAERTRFVAYLIYSAFLTGFVYPGGVALGSGPPTAGAGAAGTSGLVLLGVGGHRLSRGPGVVQRGGGGSRGLGGAV

SEQ ID NO: 85459 - DNA, 841 bp, Zea mays
  misc_feature: Ceres CLONE 1571791
  misc_feature: Encodes the peptide sequence at SEQ ID NO. 85460
ctccccgcggtggcggccgctctagaactagtggatcccccgggctgcaggaattcgtctcacccctagaaaaaacgccatccgttccatttcttatcccctctcctccggtcctcccccctcccctcgatggcgtccctcacgctcccagcactcgctctcgccctctctaaccccggcgccgtccgcctacgcgccgcggccttccgctgctgggcgctccggcggcgcggctgggcggcggcgggcgccctggcctcgcccaactccgtgcttagcgagcatgccttcaagcggctccagctcgggagcgacgacgaggacggggaagggccgtacgggagcgacgccgacgaggggttcgaggcgggggagggggacaacgaggagctcgccattgccaggctcggcctgcccgacgagctcgtcgccacgctcgagaagcgcgggattacgcacctgttccccatccagagggctgtgttgattcccgctctcgagggccgtgacctgattgccagagcaaagactggaactggaaagacactggcctttggcatacccatgatcaagcaattaatcgagcaagacgatggtcggattacaaggagaagtcgtactcctcgggttctgggtctagcacctaccagagagttagccaaacaagtccagaaagaaataaggaatcaccacccaagctcgggcacagtgtgtggtttaatggcggggtctccatataatggccagcaaatggcactccctccggggtgtccaaggttgtttgtgggaaacacctgggccccattaatcgattttgaaaaaaggggggaaagcctccaga

SEQ ID NO: 85460 - protein, 237 aa, Zea mays
  misc_feature: Ceres CLONE 1571791
  misc_feature (112)..(229): Pfam Name: DEAD Pfam Description: DEAD/DEAH box helicase
MASLTLPALALALSNPGAVRLRAAAFRCWALRRRGWAAAGALASPNSVLSEHAFKRLQLGSDDEDGEGPYGSDADEGFEAGEGDNEELAIARLGLPDELVATLEKRGITHLFPIQRAVLIPALEGRDLIARAKTGTGKTLAFGIPMIKQLIEQDDGRITRRSRTPRVLGLAPTRELAKQVQKEIRNHHPSSGTVCGLMAGSPYNGQQMALPPGCPRLFVGNTWAPLIDFEKRGESLQ

SEQ ID NO: 85461 - DNA, 948 bp, Zea mays
  misc_feature: Ceres CLONE 1571796
  misc_feature: Encodes the peptide sequence at SEQ ID NO. 85462
ccccgcggtggcggccgctctagaactagtggatcccccgggctgcaggaattcgtctcacccctagaaaaaacttccacctgaactttgccctgccttctctcgacgactcccctgtccccgccgccgccgccgccgcaaatccccttccgcgtctgtctggcctctggggcttctaggttagcgcgtgcgaccaccatggccgaggaggtccaggctccactttccgccaccatggcgaaggaggcccagtcgccgccgtccgcaaccatagcggaggcgacggcgccgccgcagctcttattatttaactcctttacgaagagggaggagccattccagccccgggtagaggggaaggtagggatgtacgtctgtggcgtcactcccctacgactttagccacatcggccacgcgcgtgcctacgtcgcctttcgacgtcctctacaggtacccttaaattctttgggggaatgaagttgaaaatatgtcccgaaattttcacgggatattggatggaccaagattatttaaaggcgtggccaatagaaacgcggggaaaaacagaaaccaaggctttgaagtaggcccggcttttattcaatggaaattttccttcctttgacaagtggacttgaaacctccccgggggctttggccctccctaacccggggaaaggcaaacgggggtaaaaccgcaaaacaaccttgtggagcaattttttaaaacatttgggataaccaccagaattaatgtgggaaaggggggaaagaccctttgggcgtttttgaaaggaggggggttttaccctttttccagggggaaagggttttccctgaaaatacttcgcgggtgtattgtggggagaaaaaattttggatcaaagatcgcgagcggggtgcgcccggggagtgcggttttggaaccaacagcaagaaggtcaatc

SEQ ID NO: 85462 - protein, 67 aa, Zea mays
  misc_feature: Ceres CLONE 1571796
  misc_feature: SWISSPROT Homolog: EC 6.1.1.16 Cysteine--tRNA ligase
MAEEVQAPLSATMAKEAQSPPSATIAEATAPPQLLLFNSFTKREEPFQPRVEGKVGMYVCGVTPLRL

SEQ ID NO: 85463 - DNA, 831 bp, Zea mays
  misc_feature: Ceres CLONE 1571797
  misc_feature: Encodes the peptide sequence at SEQ ID NO. 85464
  misc_feature (639)..(639): n is a, c, t, g, unknown, or other
  misc_feature (667)..(667): n is a, c, t, g, unknown, or other
ctccccgcggtggcggccgctctagaactagtggatcccccgggctgcaggaattcgtctcacccctagaaaaaaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcgccgccgccgactccgtgaggtctgtctgcacggaggtggccacggacctgcagatcctcgtggataactgcctctaccatctccacaagttccccctgctctcgaaatgcatgctcctgcaagcgctgtgcgccgacgccggcgacgtcgtcgtcgagctcccggggttcccgggcggcgccgaggcgttcgaggcctgcgccaagtactgctacggcatcaccatcacggtgagcgcgcgcaacctggtcccgctgcggtgcgcggcggcgcacctcggcatgtcggaggccgccgacaggggcaacctcgcggccaagctcgacgcgttcctcgcctcccctgctctgcgccgctggaaggacgcgctgggcgtgcntcactccacgcgcccacacgccccgttntgcgaggacctggggctcacgtccggctgcgttcgacgccctgggccgccctcgtcgccagcccggacaccggcccgaactccaacttcggcgttcccccgtggtgggcgcacgacgtcgccaagctcggggtcgacttcttcctgcgggataatggtcccccc

SEQ ID NO: 85464 - protein, 204 aa, Zea mays
  misc_feature: Ceres CLONE 1571797
  misc_feature (141)..(141): Xaa is any aa, unknown, or other
  misc_feature (150)..(150): Xaa is any aa, unknown, or other
MKFMRLGTRPDTFFAAADSVRSVCTEVATDLQILVDNCLYHLHKFPLLSKCMLLQALCADAGDVVVELPGFPGGAEAFEACAKYCYGITITVSARNLVPLRCAAAHLGMSEAADRGNLAAKLDAFLASPALRRWKDALGVXHSTRPHAPXCEDLGLTSGCVRRPGPPSSPARTPARTPTSAFPRGGRTTSPSSGSTSSCGIMVP

SEQ ID NO: 85465 - DNA, 814 bp, Zea mays
  misc_feature: Ceres CLONE 1571798
  misc_feature: Encodes the peptide sequence at SEQ ID NO. 85466
ctccccgcggtggcggccgctctagaactagtggatcccccgggctgcaggaattcgtctcacccctagaaaaaaaatctcaatatcccaaccctccgatccccatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacgggccgaggaggaggagcgccgcgagcaggaggccgagacgaagactcgccgccgccggggacggcccaagcgccgccgcgacccggggagcgaggatgaggagcccgaggagctagagctgcaaacggaggatccccgtgagggagagatcacggaggcggtgcccgtagctgtaggggacccggtcaagatcactggcaaggggaagaagcagaagaagcactatgctttccttcgagtacgaggggcacaggcttcgagctggagggaccccgtgcttctcccgcctgaggacagcaatcagaagccctatgttcgcatcctccaggatataacagaaactgatggggagccttttgtaacgggccaaggggttttatgaccagaaaaagctgacaaaagggggggtgggaatctggggtagcct

SEQ ID NO: 85466 - protein, 204 aa, Zea mays
  misc_feature: Ceres CLONE 1571798
MGRRRRFAQLDDDDDDDEDVPINFKPSGGASSSDAKPRKPQPPPQQRRGVSDDDDEDVEEVELEEEEDDEKDLEAMRRAEEEERREQEAETKTRRRRGRPKRRRDPGSEDEEPEELELQTEDPREGEITEAVPVAVGDPVKITGKGKKQKKHYAFLRVRGAQASSWRDPVLLPPEDSNQKPYVRILQDITETDGEPFVTGQGVL

SEQ ID NO: 85467 - DNA, 841 bp, Zea mays
  misc_feature: Ceres CLONE 1571799
  misc_feature: Translation starting site: 141
  misc_feature: SWISSPROT Homolog: EC 1.6.2.4 NADPH--hemoprotein reductase
  misc_feature (787)..(787): n is a, c, t, g, unknown, or other
agctccccgcggtggcggccgctctagaactagtggatcccccgggctgcaggaattcgtctcacccctagaaaaactcgatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccgctcgccgcgctggcggccaccgccgcggccctcttcgcagggctgcttattatcgctgtctggttccgatccggaggcgggacgccgtccaagccggtcgccacgccggtacggccaccgccggtcaaggtagacgccgacgccgacgttgatgacggccggaagcgcgtcaccatcttcttcggcacacagactggcaccgccgaggggttcgccaagtccatggcggaggaggcgagggcgcggtacgagaaggccgtgttcaaagtggtggatctggatgactatgctcaggaggacgaggaatacgaggagaagctgaagaaggaaactgtggtgctgttcttcctagcacatatggggatggggagccaactgataatgcagcacgattctacaaatggtttactgagggaaaagagagggagtttgggttgaaggatcttaaatatggtattttttgcccttggaaacaggcatacgaacatttttataaggtggcaaaggtggtagatgagctagtagaggagcaggggtgggaaacgtcctgttcctgtgggccttgnagacgatgatccgtgccattgaggatgatttcactgctgggaaagaacagtgtg

SEQ ID NO: 85468 - DNA, 1146 bp, Zea mays
  misc_feature: Ceres CLONE 1571800
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (1146)..(1146): n is a, c, t, g, unknown, or other
nnnnnngggttttnnnnnnntntggccgcttacgcgccgggacaccttcctaaacagtagaatnnnnnnnnnnnnnnaaagctggagctccccgcggtggcggccgctctagaactagtggatcccccgggctgcaggaattcgtctcacccctagaaaaccgccgccgcgtcgggtcaaactccaccaccccatctccctcacctcacctcgccttcgcctcagctcacggcctcacccgtccacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaagaaggagagcccgaaccgcggcgggcgggagggctctttttagcttgccccgcctgaggcccagcgccccatgggccaggtggccggagcgcgctacttattcactccatccacctgcggggaaggggcttggggaaaaatcattaattgaaaggcctctccccttttaacaaggaaaacctttgcattaccaaaattccggttaaagaaccgaagttcccctctaaacaaaaagtttggtctcccaaaaataagtgggaaaaaatgccaatggttcccaagtcccttgagccctaggatacaaaggccacccacttccgtttttgaagaattcccacaaagaggggagagagaccgggaaaaatttctttgtgtacccccggttccaattattttgttttaaaaaaacaccaattctttttctttgggggaaaaaaatggggaaacaccacgctttcctggaggagataaacgagtcccagagaatctctccgagggggtggaatcctctctgctggggaaaaataaacaaaatttttataaaaataaaggggcccctggaagcccctattcataaggggcctgaatatacactccccaaaattaaggggagaggcgcccccccacgcttttttgggcgaaaaaacaagtctttccccggggaaggacatatttatatccccgaacatttacacccttctttttggaaaaaaatagttgaaaccaagaggccccccacacttgn

SEQ ID NO: 85469 - DNA, 782 bp, Zea mays
  misc_feature: Ceres CLONE 1571801
  misc_feature: Encodes the peptide sequence at SEQ ID NO. 85470
  misc_feature (766)..(766): n is a, c, t, g, unknown, or other
ctcaccgcggtggcggccgctctagaactagtggatcccccgggctgcaggaattcgtctcacccctagaaaaactgttgctgcaaaaaggcacattgattccagcacaacaattctggatgtccagggcgtgggtttgaaaaatttcagcaaaactgcacgtgaattaattcagcgactgcagaaaattgacaatgataactacccagagactctataccaaatgtttattgtcaatgctggtccgggtttccggctactatggaacactgtgaagtcctttcttgatcccaaaactaccgccaagatacatgttcttgggaacaaataccaaagtaagctgcttgaaataattgacgccagtgaattgccggaattccttggtggcacttgtacctgtcctgaatacggaggctgccttaaggctgaaaagggaccatggaaggacccaaacatacttaagatagtccaaagtggtgaggttcattgtgctcgtcaaattgtaactatttccaatggtgaagaaaaaattattacttatgccaaaccgaagcaccattcaatgcgagggagtgacacatcaactgctgagtctggctcagaagctgacgatgctatctcccccaaagctctcagaagtacatacaacatcctaagttgaccccagttcgtgaagaggtcaaaattgtcagggctacgagcttttctactcgtctccctgaatatgatgtaccctgtgttgacaaggctgtggatgctacatggnagagagagcagccaca

SEQ ID NO: 85470 - protein, 145 aa, Zea mays
  misc_feature: Ceres CLONE 1571801
MFIVNAGPGFRLLWNTVKSFLDPKTTAKIHVLGNKYQSKLLEIIDASELPEFLGGTCTCPEYGGCLKAEKGPWKDPNILKIVQSGEVHCARQIVTISNGEEKIITYAKPKHHSMRGSDTSTAESGSEADDAISPKALRSTYNILS

SEQ ID NO: 85471 - DNA, 844 bp, Zea mays
  misc_feature: Ceres CLONE 1571802
  misc_feature: Encodes the peptide sequence at SEQ ID NO. 85472
  misc_feature (540)..(540): n is a, c, t, g, unknown, or other
  misc_feature (631)..(631): n is a, c, t, g, unknown, or other
agctccccgcggtggcggccgctctagaactagtggatcccccgggctgcaggaattcgtctcacccctagaaaaactcgtggactccttccccacaaaactaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcggctgcgccggcaccttctgctccggccctcccacctccgcctccgcgcgccccactccatcgccgacctctcccgctcctccaattccgccccgagcccggcccgcccagcgctgggctccggcccggagaacggcagcggcggcgtccgcgcggtggagaaggacccgatcaagctgtgggagcgctacgtcgagtggctctaccagcacaaggagctcggcatcttcgtcgacgtcagccggatggggttcacggaggagttcctgcggcagatggagccgncgatgcagcaggccttcgtcgacatgcgggagctcgagaagggtcgcatcgcccaccccgacgaagggtcgcatggtgggccactactggnttcgcgacccgggccttgctcccaattcctttctccggaacaagatcgagaccgcactcaacaggaatcctcgcccttctctcaagaagtcgtcttctggaaaagatcttttccccaatcggggcggtttcccttccaatccctctaaaggaaatcggaaggttcagcttttgggcccccaaatttggttgctgaaggcacttgccccctgaa

SEQ ID NO: 85472 - protein, 192 aa, Zea mays
  misc_feature: Ceres CLONE 1571802
  misc_feature: SWISSPROT Homolog: EC 5.3.1.9 Glucose-6-phosphate isomerase
  misc_feature (114)..(114): Xaa is any aa, unknown, or other
  misc_feature (144)..(144): Xaa is any aa, unknown, or other
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPXMQQAFVDMRELEKGRIAHPDEGSHGGPLLXSRPGPCSQFLSPEQDRDRTQQESSPFSQEVVFWKRSFPQSGRFPFQSL

SEQ ID NO: 85473 - DNA, 840 bp, Zea mays
  misc_feature: Ceres CLONE 1571803
  misc_feature: Encodes the peptide sequence at SEQ ID NO. 85474
ctccccgcggtggcggccgctctagaactagtggatcccccgggctgcaggaattcgtctcacccctagaaaaacctcctagctcggctgcttgcctagggtttcgcctgctcccggccccgcctccagccgtcgcttgagatctcgccgctgccgccactcgatcctccttcgttgttcctcactgatcctgctgagctcggattttcgcccttcctccccgccggaacagcgtccggacgcgcgggcgcagatctgggttttggtggcccgcttgttgtatgagaaggcctctaaagcttgggagcaatggaggtggagccagcgaggagggacgcggcagcgctggacctggagctgctgcagctggcggagctcgcgccgggcgcgcttcgtgagaactccatagctgatgcactgtacgcgcagtggctcgtgctacctgagacgaccaagctggtaaagtctttgattgaggatgcaaagactggtgctgtgcttaatgttgctggaagctctactagcacaaatgctgcttcaggtagttctctaccatcgatgtttcctgctggtagtgctccaccactttctcctaggagcacttctggttctccccgtgttatgagacgaggatctggagctgggaccatcgtcttggggtctccattaaaattagttagggaacccagtgagaggagttataccctcagtttttacttcaaggatggggcgtcctcctacaaaagatcttaagggagcaggggttttctaggaacggagtcacctattttttgggggggggagggggacttcgagattcaagggaattccgatcgggta

SEQ ID NO: 85474 - protein, 147 aa, Zea mays
  misc_feature: Ceres CLONE 1571803
MEVEPARRDAAALDLELLQLAELAPGALRENSIADALYAQWLVLPETTKLVKSLIEDAKTGAVLNVAGSSTSTNAASGSSLPSMFPAGSAPPLSPRSTSGSPRVMRRGSGAGTIVLGSPLKLVREPSERSYTLSFYFKDGASSYKRS

SEQ ID NO: 85475 - DNA, 910 bp, Zea mays
  misc_feature: Ceres CLONE 1571805
  misc_feature: Encodes the peptide sequence at SEQ ID NO. 85476
ctggagctccccgcggtggcggccgctctagaactagtggatcccccgggctgcaggaattcgtctcacccctagaaaaactgcacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggctgtcattgccctaaagtgcccagacattgaggttgtcgttgttgacatctccaagccccgcattgaggcatggaacagcgacaccctcccgatctacgagccccggctcgatgatgttgtgaagcagtgcaggggcaggaacctcttcttcagcactgatgttgagaagcacgtcgctgaggctgacatcatcttcgtctcgggtgaaacccccaccaagacccgtgggcttggaagctggcaaagcttcccaaccttcccctctggggaaagcgctggctcttatgaatccccaaagtttctccagttctgaaaaaaatcgttgtcaaaaaaatccaccgctcctggtaaaaacccttgaggggtttttgaaaaaaatttttgcccccaaaagggaaggggggctaaaataacaaaaatctttttcaacccgcggaattctcttggaaaaggggcccttcttttttggaaaacccttttaaaacccctaaaaaagaggtcctccgggggggggggggaacacccccccgggggggagaaaaaccccccccccgctccttcagggaagggtgttttccccc

SEQ ID NO: 85476 - protein, 121 aa, Zea mays
  misc_feature: Ceres CLONE 1571805
  misc_feature (2)..(118): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPRLDDVVKQCRGRNLFFSTDVEKHVAEADIIFVSGETPTKTRGLGSWQSFPTFPSGESAGSYESPKFLQF

SEQ ID NO: 85477 - DNA, 816 bp, Zea mays
  misc_feature: Ceres CLONE 1571806
  misc_feature: Encodes the peptide sequence at SEQ ID NO. 85478
  misc_feature (593)..(593): n is a, c, t, g, unknown, or other
ggagctccccgcggtggcggccgctctagaactagtggatcccccgggctgcaggaattcgtctcacccctagaaaaaactcaccacctccccctgtggcatgggagcttctcccggcctcttcctccccttcctgccagaccatcttcctaccgcaacggacctgacggtttccatccacctggcctccctgttgcgcaagctgatcgacccacgcaacgcaagtgcaatgccgtgccgaggctagatcgagctgccgagcgctgatcacggtgaggccacccagatccacccgattgccacgcggacttcaccccttgccttttctcctcccgtccacccatcgggcgctttccctccatccctctctctcgtgcggcatctgggcgacccgccgacgcccctacgccaggtgcccaggccttcgtcgggtcctttaccggcgacgagcacacaccagggcactggagggctaccatctgcttcgctttctgaaaaaaaaacagtttcggcataattatcaccctaagatgcctggaaattacatggatggatttgttgcagaagaagtgccgaacagggtgaattcctcntcacagaatgaaaatctgcccgcccccaattcgacggcagctttcacaatggcgccaagcatgcaaagtgaggcacttgagatgcatgtcgagagctcccgtactggggagcccctcattgagcagctctacaaacatgtgtgcgagatgaagagctccagtgagggtggctccttgtcacatgagagcttttgctcagatggggaggagtctaggattgatt

SEQ ID NO: 85478 - protein, 95 aa, Zea mays
  misc_feature: Ceres CLONE 1571806
MPGNYMDGFVAEEVPNRVNSSSQNENLPAPNSTAAFTMAPSMQSEALEMHVESSRTGEPLIEQLYKHVCEMKSSSEGGSLSHESFCSDGEESRID

SEQ ID NO: 85479 - DNA, 833 bp, Zea mays
  misc_feature: Ceres CLONE 1571808
  misc_feature: Encodes the peptide sequence at SEQ ID NO. 85480
  misc_feature (603)..(603): n is a, c, t, g, unknown, or other
  misc_feature (604)..(604): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (686)..(686): n is a, c, t, g, unknown, or other
  misc_feature (687)..(687): n is a, c, t, g, unknown, or other
ggagctcaccgcggtggcggccgctctagaactagtggatcccccgggctgcaggaattcgtctcacccctagaaaaacgtacagaataaattcagatccacatgacataatggcagaggtctacaaaaatggtcctgtagaagttgctttcacagtttacgaggatttcgcacactacaaatctggagtgtacaagcacatcaccggtggcattatgggtggccatgccgtcaagttgattggatggggaaccagtgatgctggagaagattactggcttctggcaaatcagtggaatagaggctggggcgatgatggatacttcaagatcataaggggcaaaaatgaatgtggcatcgaggagggcgttgttgctggaatgccatccacaaagaatatggttccaaacttcggcggtgccgttggaagagctatagtttaatggttacgtttgcatggcctcaaatgctgttggaattagctaaagtaattttaaaatgcaattgttaaagggccacgatggtgtatgtattttgtacactagctcatttcaaaggtcgttatgttgctggtgccacatcactttggtcaagtggaataanntattatagaactagaatttcgattcgaannnnnnnnnnnnnnnnnnnnnnnnnnnnnnnnnnnnnnnnnnnnnnnnnnnncnntccgggtctacctacttcaattaagacccctttttccctcaaccaaagtccccgccgggcccccgtccccgttcttgtgccctccctaaatttggtttcccgcccccccaaaaaattcttttccaagggaacggaacccggagccc

SEQ ID NO: 85480 - protein, 110 aa, Zea mays; identical to SEQ ID NO: 84559
  misc_feature: Ceres CLONE 1571808
  misc_feature (1)..(91): Pfam Name: Peptidase_C1 Pfam Description: Papain family cysteine protease
  misc_feature: SWISSPROT Homolog: EC 3.4.22.1 Cathepsin B

SEQ ID NO: 85481 - DNA, 782 bp, Zea mays
  misc_feature: Ceres CLONE 1571813
  misc_feature: Encodes the peptide sequence at SEQ ID NO. 85482
  misc_feature (773)..(773): n is a, c, t, g, unknown, or other
ggagctccccgcggtggcggccgctctagaactagtggatcccccgggctgcaggaattcgtctcacccctagaaaaagttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcacccgaccaagggagcgcccgtcatcgactacaagctcgcgttgctcttccagcccatgcttatgctcggcataaccatcggcgtagagctcagcgtcatcttcccatactggctaatcactgtcctcattataatcctcttcgtaggcacctcgtcgagatccttctacaagggattctgatgtggagggnagaaaacaa

SEQ ID NO: 85482 - protein, 200 aa, Zea mays
  misc_feature: Ceres CLONE 1571813
MVMEGRTGSLYGRLNKSSTRGFLAYTAAGAACAAVLACFVLSAADSPASAARNDGARLRLSSRSPRVWPDLAFNWRVVVATVVGFLGSAFGTVGGVGGGGIFVPMLNLVVGFDTKSAAALSKCMIMGASASSVWYNLQVSHPTKGAPVIDYKLALLFQPMLMLGITIGVELSVIFPYWLITVLIIILFVGTSSRSFYKGF

SEQ ID NO: 85483 - DNA, 899 bp, Zea mays
  misc_feature: Ceres CLONE 1571814
  misc_feature: Encodes the peptide sequence at SEQ ID NO. 85484
  misc_feature (537)..(537): n is a, c, t, g, unknown, or other
tccccgcggtggcggccgctctagaactagtggatcccccgggctgcaggaattcgtctcacccctagaaaaaaacgcgagcccaccccaggccgaacgccgagtgcgatccctcccgtccgtgttgccctttgcgctccgctccgccttcctcctcttccaccccgtcacttccgtgccatccgcggctcgcctccccacctcccattcccgccgccccatgcctccggctcgaccgtagccgccctacggcgaccgccatggccgccgattccggcagaggtgcccgccgttccccccttaatccttaattggtccgtcccgattcgatttctgttgatcgttcgctgagggatcgctcaccttgagttgcccatagggatggccggcctggagatcgggccggcgtcgccgggctcggagggggcgccatcgccggcatcgagcgcgggcgcctccggggagcggcccgagcagtcgtctccgcgggtgaacaaagcgcccaggcctcgtcatgtccttctccgggaaacggcntggaccagtcgccgggccgggtcgccggtcgccgtcgcccgttccctgtcgcccccgggggcttggtcattgttcccacttccaagaaaccggcttcaaaccagttcgccccgcgcgccccgggtggctagaacatgtgcccggcttccaaccaaaccgggttggaaccagtttctttccccgggcgatctttcccccggcggccagaagaaaggccgccccgggtgcttggctaaatgtaaggggttctcaaaaaaatccgggtttgaaacaggttcgcgaatccggttggcccatttacccagattcccgcaaaccggccccgagagccgcccctttataaaccacgggaaaattgggtt

SEQ ID NO: 85484 - protein, 172 aa, Zea mays
  misc_feature: Ceres CLONE 1571814
MAGLEIGPASPGSEGAPSPASSAGASGERPEQSSPRVNKAPRPRHVLLRETAWTSRRAGSPVAVARSLSPPGAWSLFPLPRNRLQTSSPRAPRVARTCARLPTKPGWNQFLSPGDLSPGGQKKGRPGCLAKCKGFSKKSGFETGSRIRLAHLPRFPQTGPESRPFINHGKIG

SEQ ID NO: 85485 - DNA, 886 bp, Zea mays
  misc_feature: Ceres CLONE 1571815
  misc_feature: Encodes the peptide sequence at SEQ ID NO. 85486
ctccccgcggtggcggccgctctagaactagtggatcccccgggctgcaggaattcgtctcacccctagaaaaaaaacccttcgctgcgccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggttgatattgttgacacattccgtctacaggagcaacctccttttgacaagaaatcatttgtctcttacataaaaaaatacagttctatatcgccccattgctcgctcgcccagagttcttcttgttaggcaaggcaaaagcagaagcaaaaaaagaaaggtcttgttgccgatggggagctcagggttctcgtggacgctttcgggaccaccccaagctccccaaggggaaaccggtgggctggtcgtcgggctggacggattggggcgaaggccaaccccgaaccagtacaactggaatccatgtccgctcagaactcccggtcatgggactcgcctaaaaaatgggggcctccttgaaaaaatgaagaactaattgaagggcttactgggaaaccccttggggggtcccccccattctggaaggatgaacagggggcaaacacatgaaaattttggttcacaaagggcacctttggggggttgggggtcaaaatattttccgcccccaagaggtgccataaagctttgtttcaag

SEQ ID NO: 85486 - protein, 108 aa, Zea mays
  misc_feature: Ceres CLONE 1571815
  misc_feature (1)..(105): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKSFVSYIKKYSSISPHCSLAQSSSC

SEQ ID NO: 85487 - DNA, 831 bp, Zea mays
  misc_feature: Ceres CLONE 1571816
  misc_feature: Encodes the peptide sequence at SEQ ID NO. 85488
tccccgcggtggcggccgctctagaactagtggatcccccgggctgcaggaattcgtctcacccctagaaaaaacagctcgagagaggagggaaaaaaaatctcagccaccaccggcagccgcgggagcttcgcgtgcgccgcttgctcactgcccgcacacgtacgccagaacccctctctcccccctccttctgcagccatgctcctccacctgcttccgctctcctgccccgcgccgccgttccacctgcgcaggaccggcggctcgccgcgggtccgcgccggggatagggccaggacacgggggctccgggggacggacgtggagccggagacagcgccgcgaaggcgccgcagccgcgatggcgacgatcctcaagcggctgggagcggtggagacaccggggcgctgctggcgtcggtcaggaggcttctgctctccgaggcgcctgcggcggcggagggagacagtgaggaggagcagggacagttccccaagcgttgggccatcgtcttcctctgcttctccgcatttctactctgcaacatggaccgcgtaaatatgagcattgctattctgcctatgtccgcagagtttggtttgaacccacagactgttggtctcatccagtcatctttcatctgggggctacctcctaactcagatagcttgagggatatgggcagatactgttgggaggaaagacttgtcctggttttggtgttgggttggggggtcatagctacagctctttactccctgttggagcaccatctgggcttgccctttccttcttggttgggcgggccttccatgggcattgggggt

SEQ ID NO: 85488 - protein, 210 aa, Zea mays
  misc_feature: Ceres CLONE 1571816
MLLHLLPLSCPAPPFHLRRTGGSPRVRAGDRARTRGLRGTDVEPETAPRRRRSRDGDDPQAAGSGGDTGALLASVRRLLLSEAPAAAEGDSEEEQGQFPKRWAIVFLCFSAFLLCNMDRVNMSIAILPMSAEFGLNPQTVGLIQSSFIWGLPPNSDSLRDMGRYCWEERLVLVLVLGWGVIATALYSLLEHHLGLPFPSWLGGPSMGIGG

SEQ ID NO: 85489 - DNA, 849 bp, Zea mays
  misc_feature: Ceres CLONE 1571819
  misc_feature: Encodes the peptide sequence at SEQ ID NO. 85490
ggcggccgctctagaactagtggatcccccgggctgcaggaattcgtctcacccctagaaaaattgtgtagagctatcatctccctcggtttcttggaagaacaattatttgacataattatcaccataagatgcctggaattacagaggatggacttgttgcagaggaggtgccgagcggtgtgaatttctctccacagaacgaaagtctgcctgccccaaagtcgacagcagcttcaacgatggcgggtagcatgcaaagcgaggcgcttgagatgcatgttgaggcctccggtgctggggaaccctcaatcgagcaactctacaacaacgtatgcgagatggagagctcaagtgagggtggctccccatcacgcgagagctttggctcggacggagaggagtctaggattgactcggagcttcgacatcttgttgctggtgagatggaggccatgaaggtgattgaggaggaagaggagaatgggagtgttgccaacgttgtaccccctgctcctgctgagaatgggaccccagtaaaggaacagtcttccagttccgtccaaaaagtcgaaagaaggcctccaaaatccccggctttgagtctgatgccctcttggtgggactccaagggaaaaggcgcccacctggaggaaagggtgaaaaccaaggttcagccaaaacgggcgaaagcccaagtttgggcccgaacgggcggaaaaaatcaaaatggccccacccctcccgggaaatggggaaacacaaaaaaaaaggcctggggggcttttgaataaacaccccagaaacgctttgggggccccatttttgccttccctttaaaaaacaaag

SEQ ID NO: 85490 - protein, 220 aa, Zea mays
  misc_feature: Ceres CLONE 1571819
MPGITEDGLVAEEVPSGVNFSPQNESLPAPKSTAASTMAGSMQSEALEMHVEASGAGEPSIEQLYNNVCEMESSSEGGSPSRESFGSDGEESRIDSELRHLVAGEMEAMKVIEEEEENGSVANVVPPAPAENGTPVKEQSSSSVQKVERRPPKSPALSLMPSWWDSKGKGAHLEERVKTKVQPKRAKAQVWARTGGKNQNGPTPPGKWGNTKKKAWGAFE

SEQ ID NO: 85491 - DNA, 830 bp, Zea mays
  misc_feature: Ceres CLONE 1571820
  misc_feature: Translation starting site: 163
  misc_feature: SWISSPROT Homolog: EC 2.5.1.6 Methionine adenosyltransferase
  misc_feature (663)..(663): n is a, c, t, g, unknown, or other
  misc_feature (682)..(682): n is a, c, t, g, unknown, or other
  misc_feature (722)..(722): n is a, c, t, g, unknown, or other
  misc_feature (824)..(824): n is a, c, t, g, unknown, or other
tccccgcggtggcggccgctctagaactagtggatcccccgggctgcaggaattcgtctcacccctagaaaaagtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctgggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctcagccacgtgctggccaccaagctgggcgcgcgcctcaccgaggtgcgcaagaacggcacctgcgcctggctgangcccgacggcaagacccangtgacggggtgagtacgtgaacgagggcggcgccatggtncccgtccgcgtgcacaccgtgctcatctccaccagcacgacgagaccgtcaccaacgacgagatcgccgtcgacttcaaggagcacgtcatcaagcccgtgnatcccc

SEQ ID NO: 85492 - DNA, 1104 bp, Zea mays
  misc_feature: Ceres CLONE 1571822
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (15)..(15): n is a, c, t, g, unknown, or other
  misc_feature (16)..(16): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
nnnnnnnattttttnnttaaataatgtgaatgtaaaatatgtataataaaatgatgaacaannnnggcnnnnnnnaaaaatggagctccccgcggtggcggccgctctagaactagtggatcccccgggctgcaggaattcgtctcacccctagaaaaattccatccccaaccaaacaagtttagatataaaaatatagcatcgcccgcgctctggagagtctggatcctcctgaacctccaggcagcaagcgatgaaaggagggacgcaagcagtatagcctgatggtgcaccttgctgagccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgatcgtgctggcttggtgagcaaagccgggggcaacaacaccgggatccccgagctggtcgacaaagaccgacccgctcgcgctcaaaatcgtttctaaaaaatcacttctgggtgaacaaaggcagggcgcctcccgaaaaaccttgaaaaatggaatgtattccaggagccgtaacttccctgggcttaagggaaacccggggggaagcccgcctccgtggcccttcccctacaaaaaaaaattaaggggtcccggcaacgcttttcctctcggtatagggcggaaatcgtcgttttaaaccttaacccccgccgggggccccccgtttggtgggggaaaacaaaagattttctcgggggcttccgtgagatctcttttcacgcccgaaaacgggcggggttacaaaatattgccgaagggggtgtaaaggggcacccctggggaacaaccgtgggccggggccaaaacagggtatattggagaaagggaatttcccgtgggggtttccctcgccacattggccaaaggcaaaaaaaaaaattcggagggaaggcacacatcccccgcgcacaggtttttccgggctccccccaaatgggaaacacctttccccaaaaaagagaacctaaagccgcgggcccta

SEQ ID NO: 85493 - DNA, 865 bp, Zea mays
  misc_feature: Ceres CLONE 1571823
tggagctccccgcggtggcggccgctctagaactagtggatcccccgggctgcaggaattcgtctcacccctagaaaaagcaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggccacggcagcaacaactgggagggtctgctggaccccatcaacggcgtgctcctccaggagctcatccgctacggcgagttcgcccagggccccttacgacagctttccaactacgaccgcgttttccccctactggggggagctggcaagtaccccgggaaaaaaccttctttccccgaaaggtcgggccctcggggggcattcgggtaacgagggtcccccggttaccttctacccccccctgggagaagaaccctccagttttccccacattttcgggaattaaagaagggccgggccaacacccccaaaaatgtgggaagcgagatctccggccccatttatatctgggtcacaggggca

SEQ ID NO: 85494 - DNA, 829 bp, Zea mays
  misc_feature: Ceres CLONE 1571824
  misc_feature: Encodes the peptide sequence at SEQ ID NO. 85495
  misc_feature (456)..(456): n is a, c, t, g, unknown, or other
ccccgcggtggcggccgctctagaactagtggatcccccgggctgcaggaattcgtctcacccctagaaaaaaacagcctcaggttactcgcagaaaagatttattagctcgccgcgggggtcgaaccgagactcctagctagctgatcgcgcgcgcacaaggcgagcggacaagaaagcttgctttgtgctcaccggcgggcggcggcacggaccccctgcgatggaagccgtcggcgtcactcctgcccccgtggcggcgccggagaagaagaagctgcttgacctcaaggaccccttccccgccgccgcgaacggcggcaccaaggcgtccccggcgagtaagtgggcgatgaagaagaagctggtgggcggcgacgccggctacgtgctcgaggacgtaccgcacctcacggattacatgccccagctcccgacatacccgaatcctctccnaagacaccggcgtattcagtcgtcaagcagtatttcgtcaaccagacgacaccgtcacgcagaagattggttgtcataagaccaatgcccaggggcacccactttcggggtgccgggccacggaagcgggggtactccagtcccaagaaggggaacccccctttgtccctggggaggcccttgcccggggattaaaccggactcccccaaacttttttgcgcgtttaaaaaaaataaggggccccccccggcctccccgcaaagggggggaacaagaggttttttttctaaaaaaatggtgggggtgcacccaagggggggggaaaccttctttaaaaaggggggggttctccccaaaccctagggggggggg

SEQ ID NO: 85495 - protein, 103 aa, Zea mays
  misc_feature: Ceres CLONE 1571824
  misc_feature (78)..(78): Xaa is any aa, unknown, or other
MEAVGVTPAPVAAPEKKKLLDLKDPFPAAANGGTKASPASKWAMKKKLVGGDAGYVLEDVPHLTDYMPQLPTYPNPLXRHRRIQSSSSISSTRRHRHAEDWLS

SEQ ID NO: 85496 - DNA, 797 bp, Zea mays
  misc_feature: Ceres CLONE 1571825
  misc_feature: Encodes the peptide sequence at SEQ ID NO. 85497
  misc_feature (602)..(602): n is a, c, t, g, unknown, or other
gagctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccgggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctcccctccagggcttcctccaagggcatggacccccacgtcgagcgcttgaagagcgggttccagaaagtcaagaccgaggtctatgacaagaagccggagctngtcgagcctctcaagtccggccagagccccaggtacatggtgtttcgcctgctccgactcccgcgtgtgccccgtcggtgaaccctggggctgcagcccgggcaaaggccttcacccgtcgcaacatcgccctccatgttcccacccctacgacaagaatcagtacgcgggcaccagggtcccgcatcaaataat

SEQ ID NO: 85497 - protein, 52 aa, Zea mays
  misc_feature: Ceres CLONE 1571825
  misc_feature: SWISSPROT Homolog: EC 4.2.1.1 Carbonate dehydratase
MDPHVERLKSGFQKVKTEVYDKKPELVEPLKSGQSPRYMVFRLLRLPRVPRR

SEQ ID NO: 85498 - DNA, 837 bp, Zea mays
  misc_feature: Ceres CLONE 1571826
  misc_feature: Encodes the peptide sequence at SEQ ID NO. 85499
  misc_feature (585)..(585): n is a, c, t, g, unknown, or other
  misc_feature (589)..(589): n is a, c, t, g, unknown, or other
  misc_feature (590)..(590): n is a, c, t, g, unknown, or other
  misc_feature (597)..(597): n is a, c, t, g, unknown, or other
  misc_feature (661)..(661): n is a, c, t, g, unknown, or other
acccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcactgggtacgcggagcccgggtcgctgaccgcgctcatggggccctcgggggtcggcaaagtcaccctgctcgacgccctcgncggnncgctcgnccgcaaacgccttcctctccggcaacgtgctccctcacggcctgcaggccaagctctcccttcngcgccgcggcgtacgtgacgcaggaccaacaacttgatcgggaccctgaacggggcccgagacgaatcggctacttcggcgctgcctggcggttgccgggacaaaaagcccccgggaagacaaaccccccgctgggtggaggcaaccttcttccaaaatggggcctcccagaatct

SEQ ID NO: 85499 - protein, 155 aa, Zea mays
  misc_feature: Ceres CLONE 1571826
  misc_feature (125)..(125): Xaa is any aa, unknown, or other
  misc_feature (127)..(127): Xaa is any aa, unknown, or other
  misc_feature (129)..(129): Xaa is any aa, unknown, or other
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGVGKVTLLDALXGXLXRKRLPLRQRAPSRPAGQALPSAPRRT

SEQ ID NO: 85500 - DNA, 854 bp, Zea mays
  misc_feature: Ceres CLONE 1571828
  misc_feature: Translation starting site: 186
  misc_feature: SWISSPROT Homolog: EC 1.4.1.2 Glutamate dehydrogenase
  misc_feature (472)..(472): n is a, c, t, g, unknown, or other
  misc_feature (854)..(854): n is a, c, t, g, unknown, or other
acccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcanggtcattcctgggcccggtgagaagccaatgatagttgttcaacacaggggggaggagaaacagtttgcagccgaaaagatctccttccatggttctcatcaagatgcgggagatccctgaaacctaccctgggcagcacgatcaagaaagctgttggccagggtccctggcctactttaacgacttaaaaaaggcgggcaccaaaggatccttgggggaatttccggcctcaaaggggctgcgatattatccatgagccaacccccgggcggcatttgcccttggggccttgaaaaaaaagggaacccacgttccggggaaaaaaaaattcccccctcttttacaccttgggggggggggcaccctttaaaggttcccccn

SEQ ID NO: 85501 - DNA, 776 bp, Zea mays
  misc_feature: Ceres CLONE 1571831
  misc_feature: Encodes the peptide sequence at SEQ ID NO. 85502
  misc_feature (400)..(400): n is a, c, t, g, unknown, or other
ctccccgcggtggcggccgctctagaactagtggatcccccgggctgcaggaattcgtctcacccctagaaacactgcagtttggttaaatgtccagcaagacagtttctacagccagtttaagcttagcatgcgaaactatatcctgtctttatcgaaacaattcattactgattacatctcatcgcctgaagtgaacttcctcaccagtatatctggaagagttagcaagaagacaaagcttgtgttccgctttcttgacgaaggctctattgagccatcgacaaaccagacatatgggtccatgttgaaaaatctaacatttgtcaagacttttgcctctggaatacttgttcccaaaagctatatctggcctgttacaccagataattacctactngcttatacatcagttgttgatgatgctcacaaagcggggctagaaatctatgctgctgattttgcaaatgactttactatcagctataactacagctttgatccattagcggaatatcttttccttcaatgggtacagtggcctctctgtcgatggtggggtgactgatttcccgattactcctccaaaagcagttgggtgctttagtaccctgaacaacggcaagattcgacctgctaaaccctctggttacccccccaaaaggggcgaaggggggactacccaaaacgggccccaacaaactttattaaaaagcatttgcctaatgggggcaaaattcctttaaccgggcccggtcaaaggaaacaaaaaaggg

SEQ ID NO: 85502 - protein, 145 aa, Zea mays
  misc_feature: Ceres CLONE 1571831
MRNYILSLSKQFITDYISSPEVNFLTSISGRVSKKTKLVFRFLDEGSIEPSTNQTYGSMLKNLTFVKTFASGILVPKSYIWPVTPDNYLLAYTSVVDDAHKAGLEIYAADFANDFTISYNYSFDPLAEYLFLQWVQWPLCRWWGD

SEQ ID NO: 85503 - DNA, 839 bp, Zea mays
  misc_feature: Ceres CLONE 1571832
  misc_feature: Encodes the peptide sequence at SEQ ID NO. 85504
  misc_feature (583)..(583): n is a, c, t, g, unknown, or other
  misc_feature (751)..(751): n is a, c, t, g, unknown, or other
gagctccccgcggtggcggccgctctagaactagtggatcccccgggctgcaggaattcgtctcacccctagaaaagtgtctcacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacgagatccaagggttcccaaccatcaagatcttcagggaccaggggaagaacattcaggaatacaagggccctagggaggctgatggcattgtggattacttgaagaagcaggttggccctgcgtccaaggagatncagtcaccagaagatgcgacggcccttatcgatgacaagaagatctacattggttggtatcttcgctgaattcagcggcaccgaatttacaaacttcatggaggtcgcaaagaagctgaagtctgactacgactttgggcccactttgcatgccacccacttccacgntggtgatgcagcagtggaccggcccattggtcaggctgctgaagccattttgatgagctttgttgttgacagcaagggatttgaatgc

SEQ ID NO: 85504 - protein, 173 aa, Zea mays
  misc_feature: Ceres CLONE 1571832
  misc_feature (35)..(143): Pfam Name: Thioredoxin Pfam Description: Thioredoxin
  misc_feature: SWISSPROT Homolog: EC 5.3.4.1 Protein disulfide-isomerase
  misc_feature (151)..(151): Xaa is any aa, unknown, or other
MAIRSKAWISLLLALAVALSARAEEEPAAAAEGEAVLTLDVDSFDEAVAKHPFMVVEFYAPWCGHCKKLAPEYENAAKALSKHDPPIVLAKVDANEEKNRPLATKYEIQGFPTIKIFRDQGKNIQEYKGPREADGIVDYLKKQVGPASKEXQSPEDATALIDDKKIYIGWYLR

SEQ ID NO: 85505 - DNA, 808 bp, Zea mays
  misc_feature: Ceres CLONE 1571833
  misc_feature: Encodes the peptide sequence at SEQ ID NO. 85506
ctccccgcggtggcggccgctctagaactagtggatcccccgggctgcaggaattcgtctcacccctagaaaaactaccccacccacccaccccctatccatccatccatcccacctcctgctccacatcctcccctccgcccaccaacgcagcagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccacctgctgcaacagccgcgcgccgatgtcgctgcaggccgccgccgccgcacctgccgccggcgcggtcgacgaggagactcctgcctcctcccctccgtcagatgctagcaagggggtggagaacctggtgatcatcggctctggaccagccggttacaccgctgccatctacgccgcccgggcgaacctgaagcctgtcgtgtttgaagggtgccaggtggggggtgtccccggcgggcagctgatgaccactaccgaggtggagaatttccctggcttcccggacggtataaccgggcctgatctcatggacagaatgcgcaagcaagccgaacgctggggcgcagagctttaccaagaggatgttgagtttgtgaatgtaaagagcagcccgttttgttattcgtagcaacgacggggaggtgaaaatgtcaaaagtctaaatcaatggaaccggggagctccggttaaagggcctccgttctggcctggggaaaaac

SEQ ID NO: 85506 - protein, 173 aa, Zea mays
  misc_feature: Ceres CLONE 1571833
  misc_feature: SWISSPROT Homolog: EC 1.8.1.9 Thioredoxin-disulfide reductase
MAVTRVAVAAALSAAPLSSRRHRVALPSACRLLPASATCCNSRAPMSLQAAAAAPAAGAVDEETPASSPPSDASKGVENLVIIGSGPAGYTAAIYAARANLKPVVFEGCQVGGVPGGQLMTTTEVENFPGFPDGITGPDLMDRMRKQAERWGAELYQEDVEFVNVKSSPFCYS

SEQ ID NO: 85507 - DNA, 1060 bp, Zea mays
  misc_feature: Ceres CLONE 1571836
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (132)..(132): n is a, c, t, g, unknown, or other
  misc_feature (274)..(274): n is a, c, t, g, unknown, or other
  misc_feature (718)..(718): n is a, c, t, g, unknown, or other
  misc_feature (848)..(848): n is a, c, t, g, unknown, or other
  misc_feature (850)..(850): n is a, c, t, g, unknown, or other
  misc_feature (851)..(851): n is a, c, t, g, unknown, or other
  misc_feature (855)..(855): n is a, c, t, g, unknown, or other
  misc_feature (861)..(861): n is a, c, t, g, unknown, or other
  misc_feature (862)..(862): n is a, c, t, g, unknown, or other
  misc_feature (908)..(908): n is a, c, t, g, unknown, or other
  misc_feature (978)..(978): n is a, c, t, g, unknown, or other
  misc_feature (986)..(986): n is a, c, t, g, unknown, or other
  misc_feature (988)..(988): n is a, c, t, g, unknown, or other
  misc_feature (991)..(991): n is a, c, t, g, unknown, or other
  misc_feature (992)..(992): n is a, c, t, g, unknown, or other
  misc_feature (1013)..(1013): n is a, c, t, g, unknown, or other
  misc_feature (1020)..(1020): n is a, c, t, g, unknown, or other
  misc_feature (1024)..(1024): n is a, c, t, g, unknown, or other
nnnnnccccaaaannnnttttccttctctacacccccctatccccccatcttacaccgctttattaagaataaaaataaaccaacaaaatannnnggtaannnnnnnnnnccaaaaactggaagctccaccncggtggcggccgctctagaatagtggatcccccgggctgcaggaattcgtctcacccctagaaaaatcatccactccgccgcacaggcgctcagctccgcaacgccgccggaaatggtcgccgccaacggcaccgccatggncaaccgctgcatcgccgctactcaacgggacccgaaatacttgcgcggctcccccaatcaagaatcaccttggcccttccttcctttggcgggcggcccggccaaagaaacgggtttccaccgggcccgggtttcccccaaaattgtttttggggggggggaaaaaaaaaaaggggccctttaaaccccccaaagggccttggaccacccggaaaaagggttttggggaaaattttttttttaaaaaaaaaagagcccgcccccccccccccgggggaaaaaaaattaaacccccctcgaaaaaaccccccccccaaaaaaagaggggccccctctcctgggaaaaaaagaaggggtcccacaaaaaaaattttttttaaaaaaacctcccttaaaaaacacaaatttttttttttaaaaaaaaaaaaggggcggggggggggnaaaaaaaaaccggataatttattaaaaaaaaagaaaaaacaaaacaaacctttctttttttgtgggggggggagaaaaaaaaaaaaaaaaaaacccccccccggggtgtgtttttttttttattatttcntnntccnccgccnnggaggggaggagaggaaaaagaaaataattttttttttgtggcgtntggttttttcctctctttttttaaaaaaaataaaaaagaacaccgccgcggcgagaaaaaaaaaacagangcgagtananctnnggtgtttttttttgtgtgggnatttacnaaangtgtgaaagacgagagcaagcaccccccgggagagg

SEQ ID NO: 85508 - DNA, 1118 bp, Zea mays
  misc_feature: Ceres CLONE 1571840
  misc_feature: Encodes the peptide sequence at SEQ ID NO. 85509
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (885)..(885): n is a, c, t, g, unknown, or other
  misc_feature (1061)..(1061): n is a, c, t, g, unknown, or other
  misc_feature (1118)..(1118): n is a, c, t, g, unknown, or other
aaaaaaagataagaaggttgcttgttccccaacacttaaaccctgccctctatccccatccacgnnnnnnnnnnnnnnnccaaagctggagctcaccgcggtggcggccgctctagaactagtggatcccccgggctgcaggaattcgtctcacccctagaaaaaggtgaggcgagccgccagtggaactgtggaagcgtccagcttttttcttctttgccttgctgcgcaaaaagaacgcaaactagaggagggcggcgatggcgaagaggctgctcccgtcgctgaaccgggtgctggtggagaagctggtgcagcccaagaagaccgccggcggcatcctcctcccggaaacatccgagcagctgaatgctgctaaagtggtggctgttggccctggtgagctcgacaaggcaggcaatctgatcccacttgctcctaaagaaaggtgacactgttcttctgccccgagtaaggtggatctgacatcaaacttggcggctgataaagagtaccctcctcttcaaaaaaagatgacctttttcgggccccactttggtggaactgatttcacgatcagcggagcaaaaccggggggctgaagactccgttaaggaaatttgaaaggcttgcgaaaccaaaacatgcctagaaaagaaaacttgtgggccccgtggtttcctgaaattgttcattaacaaattggggggggggtggaaaaaacaaaatccactgattcaattggaacgcggacattaaaaaaactctaaggataaggccctttcttatcttctgatggaaaatgcccaactctgcgcagaaaacaatagcttttctccgcggatatttttgtggatcctagttctctatcgtaaacccgtcctncccggtaaagagccgggggtggtcgcccttgtccaatctcttggcgtgggaccttctcacacaggcgggccaaaagcagtgaacccccccgggggccaaccctttacaaaacaacccgagattcgggcgacacgaacaacgaaaagacgcggctccaaagtgcgcggaggaaatcncccccactcaccaaattaaaacccgctctatcgaagagagggtcttcctcgaccaan

SEQ ID NO: 85509 - protein, 63 aa, Zea mays
  misc_feature: Ceres CLONE 1571840
MAKRLLPSLNRVLVEKLVQPKKTAGGILLPETSEQLNAAKVVAVGPGELDKAGNLIPLAPKER

SEQ ID NO: 85510 - DNA, 843 bp, Zea mays
  misc_feature: Ceres CLONE 1571841
  misc_feature: Encodes the peptide sequence at SEQ ID NO. 85511
  misc_feature (688)..(688): n is a, c, t, g, unknown, or other
  misc_feature (697)..(697): n is a, c, t, g, unknown, or other
  misc_feature (698)..(698): n is a, c, t, g, unknown, or other
ctccccgcggtggcggccgctctagaactagtggatcccccgggctgcaggaattcgtctcacccctagaaaaactcgatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccgctcgccgcgctggcggccaccgccgcggccctcttcgcagggctgcttattatcgctgtctggttccgatccggaggcgggacgccgtccaagccggtcgccacgccggtacggccaccgccggtcaaggtagacgccgacgccgacgttgatgacggccggaagcgcgtcaccatcttcttcggcacacagactggcaccgccgaggggttcgccaagtccatggcggaggaggcgagggcgcggtacgagaaggccgtgttcaaagtggtggatctggatgactatgctcaggaggacgaggaatacgaggagaagctgaagaaggaaactgtggtgctgttcttcctagcaacatatggggatggggagccaactgataatgcagcacgattctacaaatggtttactgagggaaaagagaaggaagtttgggttgaaggatcttaaatatgggtatttttggccnttggaacanngcatacgaacatttttaaaagggttgcaaaaggtggtagatgagctagtagaggagcagggtgggggaaacgtcttgttccctgttggccttgggagacgatgatcagtgcatttgaggatgatttcactgcatggaaaagaact

SEQ ID NO: 85511 - protein, 176 aa, Zea mays
  misc_feature: Ceres CLONE 1571841
  misc_feature (86)..(177): Pfam Name: Flavodoxin_1 Pfam Description: Flavodoxin
  misc_feature: SWISSPROT Homolog: EC 1.6.2.4 NADPH--hemoprotein reductase
MAALEAAREWAGSVIPPELAAAAGGDPLAALAATAAALFAGLLIIAVWFRSGGGTPSKPVATPVRPPPVKVDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWVEGS

SEQ ID NO: 85512 - DNA, 844 bp, Zea mays
  misc_feature: Ceres CLONE 1571844
  misc_feature: SWISSPROT Homolog: EC 2.7.13.3 Histidine kinase
ggagctccccgcggtggcggccgctctagaactagtggatcccccgggctgcaggaattcgtctcacccctagaagagtcgcatttcttcccactccggttctcatctgctgctccacgccgatccaactcggagtccccactccctcgaatcgcagctgctgcagcggagcaccagggtcttgcctcgatttgcggcgaaagcacgccgtttttctggtggtttgtagcgccgagcggttcttgattccggcgctggttttggtgctattgaggaggaggtgggggttttctttcgattggaggggtaaaagttgccgcctttcttgcattccactctgttcttggaccggatttcttctccctgcacgaactcgagctcgagctcggctcgggcttctccaacctccaacgcgtagtcccgtctagttttcttacatacaggtggcattttagtgcttgcttctttcaagaactgtagcgtcttgattactgctttacctctttgcggatggatggatgcgattgtattgagccactttggcaggccgatgatctcttaatgaagtaccagtacatatctgacttctttatcgcacttgcatacttctcgatcccttttgagctgatatactttgttcagaagtcagctttcttccccctacgatgggtactcatacaggtttggtgcgtttcatcgtttctgtgtgggggcaccccaccttataaacatggtgggactttcccttacgcctacccaggaccattaactggtggtggcttgaacattggcaaaaaggtggccaacagccccttggggtccatggcataaacagctcctggaa

SEQ ID NO: 85513 - DNA, 2340 bp, Zea mays
  misc_feature: Ceres CLONE 1571845
  misc_feature: Encodes the peptide sequence at SEQ ID NO. 85514
aactccaccgcccctacctgacctgacctgagataagcaaacgcacacctgcggtgcgggctgcggctccgctcatcgctgccagccagtccaggtcactgcctccctcgttccacaccatgccagcggccactctcgccgtgcgggtggccgccatcctgctcctcctcgcccggggcggatccgggtcggcgcccggggagttcgtgctcagtggcttcgcgagcggcaacgtcacgaccagcggcgcggccgtcgtcacctcctccggcatcctgcagctcaccaacgcgaccaacgaggtgttcgggcacggcttctaccccgtgccgttccgcttcaaggacgcctcctccacgccgcgctccttctccaccaccttcgtgttcgccatggtgccgcggcacgacgacgcgcacggccacgggatcgccttcgcgctggcgccgtcgccgaccgtgcccggcgcggtggccgggaagaacctcggcctgttcaacacgtccgacgacacggggaaggccaggagcggggtcgtcgccgtcgagctcgacacggccaaggacgaggagtttagcgacatcaacgacaaccacgtcggtatcgacgtcaacagcctggtgtccgtgagctcagcgccggcggcgtacgtcgacgccggcagcctagtcaacatcagcctggtcagcggggagcccctacaggcgtgggtcgagtacgacggcgcgagcatgcgcctggaggtgacggtggcgccggcgcgcaagcccaggccggccgtcccgctcgtgtcttccgtcgtcaacctctcgtcggccgtatccgacgacacgtacgtcgggttcacggcggcgaacggcgcggcctccacctctcactacgttcttggctggagtttccgcctaggcgacggacgcgcgatggacctcgacgcctcgaagctgccgccggtcccatcgtccaagaagaagacgtcgcggctaaacttggtcacgctgtccctcgttgtcgtcgtggcactcctcttagcgtcggtggcagtcgcagctctcgtggtcaggcaccggcggttcgccgaggagcaagaggactgggagatacagtacgggcctcaccggatcagctacaaggacctgcacgcggccacgagggggttccgcgacgccatcggcgaaggcggcttcggccgcgtgtaccacggcgtgctacagcggccggtgaacgccgaggttgccgtcaagaaggtgtcccacgactcccggcaggggctacgcgagttcgtgtccgagatcgcgagcatgagccggctgcgccaccgcaacctggtgcagctcctcgggtactgccggcggcggggcgagctggtactcgtctacgactacatggtcaacggcagcctcgacaggcacctgttcgacgccggcaagccggcgctgagctgggagcagcgcggcaagatcgtccgcgacgtcgccgctgggctgctgtacctgcacgaggggtgggagcaggtggtggtgcaccgcgacatcaagtccgccaacgtgctcctcgacgccgacatgaacggtaagctcagcgacttcggcctcgcgcggctgtacgaccacggcagcaacccgcagacgacgcacgtcatcgggacgctggggtacctcgcgccggagatgagcaagacggggaaggccaccacaagcaccgacgtgttcgcgttcggcgccttcctgctcgaggtggcgtgcgggcggcggcccatggagcgcgacgacgaccttgatttgcccgggctcgtcgacctcgtcctcgagtgctggaaggccgggaggatcgtggaagccagggacaaaaggatcggcaagtgcgacgaggccgacgtcgagctggtgctcaaactcggcctgctctgttcgcaccctgacccccggtgccggccgagcatgaggcaggcggtgcagatgctggaaggcgcagcgccggtgccagagacaccgcccaaagatctagccagcaacagcaggttgttctacggatacagcgagtctttcgacgagttcgccaccatgttcccggcgacgtcggaggtcaccagcgtcaccacgcagccgtcttcctcacactccaccggcgaggggcagcaggtctcctccgaacaaatcaccaacgtatagtcatgtgttttacgatggttgggttaggaagcaaacagtgatcataggtttaggtgttgtgtggtattttcttcaagtgaatataggatatggtcagccattttgtagggatgaccacaaaaacaaagttagataaagctccaacagattgaactgaaaaaaaaaaaaaaaa

SEQ ID NO: 85514 - protein, 682 aa, Zea mays
  misc_feature: Ceres CLONE 1571845
  misc_feature (25)..(261): Pfam Name: Lectin_legB Pfam Description: Legume lectin domain
  misc_feature (344)..(614): Pfam Name: Pkinase Pfam Description: Protein kinase domain
  misc_feature: SWISSPROT Homolog: EC 2.7.11.1 Non-specific serine/threonine protein kinase
MPAATLAVRVAAILLLLARGGSGSAPGEFVLSGFASGNVTTSGAAVVTSSGILQLTNATNEVFGHGFYPVPFRFKDASSTPRSFSTTFVFAMVPRHDDAHGHGIAFALAPSPTVPGAVAGKNLGLFNTSDDTGKARSGVVAVELDTAKDEEFSDINDNHVGIDVNSLVSVSSAPAAYVDAGSLVNISLVSGEPLQAWVEYDGASMRLEVTVAPARKPRPAVPLVSSVVNLSSAVSDDTYVGFTAANGAASTSHYVLGWSFRLGDGRAMDLDASKLPPVPSSKKKTSRLNLVTLSLVVVVALLLASVAVAALVVRHRRFAEEQEDWEIQYGPHRISYKDLHAATRGFRDAIGEGGFGRVYHGVLQRPVNAEVAVKKVSHDSRQGLREFVSEIASMSRLRHRNLVQLLGYCRRRGELVLVYDYMVNGSLDRHLFDAGKPALSWEQRGKIVRDVAAGLLYLHEGWEQVVVHRDIKSANVLLDADMNGKLSDFGLARLYDHGSNPQTTHVIGTLGYLAPEMSKTGKATTSTDVFAFGAFLLEVACGRRPMERDDDLDLPGLVDLVLECWKAGRIVEARDKRIGKCDEADVELVLKLGLLCSHPDPRCRPSMRQAVQMLEGAAPVPETPPKDLASNSRLFYGYSESFDEFATMFPATSEVTSVTTQPSSSHSTGEGQQVSSEQITNV

SEQ ID NO: 85515 - DNA, 1220 bp, Zea mays
  misc_feature: Ceres CLONE 1571851
  misc_feature: Encodes the peptide sequence at SEQ ID NO. 85516
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (16)..(16): n is a, c, t, g, unknown, or other
  misc_feature (17)..(17): n is a, c, t, g, unknown, or other
  misc_feature (62)..(62): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
nnnntttttttggggnnatatttaatatttgaacgagaaaccgtacaccggacaaaaaattntnnnnnntaaaaagctggagctcaccgcggtggcggccgctctagaactagtggatcccccgggctgcaggaattcgtctcacccctagaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgaagctacctgacgggcgaagttcccgggcgactacggctgggaacaccgcggggcctgtcgcgggacccggaagagtttcgccaagaacccgggagctgggagggggacccacttcccgcctggggcccattggcctggggcgcacgcaccgggctgggcggtatttccccgggaagcctggctccgcccccggcaaaaggggtggtcaacagggtttccgggcgcaaagggccccggtgtgggaggttttaaaagaggagccagggctatctcccacaaaatatactttttccaaacccggaaggagggggtggggaaaacctgggggaaaaacataacccctgctcggaggggggaaaaacgccgcgcaaaagaaggtcctgcgtatgagtagtctccccgagagagacgggggagaaaaagaagcgcatatatttccccgtttccggacgcccaaatacattggggggggggcacctatgagaccccatggaggaagctgtgaggccttcatatatgtggggggggtggcgctcaggtgtttgggagagggggcattaatacaccgccatcttcttgtcgaccgggggggaggcgccccccggagttcgggagtgaaagggagtgcaggcacgaaaataccccggctccctatgatacccggtgagggtgaaagattatttgaaaaaccctccttagggtgcctaccgccccaaaaacaaacccacgaagggagccttctccctggtagatcttacaaggtgaaaagagaacacctcaataacacccggcccc

SEQ ID NO: 85516 - protein, 179 aa, Zea mays
  misc_feature: Ceres CLONE 1571851
MASSTMALSSTAFAGKAVNVPSSSAFGEARVTMRKTAGKAKPAAASGSPWYGPDRVLYLGPLSGEPPKLPDGRSSRATTAGNTAGPVAGPGRVSPRTRELGGGPTSRLGPIGLGRTHRAGRYFPGKPGSAPGKRGGQQGFRAQRAPVWEVLKEEPGLSPTKYTFSKPGRRGWGKPGGKT

SEQ ID NO: 85517 - DNA, 815 bp, Zea mays
  misc_feature: Ceres CLONE 1571857
  misc_feature: Encodes the peptide sequence at SEQ ID NO. 85518
ctccccgcggtggcggccgctctagaactagtggatcccccgggctgcaggaattcgtctcacccctagaaaaaagtccctctcatccatccagagaagctagagtccaggtctcactcgcgaccgagagccacagagaaatggggggccctggtcgtccctggcgccggcacgtcttcctcgtcgtgtcgctgcagcttctccttgtggcgccatggcaggacgagacggccgctcgagctctcaatttcaccaggcaggatttccccagggccttcgtctttggtgccggcacgtcagcttaccagtacgaaggggcaaccgatgaagacggaaggagcccaagcatatgggacaactttactcatgcaggtaggatgccggacaagagcactggcgacctaggggcggacggctaccacaaatacaagggagacgtgcagctgatgagtgacactggcctggaggcctaccgcttctccatttcttggtccaggcttattcccagaggaagaggagccatcaaccccaagggcctcgagtattacaacaacctcatcaatgagctagtaaaacgaggaattgagatacacgtgaccctgtcccacctggattaccctcagatcctgggaggacgagtaccacggctggctgagcccccagatggtggacgacttcgaggcgtacgcggacgtgtgctttccgcgagttcgggcgaccggtgaagcaactggaccaccatggacgaagcggacgttcactccatcggccgctacgaaaacgggggctttccccccgggcgctgctccccggcc

SEQ ID NO: 85518 - protein, 194 aa, Zea mays
  misc_feature: Ceres CLONE 1571857
  misc_feature (38)..(194): Pfam Name: Glyco_hydro_1 Pfam Description: Glycosyl hydrolase family 1
  misc_feature: SWISSPROT Homolog: EC 3.2.1.21 Beta-glucosidase
MGGPGRPWRRHVFLVVSLQLLLVAPWQDETAARALNFTRQDFPRAFVFGAGTSAYQYEGATDEDGRSPSIWDNFTHAGRMPDKSTGDLGADGYHKYKGDVQLMSDTGLEAYRFSISWSRLIPRGRGAINPKGLEYYNNLINELVKRGIEIHVTLSHLDYPQILGGRVPRLAEPPDGGRLRGVRGRVLSASSGDR

SEQ ID NO: 85519 - DNA, 848 bp, Zea mays
  misc_feature: Ceres CLONE 1571858
  misc_feature: Encodes the peptide sequence at SEQ ID NO. 85520
ccgctctagaactagtggatcccccgggctgcaggaattcgtctcacccctagaaaaaagacgcagcacggcgcgccggcgcgggacgacggcatgacgccgccgtccatcttccaccaccatcgctgcctcgtctccctcccctccgcttccccgacctggacctcgtcccgtcgtctcatccatcaactcgcaaaacccacagtcctgtccctacatctgcgtccagtcttatcctcttccttcgcggttgccgccgtcggcgacgacgaggatgtcgtagtcggggattgcctcgtgttcgacgacgacgctttcgaggaaccggacctggacctcccctcgtccccgtggccgtcggctagcgcctcacgccacggccggaggtcggaggcaggcgagagcgacagcctggtgccggagaggtggaggcatgccgaggaggagatcaacctggacgaagaaggataagcgccgcatcgcgcacgggctgcggttcgggagccgcctcgagcggcgggcgcccccagctgttgctgctcctgatgaattccgcgcgtaccgcaaggggatgctgaacgctgaacgtgagcatgtttctcatgtatcccgggggccgctgggaaaggactcctcccgcccgaaagtgaaggaaacatccaccgcccgaaacccggaaccttgggaccgcgtggtggccccccagggaatcccgaggaattggggaatggggcgtttggccacccctttgaacgaacttttaaaggaagtttttttcacaaagtatagggggaaaattggttctccgggatataaagaatgggagggaaacccccaagaagtctctg

SEQ ID NO: 85520 - protein, 125 aa, Zea mays
  misc_feature: Ceres CLONE 1571858
MTPPSIFHHHRCLVSLPSASPTWTSSRRLIHQLAKPTVLSLHLRPVLSSSFAVAAVGDDEDVVVGDCLVFDDDAFEEPDLDLPSSPWPSASASRHGRRSEAGESDSLVPERWRHAEEEINLDEEG

SEQ ID NO: 85521 - DNA, 721 bp, Zea mays
  misc_feature: Ceres CLONE 1571860
  misc_feature: Encodes the peptide sequence at SEQ ID NO. 85522
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (686)..(686): n is a, c, t, g, unknown, or other
  misc_feature (688)..(688): n is a, c, t, g, unknown, or other
nnnnnnnnnnnnnnnnnnnnnnnnnnnnnnnnnnnnnnnnnnnnnnnnnnnccccccnnnaaaactgggctcccgcggggcggccgctctaaactagtggacccccgggctgcaggattcgtctcacccctagaaaaagtcgctctctccccgttctggttttcgtctaatctagattggatgggatgatgattcgaggcgttagcttattttagctgtaatccagactaaaccccgggctcgttggttcggcggcctcccgtgagatcgcttccatcagatgagcgaagaaggagtcgtcctggataacccccggagtggtgaaagtcttaaattggaaattttgggccaaaccaaacgggggggcttttttcccccggacccccggggcccgaaatttttttttttggttttaaaaattcccggccccccccaaaaggttgggggaaaaatatttttgggggggagggggccccctttttttcaaaaaaaaaaaaaaaaaagggggggccccccctttgtttgtttaccaaaaaaaaaaaaagaaaaattttctctcctcggagggggggggggggggtttttttctctaaaaaaaaaagggcgggggccctcttcaaagggggggggggggggggaaaaaaaaaaaaaggccccccccccccaaaaaaatatttttttgtttntngggagggccccccaaaaaaaaaaaaaaaacgcc

SEQ ID NO: 85522 - protein, 14 aa, Zea mays
  misc_feature: Ceres CLONE 1571860
  misc_feature (3)..(3): Xaa is any aa, unknown, or other
PPXKLGSRGAAALN

SEQ ID NO: 85523 - DNA, 691 bp, Zea mays
  misc_feature: Ceres CLONE 1571861
  misc_feature: Encodes the peptide sequence at SEQ ID NO. 85524
  misc_feature (258)..(258): n is a, c, t, g, unknown, or other
  misc_feature (342)..(342): n is a, c, t, g, unknown, or other
  misc_feature (525)..(525): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (538)..(538): n is a, c, t, g, unknown, or other
  misc_feature (539)..(539): n is a, c, t, g, unknown, or other
ctcccgcggtggcggccgctctgaatagtggatccccgggctgcggaattcgtctccccctagaaaaagagggaacaggtgggatatgaggaactcggtgtcggagcggagcttcctcatcgagagcgacgatgacgacgatgccgccgtggaggacgggaagcggcgcggccttggcggcggcggcggcgacgacgacgacgggtccgactcctcgtcgccgtgcgacagcccgcgggtggtggcggcgcggtgcanccagccgagttcgtacacgcagcaatggccgcagagctacagggaatccattgacatgtacagcagtgtgcactctccccaccntgagcttctttgggcacgccatcactggagccgggttgtcaaacttcttcccttcccaaacttcttttccggggggaaaccccccccgaaaatcactccccccgcttttattcacaggcttttttttgggcccaaaaagaatttttgttttcccccccccgcgggttgacccccccccccccnannnggccccggnntctttggggggggggccccccccgggaaaaaaaaaaccccccccccttttttcggggggggccccccccctttttttcccaaggggggggggtctctcctcccctctccccaaagagaaatgtacccccccccgggagaaacaaaaaaaaaa

SEQ ID NO: 85524 - protein, 141 aa, Zea mays
  misc_feature: Ceres CLONE 1571861
  misc_feature (58)..(58): Xaa is any aa, unknown, or other
  misc_feature (86)..(86): Xaa is any aa, unknown, or other
MRNSVSERSFLIESDDDDDAAVEDGKRRGLGGGGGDDDDGSDSSSPCDSPRVVAARCXQPSSYTQQWPQSYRESIDMYSSVHSPHXELLWARHHWSRVVKLLPFPNFFSGGKPPPKITPPAFIHRLFFGPKKNFCFPPPAG

SEQ ID NO: 85525 - DNA, 822 bp, Zea mays
  misc_feature: Ceres CLONE 1571864
  misc_feature: Encodes the peptide sequence at SEQ ID NO. 85526
ctccccgcggtggcggccgctctagaactagtggatcccccgggctgcaggaattcgtctcacccctagaaaaaagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctcccacccaaggacggcgtctacccggagaaagtcaaccccggcaagggagggcgtcggccagaaacttcgcagcatcgggcagaacgtcaaacccatcgacgtcaagttcaccggcaagggccactttcgactaatcacacttcacgtacgccgcacgcccccagccggggatcaaaataaaagaactctttcttctattaattacaggataatga

SEQ ID NO: 85526 - protein, 215 aa, Zea mays
  misc_feature: Ceres CLONE 1571864
  misc_feature (62)..(201): Pfam Name: PsaD Pfam Description: PsaD
MAMATQASAATRHLLAAAWAPAAKPRQLSSQLALPSSSSRGPAPLRASTEEAVEAPKGFVAPQLDPSTPSPIFGGSTGGLLRKAQVEEFYVITWTSPKEQVFEMPTGGAAIMREGPNLLKLARKEQCLALGTRLRSKYKITYQFYRVFPNGEVQYLPPKDGVYPEKVNPGKGGRRPETSQHRAERQTHRRQVHRQGPLSTNHTSRTPHAPSRGSK

SEQ ID NO: 85527 - DNA, 822 bp, Zea mays
  misc_feature: Ceres CLONE 1571871
  misc_feature: Encodes the peptide sequence at SEQ ID NO. 85528
  misc_feature (810)..(810): n is a, c, t, g, unknown, or other
ctccccgcggtggcggccgctctagaactagtggatcccccgggctgcaggaattcgtctcacccctagaaaaatccactgccagtgccatcccattcccatccgaggtaaacgcgtcaacgcgaccagctcacctcgtcatctcccattctctttcatatttgcatgcatctcggttctcggatctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgactaccaggactacaccccctgcaccgaccccaagcgctggcggaggtacggcaactaccgcctcagcttcatggagcggcactgcccgccgccgcccgaccggcagcagtgcctggtgccgccgcccaaggggtacaagccgcccatccggtggcccaagagcaaggaccagtgctggtaccggaacgtcccctacgactggatcaacagccagaagtccaccagcactggctcgtcaaggaggggcgacgcttccgggttccccggcggcggcacatgttccccaacgggcgtnggcgcgtacgta

SEQ ID NO: 85528 - protein, 197 aa, Zea mays
  misc_feature: Ceres CLONE 1571871
MKYSKEDKPERAGGAGAGSRAVPVALVVVVLCAFSFYLGGIYSTGRSLLDSIQPAPTALLALGAATTTRRPSDDGQARPALASTAAVAFPECPADYQDYTPCTDPKRWRRYGNYRLSFMERHCPPPPDRQQCLVPPPKGYKPPIRWPKSKDQCWYRNVPYDWINSQKSTSTGSSRRGDASGFPGGGTCSPTGVGAYV

SEQ ID NO: 85529 - DNA, 809 bp, Zea mays
  misc_feature: Ceres CLONE 1571872
  misc_feature: Encodes the peptide sequence at SEQ ID NO. 85530
ccccgcggtggcggccgctctagaactagtggatcccccgggctgcaggaattcgtctcacccctagaaaaacgctccaggctctcgtttcctggtaggcgctggtacaagcggaagcagcagtagcgtgaggcatccccatgccgggggcaatctcttcctcgtcgtcggcttttctcctccccgtcgcgtcctcctcgccgcggcgcaggcggggcagtgtgggtgctgctctgcgctcgtacggctacagcggcgcggagctgcggttgcattgggcgcggcggggcccgcctcaggatggagcggcgtcggtacgcgccgcagcggcaccggccgggggcgaaagcgaggaggcagcgaagagctcctcctcgtcccaggcgggcgctgttcagggcagcacggccaaggctgtggattctgcttcacctcccaatcctttgacatctgctccgaagcaaagtcagagcgctgcaatgcaaaacggaacgagtgggggcagcagcgcgagcaccgccgcgccggtgtccggacccaaagctgatcatccatcagctcctgtcacaaagaaagatcgatgccagtgcgggggaagcagaagcccgcaggtgatgatgctagacccgtgggaagcataggcatccctgaaccgggtggatgctaaagctgaatgcacctcccgcttacaaatgcggcgggaaatgctccctattgaacgggaagaataaagaaccctggccctttgggctggggctaaatggaaagaaaccccctccggggggggcttccaaaaatggccccccttt

SEQ ID NO: 85530 - protein, 166 aa, Zea mays
  misc_feature: Ceres CLONE 1571872
  misc_feature: SWISSPROT Homolog: EC 2.4.1.21 Starch synthase
MPGAISSSSSAFLLPVASSSPRRRRGSVGAALRSYGYSGAELRLHWARRGPPQDGAASVRAAAAPAGGESEEAAKSSSSSQAGAVQGSTAKAVDSASPPNPLTSAPKQSQSAAMQNGTSGGSSASTAAPVSGPKADHPSAPVTKKDRCQCGGSRSPQVMMLDPWEA

SEQ ID NO: 85531 - DNA, 960 bp, Zea mays
  misc_feature: Ceres CLONE 1571875
  misc_feature: Encodes the peptide sequence at SEQ ID NO. 85532
  misc_feature (197)..(197): n is a, c, t, g, unknown, or other
  misc_feature (367)..(367): n is a, c, t, g, unknown, or other
tggcggccgctctagaactagtggatcccccgggctgcaggaattcgtctcacccctagaaaaaaccccagctcactcgtgccgtgcactcgtcccgtccccctccaccctccaagacctcgcattgccaccgccgccgccgagccaggggagaggagagaggccagcctcgtcgcggcgggcggaggaggaggacnagcggtagagcggagcgagccggccgggcaggatgttcgggcgggatccctggggcgggccgctggagatctccgagggcgactcggcgactgactactaccgcagccccgacctggaccgggcggcgctgattgtgcccccccccccaaagggggggggggggggggcntgtccgggccccgctaaccattaccggaaaaaaaaaaaaaccggtaccttcgactgcggggtggggctggggtcctaaccgcaaggtctttcatggtgggacggccccgggccgtcccccgcgggctcgggggaccctcaccgcgggttcgcgtagtcggggggtgaggagaggtgcgggggttgtgaaaagggtcgccccaggtagggctggacgtgtacagaattaggtatgtaggaaagggtgcactccaacgccacgggggtggacggagggtgtcgtcccaagaaacggctcagtactccctgggctgcgaggtgttgttaaagaaagagagagagcgcgttcgtcggcttggagaggcgctgcacagtggcggcatggtgggaaggtgtccagcgtcggccgttctgtcctcagctgctcctggaccgggtgggaggggggggggggtggtcgcgcgtgccgtgacgccggggcccgcacggggctagggcgcgaaggccggcgcccgggagcggccgcctgtggacgtctgcgtgtgtgacgggatagcggcacaatagcggatagccgggagtaagaagaagaaa

SEQ ID NO: 85532 - protein, 71 aa, Zea mays
  misc_feature: Ceres CLONE 1571875
  misc_feature: SWISSPROT Homolog: EC 3.2.1.4 Cellulase
MFGRDPWGGPLEISEGDSATDYYRSPDLDRAALIVPPPPKGGGGGACPGPANHYRKKKKTGTFDCGVGLGS

SEQ ID NO: 85533 - DNA, 1034 bp, Zea mays
  misc_feature: Ceres CLONE 1571876
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (66)..(66): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
nnnnnnnnnnnnnnnnnnnnttaaaacaacatcttaaggtaggacagaggcgggagagtggaattnttattnnnnnnnnnnnnntggaactccccgcggtggcggccgctctagaatagtggatcccccgggctgcaggaattcgtctcacccctagaaaaagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtgggcaaaagtctagcagtagtcgttccatgatgtatgaagctcccctttggctacagcatttgaggacgtttcgacttgcccggagggcgtgaaaaaagttccaggtcttgctgcttacctccaactgggcccgaaagaagcccttcctggaattcccctttttgggcttccctccattcccaagaaggtttaaggaatttcctttttcctgaaactttttgaatttctgaaaccaatctttctttgggggcctggggggggtttcccgggaaaaaaaccgaaccccgattttcccccccagtcctgtggccccccctttggagaaaccccttcccccccccccaaatattccaaaaaatttgtggggtttctgaaattcccccccgggcccccacaagggggggggggttctttttctgggcgggcgggaaaggggctctccccccggggcctccaagacatatttgggggtttttgggggggggattaaaaaaaaaacccccctctaaaaagaaaccaaatttctctggaggaggacccttgtttttttttgggagcccccccccagggggggggggggtttttccgggggccccctcccca

SEQ ID NO: 85534 - DNA, 795 bp, Zea mays
  misc_feature: Ceres CLONE 1571879
  misc_feature: Translation starting site: 139
ggagctcaccgcggtggcggccgctctagaactagtggatcccccgggctgcaggaattcgtctcacccctagaaaaaaccactcccttctcgcgacctcagaatctcacggcatcacgcgaagcaaggagaaagaaaatggcgcagctggtggagacgtacgcgtgctcgccggcgacggaacgcggccgtggaatcctcctggccggggaccccaagacggacacgatcgcctactgcaccggccgcagcgtcatcattcgccgcctcgatgcgcccctcgacacttgggtctaccccgaccacgcctaccccaccaccgtcgcccgcttctcccccaacggcgagtgggtcgcctccgccgacgcctccggctgcgtccgcgtctggggccgctacggcgaccgcgcgctcaaggccgagtttcgccccctctcgggacgcgtcgacgacctccgctggtccccggacggcttacgcatcgttgtctccggggacggcaagggcaagtccttcgtccgcgcattcgtatgggactctggcagcacagttggtgagtttgatgggcactcaaagagggttctgagctgtgacttcaagccaacacgtccatttcgcattgtgacatgcgggtgaagattttctggcctaacttttatgaaggaccgccattcaaattcaagcattccataagggatcactcgaattttggtaactgtatccggtatgctcctgatggtagtaagtttatcactgtgagttctgaataagaagggttggatatatggagggaat

SEQ ID NO: 85535 - DNA, 866 bp, Zea mays
  misc_feature: Ceres CLONE 1571880
  misc_feature: Translation starting site: 665
  misc_feature: SWISSPROT Homolog: EC 3.1.1.11 Pectinesterase
  misc_feature (866)..(866): n is a, c, t, g, unknown, or other
ggagctccccgcggtggcggccgctctagaactagtggatcccccgggctgcaggaattcgtctcacccctagaaaaaataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgaccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggagcggctggccatcaacgactgcctggagctgctgtcaccaccaaaggacgagctccgcgccagcaccgacgacctggcgtcccctgccggcagggggtcggcgtcggcgggcgtgtcccaggaggcccaggggccccacaatggagcaccttaatgaaggggctttccggggggcctccccaaccaggtaaccttgcctcaacaggtttccccgaaccaaaagccggcgggcgcggggcgggccctaccttcgaggccgacctttcccaccacctgtgtccccccaaggggaaagaaaattcccctgggcccttggggccaaagaaagatttccccggggcccccgggggcgctn

SEQ ID NO: 85536 - DNA, 905 bp, Zea mays
  misc_feature: Ceres CLONE 1571883
  misc_feature: Encodes the peptide sequence at SEQ ID NO. 85537
gcggtggcggccgctctagaactagtggatcccccgggctgcaggaattcgtctcacccctagaaaaaaggagtacacacttctccttagaattggagctgtacgagccacccagcaactttcttcatcatcttcttcagctctctctctgtccgtcgacacaccaagctagccatgcaggaggagtaagggtacaaccgtagaagagagagagagagagagagagctaacaccacccaccactgtccctagctagcttatttacaggcgttcgtgatcaccaacagcttctcgtcagaaagagtgcaacgggccggccgggcagaagaggtagctgggagctagagagaaaaaaagggtgcaccgagcaacctcaggccagggaggaagggaggagtgagccatcagtcgaccgtttccggcgaactcacaggcagatggcaggcggcggattcgtggaggacatgatgagggagcagagcctcctggaggcgacgtgcggcgacctcttcgaccacatcgacgacctcctcgacttccccaacgaggaatcggccgccgccgtgctcctcctggaacccccggggccccggaagcccgcttgttcggggccattcatcgaagttcgggccgcgcccgggaaatgggctcggtcccggcctgggtgccccccacgcaaaaacaacgctttccggttagccgcctttctttcgcccgccggcgggggaaaaaaatttttttcccacacccaaagggacttttttctggggcaaaaaaatttgggctctgggggggaacgaaaattttaaaacttggaaaatggggggccaacctcgggagagtgggcttttgtcggggggttttctttctaaaaaaaaagccctttccaattccccgggaagaaa

SEQ ID NO: 85537 - protein, 123 aa, Zea mays
  misc_feature: Ceres CLONE 1571883
MAGGGFVEDMMREQSLLEATCGDLFDHIDDLLDFPNEESAAAVLLLEPPGPRKPACSGPFIEVRAAPGKWARSRPGCPPRKNNAFRLAAFLSPAGGGKKFFSHTQRDFFLGQKNLGSGGERKF

SEQ ID NO: 85538 - DNA, 850 bp, Zea mays
  misc_feature: Ceres CLONE 1571889
  misc_feature: Encodes the peptide sequence at SEQ ID NO. 85539
agctcaccgcggtggcggccgctctagaactagtggatcccccgggctgcaggaattcgtctcacccctagaaaaatggcctcctgcgacgacgacttcgttctcctcggtgacgacgcacaccagccggcaactccgccacccccggcccccaccgcgcagcaacccgcgccgccgccgccgccgccacaggcctcccatcccttcagcttcactgacgcggttgcgggggctgccgccggcgccggctccttcgcgcaggcccaggaggagagcaaccaccacgccgagcgcggcaagccggagcaccacgccaagcggggcagggagcgcgccgaggagttcagcagcgatgggggcgagtactgttcctatatcaacagcagcggcagcggcggtggtgggaagaagggccgtggcggtggagggagctcgagcgtgtcagactaccgtaaggatcgggaggagtggacggacggcgcgatcagcagcctcctcgacgcctacacggaccgatttgagcagctcaaccggggaaacctgcggggtcgggactgggaggacgtggccggcgccgtgaccgacgggcagggcaagactaccggggccaagagcgtggagcaatgtaagaataagatcgacaatcttaagaaaacgtacaagggtggagtgccagcgggctctccagtccggggcggggggtgccatcagcccactggccctgggtcaaaaagatgggagcagaatcgtgggaaaactcgcatctcctggcctcctcaagcttctaactggtgcccgaggatgaagaaaccgaggcagcagcagcagcacagcaggcaaaggtatccta

SEQ ID NO: 85539 - protein, 258 aa, Zea mays
  misc_feature: Ceres CLONE 1571889
MASCDDDFVLLGDDAHQPATPPPPAPTAQQPAPPPPPPQASHPFSFTDAVAGAAAGAGSFAQAQEESNHHAERGKPEHHAKRGRERAEEFSSDGGEYCSYINSSGSGGGGKKGRGGGGSSSVSDYRKDREEWTDGAISSLLDAYTDRFEQLNRGNLRGRDWEDVAGAVTDGQGKTTGAKSVEQCKNKIDNLKKTYKGGVPAGSPVRGGGCHQPTGPGSKRWEQNRGKTRISWPPQASNWCPRMKKPRQQQQHSRQRYP

SEQ ID NO: 85540 - DNA, 827 bp, Zea mays
  misc_feature: Ceres CLONE 1571893
  misc_feature: Encodes the peptide sequence at SEQ ID NO. 85541
ggagctccccgcggtggcggccgctctagaactagtggatcccccgggctgcaggaattcgtctcacccctagaaaaaccgtcgccccggcctcctcggtccagagacgagggggtccgcgccgttccgacgccacaccgcaaccgcatcacatcaccgcctgctcccaccgtccatccgccctccctcgatcgcgctccccggatcgctggtacctccgcgcgcggctccgacctcatcttcctccatcgactggcatcggcagcggcggcgtgttcccggccaaccttcgaaagggtaatcaatcgccagacttttgggagctgtgttgggggggaccggggggaagagccaagttactgcagaggctaacatttcggttgtcgagtgatggcgcaaggcatcaacttccctgacttcatcggcgccgtgggtggccatgatggtggcgtggactttggtgggaacttctgtgacatggccttctaccagaagctaggggagggcaccaacatgtcggtcgacagcctcaacagcatgcagaccagcatgcatggggggtccatcgccatgtctgtggacaacaacagcagcgttggctctaacagtgactcccgcactggcatgcttggtcatcctggtctcaaggggcctgccattgtgggaagctactcagttgggcacagcatcttccgccctgggccgggtgtcccatgcctggagtggagatgcgctggcacatgctctgatgggacataaaagtccaactgagacactcagggaatatgaggagtggactatggatctgggggaagctcaccttggga

SEQ ID NO: 85541 - protein, 122 aa, Zea mays
  misc_feature: Ceres CLONE 1571893
MAQGINFPDFIGAVGGHDGGVDFGGNFCDMAFYQKLGEGTNMSVDSLNSMQTSMHGGSIAMSVDNNSSVGSNSDSRTGMLGHPGLKGPAIVGSYSVGHSIFRPGPGVPCLEWRCAGTCSDGT

SEQ ID NO: 85542 - DNA, 800 bp, Zea mays
  misc_feature: Ceres CLONE 1571896
  misc_feature: Encodes the peptide sequence at SEQ ID NO. 85543
ctccccgcggtggcggccgctctagaactagtggatcccccgggctgcaggaattcgtctcacccctagaaaaacaacccagtccacacgagacgaaacgaccgagcccatccctccctccctcccgtcgccttcgccaaccctagcctagcctcctcctcctcctcccgcggatccaacctccgcccgcccgccgccgccgagagagccctatctcccccacgccgcggtctccgcgcaagcgggggcaggggacgcggatcccgcagctccccgccatctccggaacggccatggaggtggcggcggctgccgcagggaagccgctgacgccggaggaggaggcactccggcgcagcaccgactgcgtctacttcctcgcctcgccgctcacctgcaagaagggtaatgaatgcgattttcgtcacagtgagggtgctaggatgaaccctagggactgttggtactggttgaatggcagttgtttgaatcccaagtgtgcatttcgccatccgccaattgatggtctctttggtgccccaacttctggactacctccagtttctgcgcactacggtgcctataacttgggcaagcagatggtcccatgctattacttccagaaagggaactgcttgaagggtgatagatgccctttctatcatggaccacaaacagctagtaatgatcttgcagagcaagcggcgaaggtttcttcctttcctttggaaccgtcccaggctcaaaataacgaagaagctgtagctccaaataattcacgcagcaaggagcccggatga

SEQ ID NO: 85543 - protein, 168 aa, Zea mays
  misc_feature: Ceres CLONE 1571896
  misc_feature (101)..(126): Pfam Name: zf-CCCH Pfam Description: Zinc finger C-x8-C-x5-C-x3-H type (and similar)
MEVAAAAAGKPLTPEEEALRRSTDCVYFLASPLTCKKGNECDFRHSEGARMNPRDCWYWLNGSCLNPKCAFRHPPIDGLFGAPTSGLPPVSAHYGAYNLGKQMVPCYYFQKGNCLKGDRCPFYHGPQTASNDLAEQAAKVSSFPLEPSQAQNNEEAVAPNNSRSKEPG

SEQ ID NO: 85544 - DNA, 856 bp, Zea mays
  misc_feature: Ceres CLONE 1571898
  misc_feature: Encodes the peptide sequence at SEQ ID NO. 85545
  misc_feature (726)..(726): n is a, c, t, g, unknown, or other
ctccccgcggtggcggccgctctagaactagtggatcccccgggctgcaggaattcgtctcacccctagaaaaaacaccagtccaccagcgccctgttgatcttccccaagagccggaacccactcaacaccacgtcctccactttcttcgtctagatagttcaaccccacctcctctcttcctcgacacgcacagcaaccacgccaagctcgacccgtcgcccagcggtctgcactaggagcctgcgcccggagttccgtccgcgacgtgctcatcccgccgtcgacggtcatcgtgagcagatatcgggccgttcgtggagtctgagggaattgcaggagaagaccctgagcagcagcagcttggtgaaggttgtccacattgcaaccactgctcaggagaagatgaagctgtggaaggagacttccaggagttccgagactacgacgagtcctagggtgtgggttggcgggcaaccccagtcagctgcctgtgaaggccctatctttactgcgtttcgcttagcactttgaattacccattgagtggatgactatgtggatgtctctgaactcgtgatgaaataagtaaaaactcttctatggttattattcgagcactaaaaaaaaaaaacttggcggggggtctctcctggcaagggaagaaaacaccggcccgaaaactaaaacagggggaacttccaaatggccgaaaggggaagaaancccctctcccgggggcccgccggggccgccattaaaaaactacccgaaagaagctggctccactggcgggggagttagaagtcccggggtttgggcccctgggagagaaaaaacctttaaaaaactggaa

SEQ ID NO: 85545 - protein, 42 aa, Zea mays
  misc_feature: Ceres CLONE 1571898
MKLWKETSRSSETTTSPRVWVGGQPQSAACEGPIFTAFRLAL

SEQ ID NO: 85546 - DNA, 822 bp, Zea mays
  misc_feature: Ceres CLONE 1571899
  misc_feature: Encodes the peptide sequence at SEQ ID NO. 85547
ctccccgcggtggcggccgctctagaactagtggatcccccgggctgcaggaattcgtctcacccctagaaaaagtctcgcgctctcgtttcgtcgctacgctagcttccagtcccgggcttagcaactgtgctgctgttgcactgcacccggcgcacgcagagatgcgccgtgtcgggacgggtgtgaggatgctttgcggcgcggcgctgtcggtgcttctgcttctcgcgggcggcgcggcggcgtcgcactcgcgctcgtcgtgccccgccacgccgccggacgcggggaacacgctgcaggtgtcgcacgcgttcgggccgtgctcgccgctgggccccgggacggcggcgccgtcgtgggcggggttcctggcggaccaggcgtcgcgtgacgcgtcgcggctgctgtacctggactcgctggcggtgcgtggccgcgcccgcgcgtacgcgcccatcgcgtcggggcggcagctgctgcagacgctgacgtacgtggtgcgggccagcctcggcacgccgccgcagcagctgctcctgggcgtcgacaccagcaacgacgcctcgtggatcccttgcgccggctgcgcgggctgccccacgtcgtccgcggcgcccttcgaaccggccgccgtccgctcgtaccgcacggtgccctgcgggtcgcccgctgtgcgcgcaggcacccaacgcggcgtgcccgcccggccgcaaaggcttgcggtttcgccctacctaacgcgactcctccctgcaggccgggctgttccaagactccctcgccgtcccaaggaaacgccgtgaaggcctacaccta

SEQ ID NO: 85547 - protein, 214 aa, Zea mays
  misc_feature: Ceres CLONE 1571899
  misc_feature: SWISSPROT Homolog: EC 3.4.23.12 Nepenthesin
MRRVGTGVRMLCGAALSVLLLLAGGAAASHSRSSCPATPPDAGNTLQVSHAFGPCSPLGPGTAAPSWAGFLADQASRDASRLLYLDSLAVRGRARAYAPIASGRQLLQTLTYVVRASLGTPPQQLLLGVDTSNDASWIPCAGCAGCPTSSAAPFEPAAVRSYRTVPCGSPAVRAGTQRGVPARPQRLAVSPYLTRLLPAGRAVPRLPRRPKETP

SEQ ID NO: 85548 - DNA, 919 bp, Zea mays
  misc_feature: Ceres CLONE 1571901
  misc_feature: Translation starting site: 224
  misc_feature (48)..(48): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (156)..(156): n is a, c, t, g, unknown, or other
  misc_feature (181)..(181): n is a, c, t, g, unknown, or other
  misc_feature (194)..(194): n is a, c, t, g, unknown, or other
  misc_feature (201)..(201): n is a, c, t, g, unknown, or other
  misc_feature (202)..(202): n is a, c, t, g, unknown, or other
  misc_feature (233)..(233): n is a, c, t, g, unknown, or other
  misc_feature (891)..(891): n is a, c, t, g, unknown, or other
tggagctccaccgcggtggcggccgctctagaactagtggatcccccngggctgcaggaattcgtctcacccctagaaaattnnnnnannnnaaaaaaaaaaaaaaaaaaaaaaaaaaaatttaaactcacaacacggtagcagggggtggtagtnagaaggcataagcttctgttctctngaccctcaagtgntttgagnncctatttgcgcaacgaaaaaaatgagcatcnaaaagcatttaatgggaaagagccccatagtggttggaccttggggagggacagagggtacccccttggagacggcgtgtactcacaatacgccagatcgtgattggccatggtgcacctattgactcaataaggattgaatttgatctgaaagggaaggtccgttttggttcaaaaaacccctgggagggtccctgaatggggggcctccccaaaaacaaaaaaaagggggggaaaaaactataatttttctcccaaaaataaaaagacccccccccggggtgttttgtaaaaaaggggggagaacccccctcacggggattttttttttttttcctcgggggggaggaaaaaacacccccgggggtttctttttttttttataaaaaaaaaaaccttctttttagaaaaaacattttttctacaacaaaaaaaaaaaaaaaaaaaaaattttttcttaaagaattttttatggggggagcccccccttttttttgtggggcgccccccccagagggagagaggggggggccgacacccccccctttttttttcccccccccccccccccccacccttttataaacaaagaggggggggaaaaaaaaaaaaaaaaatgtgggggggaaatatctccccccccggggggggggggggnctttgtgggggggcactacaaaattata

SEQ ID NO: 85549 - DNA, 839 bp, Zea mays
  misc_feature: Ceres CLONE 1571904
  misc_feature: Encodes the peptide sequence at SEQ ID NO. 85550
  misc_feature (708)..(708): n is a, c, t, g, unknown, or other
  misc_feature (839)..(839): n is a, c, t, g, unknown, or other
ctggagctccccgcggtggcggccgctctagaactagtggatcccccgggctgcaggaattcgtctcacccctagaaaaagaacgccatccgttccatttcttatcccctcctcctcccagtcccagccatcgcctcccgatggcgtccctcgtcacgctccccgccatcgccttctctaaccccgccacagcctccggcgctgtccgcctacgcgccgcggccttccgctgctgggcgctccggcggcgcgggtgggcggtggcggctgccgtggcctcgcccaactccgtgctcagcgagcacgccttcaagcggctccagctcgggagtgacgacgaggacgaagaagggccgtacgggagcgacgccgacgaggggttccagggggacgaggaggagctcgccattgccaggctcggcctgcccgacgagctcgtcgccacgctcgagaagcgcgggattacgcacctgttccccatacagagggctgtgttgattcccgctcttgagggccgtgacctgattgctagagcaaagaccggaaccggaaagacacttgcctttggtattcccatgatcaaaaaattaatgggagcagacgatggtcggagtacaaggcgaggtcgtactcctcggggtctggttctagcacctaccagagagttagcccaaacagttgaggaagaaataaagggatcagcacccnagctttggcacgggtgtgtggtaatggcgggtgtctcatataatgtccaggcagatgcacttctcccgtggtggttaaagttgttgtttggcaaacctgggcgcataattggatttgaataagtggtggan

SEQ ID NO: 85550 - protein, 229 aa, Zea mays
  misc_feature: Ceres CLONE 1571904
  misc_feature (112)..(230): Pfam Name: DEAD Pfam Description: DEAD/DEAH box helicase
  misc_feature (190)..(190): Xaa is any aa, unknown, or other
MASLVTLPAIAFSNPATASGAVRLRAAAFRCWALRRRGWAVAAAVASPNSVLSEHAFKRLQLGSDDEDEEGPYGSDADEGFQGDEEELAIARLGLPDELVATLEKRGITHLFPIQRAVLIPALEGRDLIARAKTGTGKTLAFGIPMIKKLMGADDGRSTRRGRTPRGLVLAPTRELAQTVEEEIKGSAPXLWHGCVVMAGVSYNVQADALLPWWLKLLFGKPGRIIGFE

SEQ ID NO: 85551 - DNA, 834 bp, Zea mays
  misc_feature: Ceres CLONE 1571905
  misc_feature: Encodes the peptide sequence at SEQ ID NO. 85552
  misc_feature (558)..(558): n is a, c, t, g, unknown, or other
  misc_feature (688)..(688): n is a, c, t, g, unknown, or other
ggagctccccgcggtggcggccgctctagaactagtggatcccccgggctgcaggaattcgtctcacccctagaaaaagccggccggaccacccagagccagaagcgcgtcgccagccaactatcgccgctgataaccaacccaatccaacctaacccaaccctgctctctgccgacgcggattcgaatccgaggacgatcgatgacggtgggcgccggcatcgccgtccaggacggcagcctcctggcgctgggcgccaaggtcctgcgggaggtgcgcggcaacgtgctcgtgacgccggccgccggcgggggcctaaccaacggcgcgttcctcggcgtccggtccgcgcccgccgccagccgcagcatcttccccgtcgggaagctccgggaccagcggttcgtgtgcacgttccggttcaagatgtggtggatgacgcagaggatgggctccgcaggccgcgacatcccctccgagacgcagttcctgctggtggaagggtccggcggcggcgagcagcccgtcgtgtacaccgtcttcctccccgtgctggnaggctcgttccgtgcccgtcttcaggggaacgccgccgacgagctggagatctgcctggagagcggcgacccggacgtggaatctttccaggctcccatctggtcttcgttggcgccggatcggacccgntcgaggtcatcacaggttcagtcaaggctgtcgagaggcactttgcagacgttctctcacagggagaagaaaaagatggcagaaattctgaactgggtttggctggggcaccttgggacccctttctacacaaatgtcaccgcccc

SEQ ID NO: 85552 - protein, 210 aa, Zea mays
  misc_feature: Ceres CLONE 1571905
  misc_feature: SWISSPROT Homolog: EC 2.4.1.67 Galactinol--raffinose galactosyltransferase
  misc_feature (119)..(119): Xaa is any aa, unknown, or other
MTVGAGIAVQDGSLLALGAKVLREVRGNVLVTPAAGGGLTNGAFLGVRSAPAASRSIFPVGKLRDQRFVCTFRFKMWWMTQRMGSAGRDIPSETQFLLVEGSGGGEQPVVYTVFLPVLXGSFRARLQGNAADELEICLESGDPDVESFQAPIWSSLAPDRTRSRSSQVQSRLSRGTLQTFSHREKKKMAEILNWVWLGHLGTPFYTNVTA

SEQ ID NO: 85553 - DNA, 831 bp, Zea mays
  misc_feature: Ceres CLONE 1571906
  misc_feature: Encodes the peptide sequence at SEQ ID NO. 85554
gctctagaactagtggatcccccgggctgcaggaattcgtctcaccccctagaaaaaaccatcccagtcccaatctggcaatcccatcctccctaccccgtcccccctcctccccgcgcgaccagcgccctcgcacccgcggacgcatgcgaggccacaccgcgcgtagcccccagtagcaaccccgcccggcaatgtcggcgccccactcggcgccccaccacccatccctccccgccggggacgccaagaagcagccacacctcggggccgaccccagcaagaaggcctcctgcttcggcggcgggggcgaccaccaccccaagaagcccggcccctccgcagcgaagctcgcgctcgcgtccttcctcggcgtcatcatcctcctcgccgccgacgcctcccttaccggcgccggcgcgcaccgccgcctgcggcagcagtacctgcattacgtcggcgttggcgtcggcgtcggcgttggaggcggaggaatcaccgactcgctctcgtggctctccgtggcggaccgccccaacttcaccgacgacctactcgcggcgtggctcgcgcccggggggttcccgtgccgggacgcgcgcacggcgaacatctccggggaggttcttgacgacccccccggcgaggggggaagggaaccactctcggggccgggggaaatccccaagggtccctttctggggccctgggaaaaaggttgggcagccccccctgccctcggggggggaactaattcaaggggcaaccttctccggggaacccctgggaaaatcccgggccccccccatcggggggaacaccggggaccgg

SEQ ID NO: 85554 - protein, 212 aa, Zea mays
  misc_feature: Ceres CLONE 1571906
MSAPHSAPHHPSLPAGDAKKQPHLGADPSKKASCFGGGGDHHPKKPGPSAAKLALASFLGVIILLAADASLTGAGAHRRLRQQYLHYVGVGVGVGVGGGGITDSLSWLSVADRPNFTDDLLAAWLAPGGFPCRDARTANISGEVLDDPPGEGGREPLSGPGEIPKGPFLGPWEKGWAAPPALGGGTNSRGNLLRGTPGKIPGPPHRGEHRGP

SEQ ID NO: 85555 - DNA, 888 bp, Zea mays
  misc_feature: Ceres CLONE 1571907
  misc_feature: Encodes the peptide sequence at SEQ ID NO. 85556
  misc_feature (345)..(345): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (514)..(514): n is a, c, t, g, unknown, or other
  misc_feature (564)..(564): n is a, c, t, g, unknown, or other
  misc_feature (565)..(565): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (680)..(680): n is a, c, t, g, unknown, or other
  misc_feature (681)..(681): n is a, c, t, g, unknown, or other
  misc_feature (888)..(888): n is a, c, t, g, unknown, or other
ctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgttgcgcgcgtcatcatgttgctagtaaacgggacggcgggcagctgaggagtaaacgagagagatcgagagagaaagaaagggagggcatccaccagccgcggncgataagaggggaggagaagaggcccagagaagaggaggaggagaagaagaagatgagcagctgccctctgccttccgaaaaaaaaggagggggcagcgaaaagagaagccgtccacagatacccccaccctcgtcactcccttcagaaccagaaagccctcnnnncanttccccccctcccctcccaaggtttcttccaaggggatggggacccaccnnctcaagcgctttaaaaaaagggggttcccaaaatctaagaacccaaagtctttgaacaaaaannncccggaacctggtccgagccctcttcaaagtccggccagagccccagggnnaccatgggggtttgcctgctcccaactcccgcctggtgccccttcggggaacccgacgggctgcaaccccggggaggcctttcaccggtccgcaaacatcggcctccacggggtcccacctacgaaacagaatcaagtacgccggcaacagggtccggccatcaaagtacgcccgtgtgcgccccctcaaagtggcaaggtcatccn

SEQ ID NO: 85556 - protein, 56 aa, Zea mays
  misc_feature: Ceres CLONE 1571907
MYTLPVRATTSSIVASLATPAPSSSSGSGRPRLRLIRNAPVFAAPATVVLRASSCC

SEQ ID NO: 85557 - DNA, 823 bp, Zea mays
  misc_feature: Ceres CLONE 1571908
  misc_feature: Encodes the peptide sequence at SEQ ID NO. 85558
agctccccgcggtggcggccgctctagaactagtggatcccccgggctgcaggaattcgtctcacccctagaaaaaatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcagcaggggacgacgacttcgccttctactactcctacctccaggacgccgacgccgccgccgcctcagcgacgtcgacgctcgccctcgccgtcgacgaccccaaccccagcgccgcaggggatgacgaaacggccggcgccggaagcagcgcggggcagaggacgcccggagccgccagggaaagtgaggaggcggccaagaaagacggcaaagaagcggtccatcgccaagctgctcacctcgctggcggcgctggaggcggaggagcacgccgaccgcgcgggcgccgcggacgcgtccaggcgggagctggcgctgctcgagtccaacgccgacacccgctcgcaggccaccatggactactacgcccaagatggagagcagcttcgacgccaacggcgaggtcgaggccggccgccagttcaagcgctcagggctcgccgcgtcggcgccaccggggccgtcgtggca

SEQ ID NO: 85558 - protein, 117 aa, Zea mays
  misc_feature: Ceres CLONE 1571908
MTKRPAPEAARGRGRPEPPGKVRRRPRKTAKKRSIAKLLTSLAALEAEEHADRAGAADASRRELALLESNADTRSQATMDYYAQDGEQLRRQRRGRGRPPVQALRARRVGATGAVVA

SEQ ID NO: 85559 - DNA, 836 bp, Zea mays
  misc_feature: Ceres CLONE 1571910
  misc_feature: Encodes the peptide sequence at SEQ ID NO. 85560
ggagctccccgcggtggcggccgctctagaactagtggatcccccgggctgcaggaattcgtctcacccctagaaaaaccgctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgccgggggatccaccgctgaccttaccctcgaaatcgccaaccgtatgcagaacatggtgtgtgtggaaaccatgatgcacctgacatgtacaaacatgccagtagagaagattgaccatgccttggaaaccatcaaatccaatgggattcaaaatgttttggccctcagaggggatcctccacatgggcaagacaaatttgtgcaagttgaaggcggatttgcttgtgctcttgatttggtgcagcatattagagccaagtacggtgattattttggcataactgtagctgggtatccagaggcacaccctgatgcgatacaaggtgaggcaggtgctacattgggagcatatagcaatgattctgcgtacttgaaaaaaaaggttgatgctggtgctgaacctttttgttaccccacttttctatgataccgacatcttttctcaagtttgtgattgaccgccccccaaatgggaattacttggccccttgtgtcctgggcatattgcccaataaataacctccaaaggc

SEQ ID NO: 85560 - protein, 196 aa, Zea mays
  misc_feature: Ceres CLONE 1571910
  misc_feature (6)..(197): Pfam Name: MTHFR Pfam Description: Methylenetetrahydrofolate reductase
  misc_feature: SWISSPROT Homolog: EC 1.5.1.20 Methylenetetrahydrofolate reductase (NAD(P)H)
MKVIEKILEAAGDGRTAFSFEYFPPKTEEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEAGATLGAYSNDSAYLKKKVDAGAEPFCYPTFL

SEQ ID NO: 85561 - DNA, 842 bp, Zea mays
  misc_feature: Ceres CLONE 1571911
  misc_feature: Encodes the peptide sequence at SEQ ID NO. 85562
aaagctggagctccccgcggtggcggccgctctagaactagtggatcccccgggctgcaggaattcgtctcacccctagaaaaagccgcgccggcttcatcactctttcttcctcttcttcttcttcttcacacaagcgtgctccttctgctcttgtgctaagtagctagctcacaacagaagaggacgagagaaagcaaggcggcggcggcggcggctgcggcagcaacaacatacaccgccggccgcgtggcgccatgggcatcctggaccacatgtcgcatgtgtgcagcatcacggagacgaaggaggcgctcaagctcaggaagaagcgaccgctgcaggtactgcttgccttaattatatatatttaatttcctcccatgcatgcatgcatgatgaattttgatgcatgggatgggcggggtacggcggcggcggcggtggttgcagacggtgaacatcaaggtgaagatggactgcgaaggttgcgagcgtcgcgtgaagagcgcggtgaagtcgatgcgcggcgtgacgagcgtgacggtgaacgcgaagcagagcaagtgcacggtgaccgggtacgtggagcccgccaaggtgctggagcgcgtcaaggccaccggcaagaacgccgagatgtggccctacgtgccctacacgctcaccacctacccctacgtcggcggcgcctacgacaagaaggctcccgcgggcttcgtccgcagcgcgccgcaggccatggaagaccccagcgctccggaagtcaagtacatgtccatgttcagcgacgaggacgtcaacgcctgcacagtcatgtgatgcatgcatatgtatagtct

SEQ ID NO: 85562 - protein, 134 aa, Zea mays
  misc_feature: Ceres CLONE 1571911
  misc_feature (15)..(75): Pfam Name: HMA Pfam Description: Heavy-metal-associated domain
  misc_feature: SWISSPROT Homolog: EC 3.6.3.4 Copper-exporting ATPase
MGGVRRRRRWLQTVNIKVKMDCEGCERRVKSAVKSMRGVTSVTVNAKQSKCTVTGYVEPAKVLERVKATGKNAEMWPYVPYTLTTYPYVGGAYDKKAPAGFVRSAPQAMEDPSAPEVKYMSMFSDEDVNACTVM

SEQ ID NO: 85563 - DNA, 927 bp, Zea mays
  misc_feature: Ceres CLONE 1571912
  misc_feature: Encodes the peptide sequence at SEQ ID NO. 85564
ccccgcggtggcggccgctctagaactagtggatcccccgggctgcaggaattcgtctcacccctagaaaaagcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgccgggggatccaccgctgaccttaccctcgaaatcgccaaccgtatgcagaacatggtgtgtgtggaaaccatgatgcacctgacatgtacaaacatgccagtaacagaagattgaccatgccttggaaaccatcaaatccaatgggattcaaaatgttttgggcccctcagagggggatcctcccacatggggcaaagacaaattttgtggcaaggttgaagggccggattttgcttgggggctctttgaatttgggggcacccatattaggagccccagatccgggtgaatttttttttgggcaaaaacctgggtagcctgggttgatttccagaaggccccccccccctgggttgccgaatacaaaggggcgaaggggaaggtgccttacatttgggaaaggcttttttgccaatggaatttttgccgtacttttaaaaaaaaaaagggttgaaacctgggtgcttgaacctttatttgtgtacccaaactttttttcttgtgatcccgaccttcttttttctaaatttttgtgaaaggcccgcgcgccccaaaatgggttattaaaatgaggcccaagtattcctggggagatatggcatataaatcacctcccagggttttctcgccgccg

SEQ ID NO: 85564 - protein, 92 aa, Zea mays
  misc_feature: Ceres CLONE 1571912
  misc_feature (6)..(91): Pfam Name: MTHFR Pfam Description: Methylenetetrahydrofolate reductase
  misc_feature: SWISSPROT Homolog: EC 1.5.1.20 Methylenetetrahydrofolate reductase (NAD(P)H)
MKVIEKILEAAGDGRTAFSFEYFPPKTEEGVENLFERMDRMVAHGPSFCDITWGAGGSTADLTLEIANRMQNMVCVETMMHLTCTNMPVTED

SEQ ID NO: 85565 - DNA, 824 bp, Zea mays
  misc_feature: Ceres CLONE 1571914
  misc_feature: Encodes the peptide sequence at SEQ ID NO. 85566
ctccccgcggtggcggccgctctagaactagtggatcccccgggctgcaggaattcgtctcacccctagaaaaaaccaaaactccgctctcatcccacccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcagccatggggggcgccgtgatggtcgccatcgcggcctctatcggcaacttgctgcagggctgggacaatgcgacaattgctggagccgtcctgtacataaagaaggaattcgacctgcagagcgagcctctgatcgagggcctcatcgtcgccatgtccctcattgggagcacagtcatcaccacgtttctctgaggcagcggacgactgcgtttgtaagaagcccatgctggtcagctcgggctgtcctctaactcgtcagggggctggtgatgctctgggggcccagggggtacatcttgctcctcgcaagggtcattgataggttcccgtaatcggttatggcggccacacctggttcatatcaaattctcaaagactgccgccgacagaacattcggggggctggtgaaaaaggttgccaccagatcaaatggggccagggaaggaatgttcccccaccccaccgccaagggggattttgggaaagtcccctc

SEQ ID NO: 85566 - protein, 63 aa, Zea mays
  misc_feature: Ceres CLONE 1571914
MGGAVMVAIAASIGNLLQGWDNATIAGAVLYIKKEFDLQSEPLIEGLIVAMSLIGSTVITTFL

SEQ ID NO: 85567 - DNA, 793 bp, Zea mays
  misc_feature: Ceres CLONE 1571915
  misc_feature: Encodes the peptide sequence at SEQ ID NO. 85568
ggagctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggtgatataacgacaaaccacttcctccctatccatcgtgaagcccctgctttcgttgagcaggcactgagcagcaaattctttgtactggaatcaaggtc

SEQ ID NO: 85568 - protein, 210 aa, Zea mays
  misc_feature: Ceres CLONE 1571915
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDITTNHFLPIHREAPAFVEQALSSKFFVLESR

SEQ ID NO: 85569 - DNA, 835 bp, Zea mays
  misc_feature: Ceres CLONE 1571919
  misc_feature: Translation starting site: 230
ctccccgcggtggcggccgctctagaactagtggatcccccgggctgcaggaattcgtctcacccctagaaaaaggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaatattgcttctggcacttcagaaatacaaaggttgttattgatcatggagctgttcctatatttgtgaagctttctgggtctggtagtgatgatgttcgtgagcaggctgtgtgggctttggggtatgttgctggcgattctccgaagtgccgcgaccttgttcttgccaatgggtgcgttgatccctctg

SEQ ID NO: 85570 - DNA, 765 bp, Zea mays
  misc_feature: Ceres CLONE 1571921
  misc_feature: Encodes the peptide sequence at SEQ ID NO. 85571
  misc_feature (444)..(444): n is a, c, t, g, unknown, or other
  misc_feature (445)..(445): n is a, c, t, g, unknown, or other
tggagctccccgcggtggcggccgctctagaactagtggatcccccgggctgcaggaattcgtctcacccctagaaaaaactccgcctccgctccccgctcgccgccgcgattgctggattggctgccgccagcgccccggtgctagctcccgttcctcgcggtggtcactggactagcctggacgccgcggcccgccgcctggtcgaagagatggactcggtcatggccgcccccgactcgccgccgcagactgtcgtgctcgtctctgccggcgccagccactccgtcgcgctcctcacgggcaatgtcctgtgctcgtggggcaggggcgaggacgggcagctcggccacggcgacgcggaggaccggctcgtgcccacggtgcttagcggcttcgacgcgcccgcgatcacgtccgtcatctgcggcgccgaacacaccnnacgctactccgaagacgagctgcaggtctacagctggggctggggagactttggggaggctggggcacgggcactccaagcgacgtcttcacgccccaccctgtcaaggcgctgcaggggctcaagatcaaacagattgcctggcggggacagccattggtccttgccttcaccatgggcccgaaaaaatgcaaaatttgggggcccttaccaaaaagggaaagcttgggctttggaacccctggaaaaattgcttgctcccaaaaaaaaaattcaggctttttggaaaagggtttggcgggaaaaatgaatgtgctgcg

SEQ ID NO: 85571 - protein, 180 aa, Zea mays
  misc_feature: Ceres CLONE 1571921
  misc_feature: SWISSPROT Homolog: EC 2.7.11.1 Non-specific serine/threonine protein kinase
  misc_feature (78)..(78): Xaa is any aa, unknown, or other
MDSVMAAPDSPPQTVVLVSAGASHSVALLTGNVLCSWGRGEDGQLGHGDAEDRLVPTVLSGFDAPAITSVICGAEHTXRYSEDELQVYSWGWGDFGEAGARALQATSSRPTLSRRCRGSRSNRLPGGDSHWSLPSPWARKNAKFGGPYQKGKAWALEPLEKLLAPKKKIQAFWKRVWREK

SEQ ID NO: 85572 - DNA, 836 bp, Zea mays
  misc_feature: Ceres CLONE 1571924
  misc_feature: Encodes the peptide sequence at SEQ ID NO. 85573
  misc_feature (574)..(574): n is a, c, t, g, unknown, or other
  misc_feature (688)..(688): n is a, c, t, g, unknown, or other
  misc_feature (796)..(796): n is a, c, t, g, unknown, or other
  misc_feature (812)..(812): n is a, c, t, g, unknown, or other
acccgcggtggcggccgctctagaactagtggatcccccgggctgcaggaattcgtctcacccctagaaaaagcaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctcgaaggatcagcatctactcttgattgtggactttgtcgcatctgatatcaacttcataaatctttatccaagatggcgctgcaaaacattggtgcttcaaacagggatgatgccttctacagggtacagatgcccagaatgattaccaagatagaaggccgtggtaatggtatcaagacnaatgttgtgaacatggttgacatagcaaaagcacttggcagggcagcttcctacacaaccaagtactttggatgtgagctgggtgcacagtcaaaatttgatgagaagacgggnatttccttggtaacggggctcatgatactgcaaagctgggctgtcctccttgagggtatcatcaagaagtatgtccaatgttatggggtggtggaaatcccgaaaacngagattctcattctcnaagaccccgatgatattcctggac

SEQ ID NO: 85573 - protein, 123 aa, Zea mays
  misc_feature: Ceres CLONE 1571924
  misc_feature (1)..(118): Pfam Name: eIF-5_eIF-2B Pfam Description: Domain found in IF2B/IF5
  misc_feature (116)..(116): Xaa is any aa, unknown, or other
MALQNIGASNRDDAFYRVQMPRMITKIEGRGNGIKTNVVNMVDIAKALGRAASYTTKYFGCELGAQSKFDEKTGISLVTGLMILQSWAVLLEGIIKKYVQCYGVVEIPKTEILILXDPDDIPG

SEQ ID NO: 85574 - DNA, 868 bp, Zea mays
  misc_feature: Ceres CLONE 1571925
  misc_feature: SWISSPROT Homolog: EC 2.7.9.1 Pyruvate, phosphate dikinase
  misc_feature (634)..(634): n is a, c, t, g, unknown, or other
  misc_feature (635)..(635): n is a, c, t, g, unknown, or other
ctccccgcggtggcggccgctctagaactagtggatcccccgggctgcaggaattcgtctcacccctagaaaaaatgcatgatatcgagttcactgtacaagaaaacagggtgtgtatgttccactgcatgacatgcaaacctacgggccacactgtcgtgaagatcgccgtgcacatggtctaaccaaggccttgtttacctccactcagcgatcaagatggtagatccaggccacctgctaccaactactacatcctcatttagacaacccgtctgcttacaaagatcaacttcttgctactggtctacctccctcacctggggctgctgtaatgccacgttgagttctctgatgaggatgctgactatggcattcccagagacacagctgatattctggtaagggcggacacacagtcctgaggatgttcgtggcatacaccctcctcgtggcgattctctatcatgaggggtggtcatgactctcccaaacctgctgaggacgcacatgatctgcgcacaaatcgctcgcatctccagaattctagagaagttcggcttcaaccgacgcaggacatcctccgtcaccatactcaggacatgtaggagaccctacagtcaccgtcctgtcnncagaatggctcgactggctgagggtgatctcttggagagctcacgcatctcaccgtacgacctgattgtcgatctgcaaactatcatgtcctgcggtcgatgatgtcagaaagataaacgcccgtgtctagaactgattcacctgatcttacagtcgacgacctcactgatgacgacaaacgggatctcatataggctcaccaaacaaatgatccttgcgtcttacgagacga

SEQ ID NO: 85575 - DNA, 816 bp, Zea mays
  misc_feature: Ceres CLONE 1571926
  misc_feature: Encodes the peptide sequence at SEQ ID NO. 85576
  misc_feature (485)..(485): n is a, c, t, g, unknown, or other
ctccccgcggtggcggccgctctagaactagtggatcccccgggctgcaggaattcgtctcacccctagaaaaaacacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgattcagttgtagctggtgaatttggcaagactcaatttctctcatctgagttcagaaacgtttgcttggtctcctgcttcccttgagtcttgccaaccatagttttctctcatctctttctgtgacttgaccaacatctcntttggtcctgtcagtctcgcaatactcccttccaaagacttgtctagaggttggattgccttgctctctgctggcgctgcagcttgctgaaatctttacttgctgcattctgggctcacacttttgaaagctgctctcttctgctccggggtggttgattttctgccctcagcttttctttgcctgtgcacctaaagcttcttctcttctgggggaaattagggaatcccctttgaacgaatttccgcctttttccccagaagaactttttctgtttgttccccaaaaggcaaaaaagaaggcttttaagggggaatgccgccaaaattca

SEQ ID NO: 85576 - protein, 29 aa, Zea mays
  misc_feature: Ceres CLONE 1571926
MSAEVAGGHPYFLSCYFWFIYCIKFRDFT

SEQ ID NO: 85577 - DNA, 843 bp, Zea mays
  misc_feature: Ceres CLONE 1571928
  misc_feature: Encodes the peptide sequence at SEQ ID NO. 85578
ccgctctagaactagtggatcccccgggctgcaggaattcgtctcacccctagaaaaaaaattcccaaagctctcgcgcgcggtgcatggcggagcgcctcgccgcctccctcctccctgccgcctcgccgtccccgtccgcccgccgcgcaacggtcgcagccgcagccgccgcctctttcccctccccatgctccgcccgcgcggggcagcacctacgctcccgcccgcccctcttctcgcagaaggaggccgggcgcgggtgtggccagcgggaggagcggtgcatggcaggctcggacgaggcgcagctcagggccgcgcgggaggacatcaaggaactccttaagagcaaatacagccaccccatcatggtccgtctggggtggaatgaatctggtacctatgacaaggatatgaaggactggccacagggaggtggagctaatggaagtttaaggttcgatgctgagctgagtcatggagccaatggcagcctgattaatgcattgaaacttatccagcctatgaaggacaaatacccaggtaatagttatggagagtttgttcagttaagaagtgctaccgcgaattgaggaagctggtggtccaaaacttcccaatgacattatggacgtgttgatggcaccacaagcttgaacagtgttcggccccgaggggaaggctccctgatgcgggcccacggggaacctggtggaacctctttggggaagtcatttttaaaaaaaggggccctttgaaaaacaaggaaaatggttggaaccaattcgggagaaacccccccctttgaaaaagaaaaaaggaccggaaccgggaatgggg

SEQ ID NO: 85578 - protein, 169 aa, Zea mays
  misc_feature: Ceres CLONE 1571928
  misc_feature: SWISSPROT Homolog: EC 1.11.1.11 L-ascorbate peroxidase
MAERLAASLLPAASPSPSARRATVAAAAAASFPSPCSARAGQHLRSRPPLFSQKEAGRGCGQREERCMAGSDEAQLRAAREDIKELLKSKYSHPIMVRLGWNESGTYDKDMKDWPQGGGANGSLRFDAELSHGANGSLINALKLIQPMKDKYPGNSYGEFVQLRSATAN

SEQ ID NO: 85579 - DNA, 805 bp, Zea mays
  misc_feature: Ceres CLONE 1571929
ccccgcggtggcggccgctctagaactagtggatcccccgggctgcaggaattcgtctcacccctagaaaaaaatcttcccgtctccaagtctccggtctcgaatccctcccttccagaacaagacacctgacgccgccgcccccccgccagccgcacccgtccataccataccatacctccggccgctcgtctcctatctcgtcaccttcgcccggcgctcagatctccgccgcgcctctgcctgatccccccacccccattggagggagacacatcccgcgtgggcgcacgaggacctggtttttttatcaaatgcttgacaaaatgcttgcttggtgatgtctggctatgatttgggtcctgtttatcatgcagttggcttctcatggcactcaaacagaagagacgatgcagtttgtgccccattgtgatcatgcagaagtgtcagattcacagtcaacaagttcacaactaaacctgatagagagatcaacagagcatctagcctcatgtgaaatcaacccagtgagcgttgatgatgacaacgacaatgaacatatcgatgccaatgaagaaactcacctttgttattcaggacgttcctcaatgccggatttgccttgatagtgaagggttgctctttgactatcagtgttcttaaggcgcctaggcgagcaagtgcagcagacaaccgccttagcgcctaggcgacgcctaagccgggaaaggcaagcaaggcggccagttttggccgagccgcttggaacccttagcgtttgcctaggggaccccttaaaaatagc

SEQ ID NO: 85580 - DNA, 799 bp, Zea mays
  misc_feature: Ceres CLONE 1571931
  misc_feature: Encodes the peptide sequence at SEQ ID NO. 85581
  misc_feature (449)..(449): n is a, c, t, g, unknown, or other
ccccgcggtggcggccgctctagaactagtggatcccccgggctgcaggaattcgtctcacacctttacctacacagctcaacaaaggagcgcggcggcccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgccgtccccaagctcggggtcatgcttgtggggtggggaggcaacaacgggtccacgctgacggctggngtcattgccaacagggaggggatctcatgggcgaccaaggacaaggtgcagcaagccaactactacggctccctcacccaggcttccaccatcagagtaagcagctaccacggggaggagatatatgcggccgttcaagagcctcctaccccatggtgaacccagacgaacttggtgtttgggaggctgggacatccgccagcatggaacctggcaaaagccatggacccaggggccaagggggctgggaaatttgacccgggcaaaaaccaccttcaggcccctaactggggagtcccaggggggccccctttcccccgggggttttttgaaatcccgggaattttcct

SEQ ID NO: 85581 - protein, 132 aa, Zea mays
  misc_feature: Ceres CLONE 1571931
  misc_feature: SWISSPROT Homolog: EC 5.5.1.4 Inositol-3-phosphate synthase
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVSSYHGEEIYAAVQEPPTPW

SEQ ID NO: 85582 - DNA, 847 bp, Zea mays
  misc_feature: Ceres CLONE 1571932
  misc_feature (847)..(847): n is a, c, t, g, unknown, or other
aaagctggagctcaccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggccacaaagaacgacggagcggcggcggtgggcggccagcgaccccgacaagctcttgagcctgctgccgtcgccgccccatgaagctccccatcatcgggcaccctgcacctgatgggggacatcccctaagtgttccctcgccgggcttcgcaaccaggtacgggcccgggacctgatggcggcttccccctcaggggccgtggccaaaccggggggggtctcggtcgcccgcgctgtcccccaaaggccgagcctccaccaccttacgaaacacggtattttttctcccggcccggggctccctggggtggtcgaacaatcctccagtggagcggggggccccaccgaactcgtaggcttttggggacccataaaggggggaaccgtcttttcccgcaaaaggggtgcgggaaagacacgggacccaacccggcgacn

SEQ ID NO: 85583 - DNA, 848 bp, Zea mays
  misc_feature: Ceres CLONE 1571934
  misc_feature: Encodes the peptide sequence at SEQ ID NO. 85584
aagctggagctccccgcggtggcggccgctctagaactagtggatcccccgggctgcaggaattcgtctcacccctagaaaaaaccgcgccaccaaccgcagatcctaaatccgatctctctctctctccctccctccctcccgccctctcgaggttttcggtttcgatccggcaagcgggcgagatcttcatggcgacgtcgttcgaccgctgggagaaggaccccttcttcctcgccgccgaagaggtccaggaatccgccgatcggatggaatcggtttatcgggtatgggtgcaggagaggagcgggggcgattccgaggcggcaagcgtcactggaggccctacagctgcgcagcttcgccgcgagctgcacacggcgctcggcaccgccaagtggcagcttgatgaactggcgcgggcagtcagatcgaacgatctggttatgtcagcaggaaaagacacaagggctaggcatgatgattttgttacagcaatcggctatcgcatattagaggtcgagaactacttgaaagaatccaatcttgcggacgggagggggccattgagctgggttcacttggatgaggatgaaagggacgaccttgcagcttttctatctgccagtccttttcacagaaagacaaagtggtcacaattccttcagcaggtgacattgaagtgggcagcaatgcagcaaggatgaaaaatgatatatcaactgacagctccaaggattcagctggtttccacggaatttgatatcaggcagaggcaaggaaggatttgccatcgtgggcacaggaaaagcaacctagtgcccagtgcttgaaatagggctcattga

SEQ ID NO: 85584 - protein, 171 aa, Zea mays
  misc_feature: Ceres CLONE 1571934
  misc_feature (11)..(111): Pfam Name: Syntaxin-6_N Pfam Description: Syntaxin 6, N-terminal
MATSFDRWEKDPFFLAAEEVQESADRMESVYRVWVQERSGGDSEAASVTGGPTAAQLRRELHTALGTAKWQLDELARAVRSNDLVMSAGKDTRARHDDFVTAIGYRILEVENYLKESNLADGRGPLSWVHLDEDERDDLAAFLSASPFHRKTKWSQFLQQVTLKWAAMQQG

SEQ ID NO: 85585 - DNA, 814 bp, Zea mays
  misc_feature: Ceres CLONE 1571943
  misc_feature: Encodes the peptide sequence at SEQ ID NO. 85586
  misc_feature (659)..(659): n is a, c, t, g, unknown, or other
  misc_feature (699)..(699): n is a, c, t, g, unknown, or other
  misc_feature (814)..(814): n is a, c, t, g, unknown, or other
ccccgcggtggcggccgctctagaactagtggatcccccgggctgcaggaattcgtctcacccctagaaaaagaaaaaagcggcatccgccacttcgtcgtcgtcgcacggattggcattggctgccctccggccctgttcctcgtcctcctcatcaaatcccgtctcctcagtcctcccaataatggtggcgtggtgagaaatccttccgtccggccgtcgtcttagaagatgaactgttcctcttgctgcgccgctgccactccatcttctccggcgcttctcgccaggccgcgggggggtttagctgctagctgctccacgacgacagcaaatcagaaggtgcttttcctgggctcaaaacagtttccacggatcacgtatagccgtgcgtcgtcacggttgtcgcggagagaggtaatagcttttgccgggcaacaaccttgggacatcggcagatttgtcaagacgctgtatttcttcaacgggcctccaaaccttctcaagattgtagaatctatcatcagcagtttcactggacctgcttctagtgaagcgccaaagaaaatggaaacatcagatgtggtgctggttactggagccaccggtggtgttgggcgacgggtggtggacgtcctgcagaagaagggagtacctgntcgagtattggctagaaatgtagacaaggcaaggagcatngtggggcccggatgtacctctgatcataggagaatgttacaaggagatacacttgatcctaagctattcaaggggataaaaaagtagtcaatgcagtctctgtcatagggggccn

SEQ ID NO: 85586 - protein, 184 aa, Zea mays
  misc_feature: Ceres CLONE 1571943
  misc_feature (143)..(143): Xaa is any aa, unknown, or other
  misc_feature (156)..(156): Xaa is any aa, unknown, or other
MNCSSCCAAATPSSPALLARPRGGLAASCSTTTANQKVLFLGSKQFPRITYSRASSRLSRREVIAFAGQQPWDIGRFVKTLYFFNGPPNLLKIVESIISSFTGPASSEAPKKMETSDVVLVTGATGGVGRRVVDVLQKKGVPXRVLARNVDKARSXVGPGCTSDHRRMLQGDTLDPKLFKGIKK

SEQ ID NO: 85587 - DNA, 830 bp, Zea mays
  misc_feature: Ceres CLONE 1571945
  misc_feature: Encodes the peptide sequence at SEQ ID NO. 85588
ctccgcggtggcggccgctctagaactagtggatcccccgggctgcaggaattcgtctcacccctagaaaaagcctaccccgtccctccccagcgcgccgtctagggtttcacagcggtgccccgatccattcgagcgccccgcaccgccgccatggagtttgacgaatacgagtacttggagaaggcggtggagcccgctcctccacaggccaatggttccggctccggctccggcgagaaggaccggggctcgcgccgccgcgagggcggcgaggaccgcatatcgaagcgctctcgctcgggggaggaccgcgaccgggacaggcaccgcagcggccgggagcaccgtgaccgggacagggatgacgtgaaggaggagaggagccgcgaaagccgcgggaaggacagggacagggacagggaagggagagaacgggagaaggagaggggagacaggcatcggctgagagagagggaagtggaacgggagcggaggagccggagccgctcggagcggcgccgtgccgaggagaagagatggttagggagctggaacgggaacgccagcgcaccaagcaaattactttccccaccgtgaagtcaggggtaagaaaaaataaccgggcaaaacccaaattttgttccagaaaggggcccgagggaacggtttttcccctccccccttcttctttaaagggagaaaaaaaaaaatttttttaaaggttttttctcagggggggggaagaagtcccagaaatttcccctttttcggggggcccaaaatctagagatgtttttaaagagggggggtggggactctgtggtttt

SEQ ID NO: 85588 - protein, 148 aa, Zea mays
  misc_feature: Ceres CLONE 1571945
MEFDEYEYLEKAVEPAPPQANGSGSGSGEKDRGSRRREGGEDRISKRSRSGEDRDRDRHRSGREHRDRDRDDVKEERSRESRGKDRDRDREGREREKERGDRHRLREREVERERRSRSRSERRRAEEKRWLGSWNGNASAPSKLLSPP

SEQ ID NO: 85589 - DNA, 1200 bp, Zea mays
  misc_feature: Ceres CLONE 1571948
  misc_feature: Encodes the peptide sequence at SEQ ID NO. 85590
  misc_feature (13)..(13): n is a, c, t, g, unknown, or other
  misc_feature (14)..(14): n is a, c, t, g, unknown, or other
  misc_feature (73)..(73): n is a, c, t, g, unknown, or other
tttggaatttttnntttttcattttcttaatcatcggaacgcacccggacaacgtgagtacacacagtaaaanaaaaaaatggagctccccgcggtggcggccgctctagaactagtggatcccccgggctgcaggaattcgtctcacccctagaaaaaatccacccacgcctccactacaccacatagagccgcagcagactcgcatgggaaaggagatggatcgtctgcccgagtcgacccggagcatgaggaagtacgcgtcggaggccggcgggcttcgcgcggcgcggcagggcccccacgggcggtcgctgacggcgcgcacggcgcacagcatgtccacgactgcgctgcgcaccaagtccaagtcggccgcgtccctgctgcacagggtgcccttcgcgccgctccgccccgtcctcgccaacctgcaggaggtgttcctcggcaccaagctcgccgtgctattccccgccgtgccgctcgccatcggccgcccagtgcgcgcactttcggccaggtgtggggtgttttacccttcaagcctgagtcggaccgtcatccccccctcgcccgaagcggtggtcaggccttccctccacccgaagggaagaattcgccgaatatataaaaccccgggccccccccacccggtggggggcggggcccctccccttcaaaaccgccccgaaacgggtggccccggtccaaataccggcaccaatgcggggaaaagctgttccaatatccactatcccgcgccgcggcgcttcccttattttccggaacgaggccttttcaaatgtggtgggggggggggggcacccaaggggaaatctcgcgaaagagtgttccctctcttgaaagaagaagtgggggtgtgccccccctatcccaatttgcggggggcgttcccccagattctcctttccttccccccaaaacgcctttaggtctttgccttctcagcgtggactttcctgggagagaacggagtcccccccttgcctttttcttgaggcaaaagtagggggcgggatccttttctaaaacgcgcctgcgcgggttctgtcgcgaaaaaacagggcccgctttataccggtaaacaaggggttcaccgccaaggccctcgagaaactgtttcaagggacgagcggggccccattccctctcaataccccaggggggcgtgtgtgc

SEQ ID NO: 85590 - protein, 249 aa, Zea mays
  misc_feature: Ceres CLONE 1571948
MGKEMDRLPESTRSMRKYASEAGGLRAARQGPHGRSLTARTAHSMSTTALRTKSKSAASLLHRVPFAPLRPVLANLQEVFLGTKLAVLFPAVPLAIGRPVRALSARCGVFYPSSLSRTVIPPSPEAVVRPSLHPKGRIRRIYKTPGPPHPVGGGAPPLQNRPETGGPGPNTGTNAGKSCSNIHYPAPRRFPYFPERGLFKCGGGGGAPKGKSRERVFPLLKEEVGVCPPYPNLRGAFPQILLSFPPKRL

SEQ ID NO: 85591 - DNA, 780 bp, Zea mays
  misc_feature: Ceres CLONE 1571950
  misc_feature: Encodes the peptide sequence at SEQ ID NO. 85592
gagctccccgcggtggcggccgctctagactagtggatcccccgggctgcaggaattcgtctcacccctagaaaaaatccgccgacccggagccaaagccaacaaacagccgctccgccttcctccgcggctgcagccagcgcgaggtacctggctggcattttgcatttgaggtcatcattgaatggctgcaacgatgggttcaatatctgccaacggttcttaccaaacaaataggcccagtgcactaaagcaggcacctcacatgcaattccaacaatgttgcaacggtggacttaggttcttaagcaagcactcccaatccatgcgaagtaagatacaggtggctaaaagaagagctacagataatggaattcatccaaagactacgggacatcgggcacctattgtatgttctgctgggatgactattgtatttgttgcaactgaagtgcacccatggtgcaaaactggtggcctcagtgatgttgtaggaggactgcccccagctttggctgctatgggacaccgtgtcatgacaatagctcctcgttatgatcaatacaacgatgcgtgggatacaagtgtccttgttgaggtaaatattggagacacggtagacactgtgcgattcttccactgctacaaaagaggagtcgatcgtgtggtttgttgatcatcctatgtatcatgcaaaggtatgggggcagactggagcaaaactatatgggtctactactgggactgactagggagataaccagtgtgagcttctgcctt

SEQ ID NO: 85592 - protein, 159 aa, Zea mays
  misc_feature: Ceres CLONE 1571950
  misc_feature (78)..(160): Pfam Name: Glyco_transf_5 Pfam Description: Starch synthase catalytic domain
  misc_feature: SWISSPROT Homolog: EC 2.4.1.242 NDP-glucose--starch glucosyltransferase
  misc_feature: The sequence is a functional homolog of SEQ ID NO 4 in US patent 7169982
MGSISANGSYQTNRPSALKQAPHMQFQQCCNGGLRFLSKHSQSMRSKIQVAKRRATDNGIHPKTTGHRAPIVCSAGMTIVFVATEVHPWCKTGGLSDVVGGLPPALAAMGHRVMTIAPRYDQYNDAWDTSVLVEVNIGDTVDTVRFFHCYKRGVDRVVC

SEQ ID NO: 85593 - DNA, 866 bp, Zea mays
  misc_feature: Ceres CLONE 1571952
  misc_feature: Encodes the peptide sequence at SEQ ID NO. 85594
ctggagctccccgcggtggcggccgctctagaactagtggatcccccgggctgcaggaattcgtctcacccctagaaaaaacgccatacgacacggaggacaccgagccggaggcgaagccggtgcgcagcgcgagagtagcggcgagtcggcgaccatcaagcaactgcatggccgcgttacccgccagcgcccccgcccccgcccccgccccctccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtcaatctgatcggggagcacatcgactacgagggctactcggtgttgccgatggccatccgccaggacatgatcgtcgccatccgaagggccaacggcgcccaggtgagggtcgctaacgtcgacgacaagtaccccctctgcgtctaccccgccgacccagacaaggaaattgacgtaaaaaatcacaatgggggcactatttcatgtgtggatacaagggagtttatgaatactgtagattcaaaggggatagatctgggcaaaacctgttgcggcttgacgtcctttgttaatgggacaagtttccccaggggtctggaattgtcaagctccgcagccttttgtctggttcagcaacaattggctatcatggggaatcctttgaaaaaaaaatttcccaaaaaaagaaagtggcccaaattcccccttggtctgttctgaagcgcccactttgggaaacgcaaatctgggcggggaatggaaaaa

SEQ ID NO: 85594 - protein, 216 aa, Zea mays
  misc_feature: Ceres CLONE 1571952
  misc_feature: SWISSPROT Homolog: EC 2.7.1.6 Galactokinase
MAALPASAPAPAPAPSEAAELVPTLSSLEPVYGAGAQLDEARLRFARLGDRFHAVYGARPALFARSPGRVNLIGEHIDYEGYSVLPMAIRQDMIVAIRRANGAQVRVANVDDKYPLCVYPADPDKEIDVKNHNGGTISCVDTREFMNTVDSKGIDLGKTCCGLTSFVNGTSFPRGLELSSSAAFCLVQQQLAIMGNPLKKKFPKKRKWPKFPLGLF

SEQ ID NO: 85595 - DNA, 809 bp, Zea mays
  misc_feature: Ceres CLONE 1571953
  misc_feature: Encodes the peptide sequence at SEQ ID NO. 85596
  misc_feature (622)..(622): n is a, c, t, g, unknown, or other
  misc_feature (623)..(623): n is a, c, t, g, unknown, or other
  misc_feature (647)..(647): n is a, c, t, g, unknown, or other
  misc_feature (738)..(738): n is a, c, t, g, unknown, or other
ccccgcggtggcggccgctctagaactagtggatcccccgggctgcaggaattcgtctcacccctagaaaaaagcagcctccggtaggccttgcggcgccgccctcgcctactccacagtcgctgccgcagccgcagccgcagccgcagcccccgccacctcctgaaccctcactgccaccctcgccacaccccccgccgcctctgccttttagtccagtaaccaccataagaaagatggagaagagggatggtgaattcccaccaccaccaccacctctggttttgagtccaataagattaagaaaaagggatgatgagatccatgtgggtgattttaccgatgatgacgatgacactgacagctgctcaactcctctaccaccacccctgccacccggtatagattgggaggacttggatccttacaacgttcgccccttgagtttcccatctccatttgctgacaggaacgatgaagaggtggcctcgcaggttgccatggacaatggtcctgaggtacacacagaatttgatggagaggaggatgaaagtgtgcttggcattgtggataggggtccatgtgaatccagccaagagtagggctctgggtgatggcaacnntctcactgtgagccaggtaacaanggattcagactctgtggcagtgccttggaggagtatgaagtcacttgtagagattggtaaggaggatgacgagtacttcttgaaagcagcnagcagtggtaatgaacgtgtgattcttttggactctgcctgtgggccgcctgatgctttagagatggagca

SEQ ID NO: 85596 - protein, 121 aa, Zea mays
  misc_feature: Ceres CLONE 1571953
MEKRDGEFPPPPPPLVLSPIRLRKRDDEIHVGDFTDDDDDTDSCSTPLPPPLPPGIDWEDLDPYNVRPLSFPSPFADRNDEEVASQVAMDNGPEVHTEFDGEEDESVLGIVDRGPCESSQE

SEQ ID NO: 85597 - DNA, 806 bp, Zea mays
  misc_feature: Ceres CLONE 1571954
  misc_feature: Encodes the peptide sequence at SEQ ID NO. 85598
  misc_feature (13)..(13): n is a, c, t, g, unknown, or other
  misc_feature (35)..(35): n is a, c, t, g, unknown, or other
  misc_feature (153)..(153): n is a, c, t, g, unknown, or other
  misc_feature (350)..(350): n is a, c, t, g, unknown, or other
  misc_feature (525)..(525): n is a, c, t, g, unknown, or other
  misc_feature (532)..(532): n is a, c, t, g, unknown, or other
  misc_feature (540)..(540): n is a, c, t, g, unknown, or other
  misc_feature (558)..(558): n is a, c, t, g, unknown, or other
  misc_feature (566)..(566): n is a, c, t, g, unknown, or other
  misc_feature (569)..(569): n is a, c, t, g, unknown, or other
  misc_feature (573)..(573): n is a, c, t, g, unknown, or other
  misc_feature (746)..(746): n is a, c, t, g, unknown, or other
ggagctccccccngtggcggccgctctaaaactantggatcccccgggctgcaggaattcgtctcacccctagaaaaactcaaaccctagccgcctcctgcaagtttcagagctcaggaatctgcgccatggcgagtgagacggagaccttcncatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccaaacaaggccacnaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggccagttcggcgtcggtttctactctgcctacctcgtcnccaatanagttgtcntgaccaccaagcacaacnatgacaancantacntgtggggaagtcccagcgggcgggtcgttcactggtactcttgacacctcaggggaacaccttggcaggggcactaaaatcaaactgttccttaaggacaaacaacttggaatacctttaaggaacgtccccctccaggaattggggcaaaaaagcccctggggatttttaanattacccccctctcccctttgggcctggaaaagaccaccaaaaaagggaaattttttggg

SEQ ID NO: 85598 - protein, 162 aa, Zea mays
  misc_feature: Ceres CLONE 1571954
  misc_feature (9)..(9): Xaa is any aa, unknown, or other
  misc_feature (133)..(133): Xaa is any aa, unknown, or other
  misc_feature (135)..(135): Xaa is any aa, unknown, or other
  misc_feature (138)..(138): Xaa is any aa, unknown, or other
  misc_feature (144)..(144): Xaa is any aa, unknown, or other
  misc_feature (146)..(146): Xaa is any aa, unknown, or other
  misc_feature (147)..(147): Xaa is any aa, unknown, or other
  misc_feature (149)..(149): Xaa is any aa, unknown, or other
MASETETFXFQAEINQLLSLIINTFYSNKEIFLRELISNSSDALDKIRFESLTDKSKLDAQPELFIHLVPNKATNTLSIIDSGIGMTKSDLVNNLGTIARSGTKEFMEALAAGADVSMIGQFGVGFYSAYLVXNXVVXTTKHNXDXXYXWGSPSGRVVHWYS

SEQ ID NO: 85599 - DNA, 828 bp, Zea mays
  misc_feature: Ceres CLONE 1571955
  misc_feature: Encodes the peptide sequence at SEQ ID NO. 85600
  misc_feature (690)..(690): n is a, c, t, g, unknown, or other
ggagctccccgcggtggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggcccccgccgacgccatcctcgtggcgagctccatcctgcacatgctcaacctcgccaacctggccgaggaagtgcagatcgcgcaccgccgccgcaacagcaagctcaagaaaggtgggttcgccgacgagggctccgccaccaccgagtccgacatcgaggagacgctcaagcgcctcgtgtccgaggtcggcaagtcccccgaagaaggtgtcgaggcgctcaagaacccagacgtcgacctcgtctttcacgcgcantccacgcagtccgcccgccgctcgctcctgcagaaaaacgccaggatccggaattgtctgacccagctgaaatgcaaggacatcactgacgacgaacagcaggagctcgatgaggctctgcagagagagatccagcat

SEQ ID NO: 85600 - protein, 223 aa, Zea mays
  misc_feature: Ceres CLONE 1571955
  misc_feature: SWISSPROT Homolog: EC 4.1.1.31 Phosphoenolpyruvate carboxylase
  misc_feature (177)..(177): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNSKLKKGGFADEGSATTESDIEETLKRLVSEVGKSPEEGVEALKNPDVDLVFHAXSTQSARRSLLQKNARIRNCLTQLKCKDITDDEQQELDEALQREIQH

SEQ ID NO: 85601 - DNA, 823 bp, Zea mays
  misc_feature: Ceres CLONE 1571959
  misc_feature: Encodes the peptide sequence at SEQ ID NO. 85602
ctggagctccccgcggtggcggccgctctagaactagtggatcccccgggctgcaggaattcgtctcacccctagaaaaaaacgcgctcctctctcgccgtcgccaaccatcgccgcctcgcgtccggacccgccgttcctccgaggaaatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacagtcgacccaacagctccagaatttctgccactcccatcttttgaagaatgctttccaaggagtaccaaagaatcaagtgaaatcatccacgaggaatcaggtcatgtcctcaaggttccattccggagagtccatttgactggagatcagaagcactttgatacatatgacaccagcggtcctcaaaatataagcccaaggattggactcccaaagataaggaaggaatggattgataggagggaaaagctgggtagtcctcggtacacacaaatgtattatgctaaacagggaattgtaacagaggagatgttatactgtgccagccgtgagaaccttagtcctgaattttgtcggacagaagttgcccgtggacgagccataaatcctttcaacaagaggcacctggaattggaacccatgaattgttggaagaaacattcttggtt

SEQ ID NO: 85602 - protein, 224 aa, Zea mays
  misc_feature: Ceres CLONE 1571959
  misc_feature: SWISSPROT Homolog: EC 2.5.1.3 Thiamine-phosphate diphosphorylase
MAALQPSFSPAMTLKSSCSALKFPKTALLSGFGGIPRLQDAQDRNTSVAYLIPKAASVTDQSIAEPPKTKQNRHTVDPTAPEFLPLPSFEECFPRSTKESSEIIHEESGHVLKVPFRRVHLTGDQKHFDTYDTSGPQNISPRIGLPKIRKEWIDRREKLGSPRYTQMYYAKQGIVTEEMLYCASRENLSPEFCRTEVARGRAINPFNKRHLELEPMNCWKKHSW

SEQ ID NO: 85603 - DNA, 792 bp, Zea mays
  misc_feature: Ceres CLONE 1571963
  misc_feature: Encodes the peptide sequence at SEQ ID NO. 85604
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (742)..(742): n is a, c, t, g, unknown, or other
  misc_feature (743)..(743): n is a, c, t, g, unknown, or other
  misc_feature (761)..(761): n is a, c, t, g, unknown, or other
ctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacagccccgaccgcgtgctgtacctgggcccactgtccggcgagccgccgaagctaccgtgacgggcgaagtcccggggtcgactacgggcttggggaaaaacccccggggggggcttttttccnnnnggaaacccggaaaaattttcccaaaaacccggggagggggggggggaaccctttttcccccgtggggcaaagtgggggggggccctttctggtgttttttttttcccagaaaataatcttcccccccccacaaaggcggtttttatatttttttggaaagaaccccctttggggttgaaaaaaaggggcgccccccccccaaaatttttttggagggggggggggggggaggagaaaaaaaattctccgggggaagaaaaaaaaaggttttttttttccctcccgcgaaaaaaaaaaaaaaccccccccccccttccccnngggcgccgccccaccacnaggaaggggggatgtgtggggaggggggggg

SEQ ID NO: 85604 - protein, 70 aa, Zea mays
  misc_feature: Ceres CLONE 1571963
MASSTMALSSTAFAGKAVNVPSSSAFGEARVTMRKTAGKAKPAAASGSPWYSPDRVLYLGPLSGEPPKLP

SEQ ID NO: 85605 - DNA, 831 bp, Zea mays
  misc_feature: Ceres CLONE 1571964
  misc_feature: Encodes the peptide sequence at SEQ ID NO. 85606
  misc_feature (713)..(713): n is a, c, t, g, unknown, or other
ccccgcggtggcggccgctctagaactagtggatcccccgggctgcaggaattcgtctcacccctagaaaaacatctcgtcgtcaatccgtgcgtcagcaagaaatcccaagaatcgggtgaagacgaagctagcagcgcgatattccccaagcgctcgacaaattgcctggatcggaaaatcgctaccgatctcgcggattcgtgtcagctgctgaagcggtaagctgatgaattattcagaatagttcaatcgatgaataaattaatgttttattgcgatgctcattagatgctcgataaatcgcgtgagtcacgaaactctcgtcgacttcgcagttcttgcgattatcgagccagattcagctatagcgaattatttcgctattccggtcacttagctgaattagtggatcgagtagaattttagtaggcatgtgtgttgatgaaataagtttagtattcctattagctagttaatagaattttctagtgtcgttatatcaatttgattaattgatatggtcgatgccctgcataaatagttagtttattctagtcatgatatcctttgttaatgatcaattatatagatgatgaatcgtgtctaggctaattatgtttaaagtgtatgatttgtttgcgatgttgtgtttaggttcgttttatttagaggagcgtaatttatgcgcgtagtcatatagtaataactangtgttttcgtggtagaatgtacaacgccttcgccgctaggtggttaaatttcgtcatcgcgtagcacctatttagggtttttttgataatcctggtcaatatgcattcatatgcataa

SEQ ID NO: 85606 - protein, 45 aa, Zea mays
  misc_feature: Ceres CLONE 1571964
MLDKSRESRNSRRLRSSCDYRARFSYSELFRYSGHLAELVDRVEF

SEQ ID NO: 85607 - DNA, 845 bp, Zea mays
  misc_feature: Ceres CLONE 1571965
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (272)..(272): n is a, c, t, g, unknown, or other
  misc_feature (277)..(277): n is a, c, t, g, unknown, or other
  misc_feature (280)..(280): n is a, c, t, g, unknown, or other
  misc_feature (282)..(282): n is a, c, t, g, unknown, or other
  misc_feature (285)..(285): n is a, c, t, g, unknown, or other
  misc_feature (286)..(286): n is a, c, t, g, unknown, or other
  misc_feature (289)..(289): n is a, c, t, g, unknown, or other
  misc_feature (290)..(290): n is a, c, t, g, unknown, or other
  misc_feature (298)..(298): n is a, c, t, g, unknown, or other
  misc_feature (299)..(299): n is a, c, t, g, unknown, or other
  misc_feature (302)..(302): n is a, c, t, g, unknown, or other
  misc_feature (304)..(304): n is a, c, t, g, unknown, or other
  misc_feature (307)..(307): n is a, c, t, g, unknown, or other
  misc_feature (308)..(308): n is a, c, t, g, unknown, or other
  misc_feature (319)..(319): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (339)..(339): n is a, c, t, g, unknown, or other
  misc_feature (349)..(349): n is a, c, t, g, unknown, or other
  misc_feature (351)..(351): n is a, c, t, g, unknown, or other
  misc_feature (352)..(352): n is a, c, t, g, unknown, or other
  misc_feature (354)..(354): n is a, c, t, g, unknown, or other
  misc_feature (361)..(361): n is a, c, t, g, unknown, or other
  misc_feature (376)..(376): n is a, c, t, g, unknown, or other
  misc_feature (379)..(379): n is a, c, t, g, unknown, or other
  misc_feature (384)..(384): n is a, c, t, g, unknown, or other
  misc_feature (397)..(397): n is a, c, t, g, unknown, or other
  misc_feature (428)..(428): n is a, c, t, g, unknown, or other
  misc_feature (429)..(429): n is a, c, t, g, unknown, or other
  misc_feature (451)..(451): n is a, c, t, g, unknown, or other
  misc_feature (452)..(452): n is a, c, t, g, unknown, or other
tacccgcggtggcggccgctctagaactagtggatcccccgggctgcaggaattcgtctcacccctagaaaaagcccgtgcccacctccacgactccacctccgcagcgcccgcggtaacctccccacgccacgccacatcgcgtgcgagccccaaccgtcgccggcctcccaattaagccgcccccgcggcgcgatccggtgtccaccgctgctccgccggaggagggggaaggggaagaaaagggagggggggagcnnnnggggatggtngaggngangnggnngtnnggggggtnnggngnggnnggggggggggngnnnntnnnnggtnnngggngggggggggngnngntggtggnttgggttttggtgtngtnggtgnttatgggggggtngttgttgtttttgtggttggggggggtgttnnttttgtttgggtgggtgtgttnnggggttttggtggaggttttttttgttgagggtttgtttggtgggttgatggggggttaagaaggggagagggggggaggtgtggaaaagaatggtataatttatataaaggttaaaaggggtgaggaagtttaattgggagggaaggataaaggggggtttaaggaaaggggaaaataaaagggatggggaaaattggaagaatgaaggggagaaggatgaaaaaaggtaaaaaataaaattatggatagaaaggggaaaaaagagtaaaaaattggggtttataaaaatataggggtggaaataaggggggaaaaagtggggtataaaaatgggggggtgttgatatggggaggaaaagaggagagagaaggaaggagtgaaaaaaagaga

SEQ ID NO: 85608 - DNA, 767 bp, Zea mays
  misc_feature: Ceres CLONE 1571968
  misc_feature: Encodes the peptide sequence at SEQ ID NO. 85609
ctccccgcggtggcggccgctctagaactagtggatcccccgggctgcaggaattcgtctcacccctagaaaaaagttcttctgatctctgacttctgagcgaggagtggacgagtggtgtgccgtcgtccggttcccgttggtttggcgatgaggcgcgctcgcggtcgccgcgggctgctgcttctcctcggcgtggcgctctcggcggctgcgctgctccgtggctgcgcggggcagcaaggggaggacggctcggacgcccctgcggcggcggcggagacggcccccatggaggagaaggagcgcagggcgctgtacgccgccatcgagagcttcgtcggcaaggggtggaacggctccgggctctacccagacccctgcggctggtctcccatccagggggtgtcatgtgatctcttcaatggcctgtggtacccaacagtgatgagcattggcccagtccttgacaactcgctgcagtgcggccccgacgccaagttcagcgcccagctgttcgacctgaggcgcctccggacgctgtctttctacagctgcttcccggcgagcaacccacggccatcccgaccggcagctgggagaaactggcggggacgctggagacgctgggagttccgcaccacccggggcctgacggcgccatcccggcgtccctcggccgccctgggcagccttgcgttccctggtgctcggtggaaaacaacctgacgggggcccgtggcccccggagctggggccccctttcc

SEQ ID NO: 85609 - protein, 192 aa, Zea mays
  misc_feature: Ceres CLONE 1571968
MRRARGRRGLLLLLGVALSAAALLRGCAGQQGEDGSDAPAAAAETAPMEEKERRALYAAIESFVGKGWNGSGLYPDPCGWSPIQGVSCDLFNGLWYPTVMSIGPVLDNSLQCGPDAKFSAQLFDLRRLRTLSFYSCFPASNPRPSRPAAGRNWRGRWRRWEFRTTRGLTAPSRRPSAALGSLAFPGARWKTT

SEQ ID NO: 85610 - DNA, 797 bp, Zea mays
  misc_feature: Ceres CLONE 1571969
  misc_feature: Encodes the peptide sequence at SEQ ID NO. 85611
ggagctccccgcggtggcggccgctctagaatagtggatcccccgggctgcaggaattcgtctcacccctagaaaaaatagcagtcggctgccgtggtccggtgacctccccacgatgcctcccgggaagagatccacacagccctcacggaattccgaagaccctcttactgaatacgagaaaatgagggctgtgaatatgatgaagaacaatcaattgtttcaacggctaggccttggacaattaaaaacaatgatcaccgcaacaactacaaacaacaatcaaggcggtcctcaggaatcaggttctttatatgatggtgagaacgttgaggattctggtgaagaggatgttggcatggaattccaagctcgtaagggtgtccctacccacatctccaatgatggtgaacatatgtcaacaaaagtaacaagaggaaataaaagaattatggcacctgtgcaggaacggccagttagagtcactagacaaagagttgctgaagtaaaccaaatgtctacccatagcctaaatgtttctacacaacccagttcaagtgccgccacaaaccatgatttgacccacaaccttattgttcctacacatcctagttccaatactgccacaaaccatgagcccatccaagacatggatactattgcacaacctactttccagatacaggagggtgataaccacactgggaaatcagaaatcataccaaggagaaaaagttgggcaggcaacttgaaatcgtaagcagaggactggggaatcatattccaatcaaatcact

SEQ ID NO: 85611 - protein, 191 aa, Zea mays
  misc_feature: Ceres CLONE 1571969
MRAVNMMKNNQLFQRLGLGQLKTMITATTTNNNQGGPQESGSLYDGENVEDSGEEDVGMEFQARKGVPTHISNDGEHMSTKVTRGNKRIMAPVQERPVRVTRQRVAEVNQMSTHSLNVSTQPSSSAATNHDLTHNLIVPTHPSSNTATNHEPIQDMDTIAQPTFQIQEGDNHTGKSEIIPRRKSWAGNLKS

SEQ ID NO: 85612 - DNA, 857 bp, Zea mays
  misc_feature: Ceres CLONE 1571971
  misc_feature: Encodes the peptide sequence at SEQ ID NO. 85613
  misc_feature (535)..(535): n is a, c, t, g, unknown, or other
  misc_feature (620)..(620): n is a, c, t, g, unknown, or other
ccccgcggtggcggccgctctagaactagtggatcccccgggctgcaggaattcgtctcacccctagaaaaacggatgaggtgccccagggtcctctgctcatgtccacgtccatgtccgctccggctccgacccccgtcccgctgacctccttcgccgtgctgcggcaacaccactcgcagctcatccgtctcggcgtcgcctcccacgccgcccacgcgcgccgccttctctccttccttgcccgggaccccgactcccacttcccgtacgcgagccgcctcctggcgcaccacccggacccgcacccggcgctcttcaacccgctcttctccgcgctcccgacgcgccacgccgcgcggctcctggccctcatgctgtccctgcccctgcgcccggaccacttcaccttcccgcaaatcctcccgagcgcccagccgctccacctggtcgcccagctccacgcgctgctcctcaagctcgggctcccacgccacacgcagtcgctcaacgcgctgctcggcgcctacctcgncaacgcgagaaccgacctcgcctcccgcgtcttccgggggggcggggagctctcgacgtcttgtcggggacacctatggtcggcngggctcctaaagcttgggcttgttcaacaaccccccgggtgcttttccaacggaatgccctaagcaaaaacctggggtccgggaaccccaattaaattccggggtaccttaaggccttgaaagttttcctgaaccccccttggagggggtttcaacaaaaaatccgggccccccccgggggggaacaacgaaaacttttttttttggcggggtatacccggggggggggggcggcgc

SEQ ID NO: 85613 - protein, 34 aa, Zea mays
  misc_feature: Ceres CLONE 1571971
  misc_feature (4)..(4): Xaa is any aa, unknown, or other
MVGXAPKAWACSTTPRVLFQRNALSKNLGSGNPN

SEQ ID NO: 85614 - DNA, 905 bp, Zea mays
  misc_feature: Ceres CLONE 1571972
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (31)..(31): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (158)..(158): n is a, c, t, g, unknown, or other
  misc_feature (724)..(724): n is a, c, t, g, unknown, or other
nnnnnnnnnnnnnaaccaacaaacccacaangcagaacgannnaaannnnnnnnnnnnnncnnnnnnnnaaaagtgggactcccgcggtggcggccgctctagaatagtggacccccgggctgcaggaattcgtctcacccctagaaaaatcacacangcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggcccttcgtgggatcttgaaaattgaatgttctaatgggagtccaagggtgggcaaagaagaaagtcttagcaggtaagtcggttccttcccctgaatggtaccgaaagccttccccctttgggccttcccaggcaatcccaaagggaaataatccccggccccccctgggacaagggggcgggggccatttttcacaaaagaaaaaaatttttttccctctcccccccccccggtggggcctttttttaaaacctcctcccccgaaaaaaaaaaactctttgtgcgcccccccccgcaagaggggggaaaaaaaaaccccccccaaatttcccccccgtgtggggaaaaaaaaaaaccccccccccgggggggncccgggtttaaaaatttcccccccccccaatttccccctaaaaaaaaaaaagccccgcgtttaaagaaacaacccccccccccgcggggggaaattttttttttcccattttttttggaggaaaccccccccccccaaaaaatccccccccctcccgggggtaaaaaaacgcgtgcttttt

SEQ ID NO: 85615 - DNA, 903 bp, Zea mays
  misc_feature: Ceres CLONE 1571976
  misc_feature: Encodes the peptide sequence at SEQ ID NO. 85616
  misc_feature (819)..(819): n is a, c, t, g, unknown, or other
ctccccgcggtggcggccgctctagaactagtggatcccccgggctgcaggaattcgtctcacccctagaaaaaacgccacgcgtccacgtccgggtccgtccattctgctctcaccctcgggtctcggtcatcggggaagagcacgaggctcaacgcgtcagcgactcagcgtcatatttctgagttctcgcttctcacttgtgcccagatgccggccctttccttttcgggatctcctcggtgacctagatcggatggacccgccgccggcgacgcgcgcggcgtccaggcggcgggaccgccgacggcgcctgcggcagcggcagcgcgcagctgcagccacgaaaacgagggtcggtgcggccgtgctggccgtggagccgcagagcgcagcagtcacaaccccggtggcttcgaccggccctgctgccacgccggcgtcgaggggcaggaaacggcggaggcctcgtagacggcgtgactggaacgcgggcgccgctggggtgggcgacgaaccaccggctgcgtccccccgtttcccgttccagatgccccgcaaggcaagttgcaaatttggaagcaattggcatcaccttctgaacgaataatgtgcctgccaaacttatgaccggagaaagattaatgaggttcagaataaaacaaggcaagaagaaatttttcccccccgggaaatgaaggcccctaaaaaaattcttgtgggctggaggggggcttcccctggctccttcttctttgccccggtcggtgaaacatttcttccccgaaagaaaaatgggagcccctccaggggagttgnaaaattcctttaagaaaattcccatggtaaaaaactcccccaggtttagaatagtttgcccctcggaacaaaaggaaactgttg

SEQ ID NO: 85616 - protein, 117 aa, Zea mays
  misc_feature: Ceres CLONE 1571976
MDPPPATRAASRRRDRRRRLRQRQRAAAATKTRVGAAVLAVEPQSAAVTTPVASTGPAATPASRGRKRRRPRRRRDWNAGAAGVGDEPPAASPRFPFQMPRKASCKFGSNWHHLLNE

SEQ ID NO: 85617 - DNA, 833 bp, Zea mays
  misc_feature: Ceres CLONE 1571977
  misc_feature (734)..(734): n is a, c, t, g, unknown, or other
  misc_feature (736)..(736): n is a, c, t, g, unknown, or other
ggagctccccgcggtggcggccgctctagaactagtggatcccccgggctgcaggaattcgtctcacccctagaaaaacccctttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttggcccgggggacgaggaggaggctggtcaaagatctgtggtcaaaaattgatggtggggttcatggaatgggtgcatgactggttgctgtgggacgccttcctggagtgcggagggatcatgaggccaccgattagatagcggctggggagcgagggaccacaggaggcggaggccgccgttagcaccccccaccaccccgcgccgcgagcaagcagccatgggggaagaccctcgtcacaccctgtccatggagaacggcgggcggcggcaccacggcccctgcacgctcctcttcatgggaccgtccggggccactctcgcgccggacgaacgcgccgtcggcgtcatgtgcaactatcctaaagggggggggggttttattactanancccccaccccaaacccgtggtcgcccttccggggcgccctccgcccaacaataaacaggccggtggaaaaaccaacctcggcgaaatgggtgggaaa

SEQ ID NO: 85618 - DNA, 814 bp, Zea mays
  misc_feature: Ceres CLONE 1571978
  misc_feature: Encodes the peptide sequence at SEQ ID NO. 85619
ctccccgcggtggcggccgctctagaactagtggatcccccgggctgcaggaattcgtctcacccctagaaaaaaacctaacagaagcaaccgaatatcccctcgcctttcaactcgtcttcctcctcatgtcgtcgcctcctatccctctatatcttctattctaagccacctcgatcggaccctagatagatgcaagaaaagaaaagagaagagcctctgtggatagtggtgggtgctggatcactgggcggagcagcttctcatatcggatcgatcgattaattaatatatactataaacatacaatcaattacatacatatacgccaagagaagaggaacgccggcccgtttcacttgtctccttcctccgatccctcccggcggccggccgggctcgggcgtttttccccttttgtttcccatggaggacgccaagatggggaacggcgccaccatccgcgcggtgctcgccatcctccagtggtggggattcaacgtcaccgtcatcatcatcaacaagtggatcttccaggtcccgtccctcgcgcttgctcttgtttaaatcctggtcttctttttttgtttcaattcaatttccagagatggccatgtatgtagttatatatatattcattcaaggggatttaaggggtgggatccgtcaggacaaccaagagatttcgtctctttttagttcttggccttcatccaatcgttcgataggtgcagaataaatcgcccccaggaatgttgtcgtcctttttcttccagtgattttggtaggaacattaaaggaatcatcccttttt

SEQ ID NO: 85619 - protein, 46 aa, Zea mays
  misc_feature: Ceres CLONE 1571978
MEDAKMGNGATIRAVLAILQWWGFNVTVIIINKWIFQVPSLALALV

SEQ ID NO: 85620 - DNA, 827 bp, Zea mays
  misc_feature: Ceres CLONE 1571982
  misc_feature: Encodes the peptide sequence at SEQ ID NO. 85621
  misc_feature (567)..(567): n is a, c, t, g, unknown, or other
ctccccgcggtggcggccgctctagaactagtggatcccccgggctgcaggaattcgtctcacccctagaaaaagactaccccgcaagtcgaggccttccgctggctctcgctcgctcgctcgccccgcgactggttgcctctccgccccgaccctgccctgagaccggagacgaccgcgccccgcggtggcgctgcgacccgcgatacgctttgggcactgaaggttggcttacttgacaggaaattccccgtttaattgcatattggacatgtcttgtggcgtttgattggaggatttaattcttcccaacgatttccgttcttcggaggcttccatcttggtttcagttctgcaggctgtgtgtttgtgatctgtgactgagaggggaggaattccagtcagtcgtttatgaatcctggggcctgtgcttactagagggagggcaaggcaagttaggatccgagatgagggggagaaatgactccgggaacagcaagccggttgtgctgtgctgtgtgatgatcgtgtgcctatgcctcctcttcttgtatttctcgggctccnatgggacagctgggagcaccgcatttgagtacgggaccaaattctcacggtcacttggatggggcagtgatgatggttctgaagagtccattttgggaacgggggatgcagatgatgtcaagcccagagctttcttggtgtgtgatgaccggcactctgagctgatcccctgctttgatcggaactggatatattcaatgaggctggagctgggattaaacttgatggagcactatgagaggcattgccctcaccctgaa

SEQ ID NO: 85621 - protein, 120 aa, Zea mays
  misc_feature: Ceres CLONE 1571982
  misc_feature (34)..(34): Xaa is any aa, unknown, or other
MRGRNDSGNSKPVVLCCVMIVCLCLLFLYFSGSXGTAGSTAFEYGTKFSRSLGWGSDDGSEESILGTGDADDVKPRAFLVCDDRHSELIPCFDRNWIYSMRLELGLNLMEHYERHCPHPE

SEQ ID NO: 85622 - DNA, 832 bp, Zea mays
  misc_feature: Ceres CLONE 1571985
  misc_feature: Encodes the peptide sequence at SEQ ID NO. 85623
  misc_feature (746)..(746): n is a, c, t, g, unknown, or other
  misc_feature (811)..(811): n is a, c, t, g, unknown, or other
ctccccgcggtggcggccgctctagaactagtggatcccccgggctgcaggaattcgtctcacccctagaaaaaaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtagcagctggtgctaatcctgttcagattactcgtggtattgagaaacagctaaagcactagttgaagaactacggaagttgtctaaggagggtgaagatagtgagcttgcagatngtgctgcagttagtgctgggcaacacttatgaattgggtacatgatagcagaggcatgagcaggntcggtcgggagggcgttgtcc

SEQ ID NO: 85623 - protein, 160 aa, Zea mays
  misc_feature: Ceres CLONE 1571985
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKQLKH

SEQ ID NO: 85624 - DNA, 763 bp, Zea mays
  misc_feature: Ceres CLONE 1571986
tccccgcggtggcggccgctctagaactagtggatcccccgggctgcaggaattcgtctcacccctagaaaaacccttccttcgcctccgcttcctcctcctcctcctcctgcccctcccccacccccacccgtcgggacgcctccccactttcccctcccccggatccgcatggcgcctctgcagcccgcgccgctcggcctcccgtagccgacgcccggccccgtcccaccgcccgctgcgccgagcgctgcccgtcccaggctcatatttgcacagagtcattggaggaagtttgatgtttcagcagtactgtgacctttattagatgtctttccgcagcattgtgcgtgatgtaagagatggctttgggagcttgtctcgaagagggtttgaggtgaagtttctgggccaccgccgaagcagatctcacggtgctgtccatgagctgcgtgatccagccccagtgatcaagagcagttgctgggctaatttgccccctgaaattgctcgagatgtgaatgaagaggttgggaggccagtgaaggcaacatgccctaacaggaaagagtgtagtcctcttgtgcaagctggtttgtccggaccctggaaaagaaaatctgccaaaaaaaatccgtttagaaattcccaaagttccccgtgaaaaaaacacctttttcccggggggcccttaaaaacaaaacctgggggcctcccaaaatgtaaaccctcccagggggttttacctaagaaagggaaaata

SEQ ID NO: 85625 - DNA, 870 bp, Zea mays
  misc_feature: Ceres CLONE 1571988
  misc_feature: Translation starting site: 172
ggagctccccgcggtggcggccgctctagaactagtggatcccccgggctgcaggaattcgtctcacccctagaaaaaacctcacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagccgccaaatgcgccggcgagcagccttaccgcctcgcgggcttcctggccgtctgcgccgtggccttcgtcgtgacatgcctcctccactggtgcttcccgggaggcccggcgtgggggaggtggtggtggacgcggcggctcggtgccggtgccggtggcggcgcgacggcggtggcggcggccctgccggggccgaggggcctgcccgtggtcgggagcatgtggctcatgacgggcctggcgcaccgcaagctcgcggcggcggcggggagcctcggcgccaggcgcctgatggccttctccctcgggggcacgagggtgggtggtggcctcgcaaccggacgtggcgcgcgagatcctcagcagcccggcgtttccggaccggcccatcaaggagtcccccgtacgggctcctggttccaacgcgccatcggcttcgcgccctacggcggcccaaggggggcgcgcttgcgcccccgtggcggtccacgcacccttttcttccccgcgggagggcgccccccgttcggcccgcccagcgccccccttatttgaggtgtcccaaagtggtccgggcccccatctaaggaaaccttgttcggcgggctcttccctcgtgggaggggcccgacccgggtaaccagaaga

SEQ ID NO: 85626 - DNA, 819 bp, Zea mays
  misc_feature: Ceres CLONE 1571989
  misc_feature: Translation starting site: 492
gctggagctccccgcggtggcggccgctctagaactagtggatcccccgggctgcaggaattcgtctcacccctagaaaaaaactcccatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgccctctccaatcttcatttaaggtgactgttttggaatcgagagatcgtattggcgggcgcattcatactgataactcggttgaatgccaatttgatatgggaagctcatggctacacggcgtgtgcaatgagaatcactggcaccattgaatagctatcttgggctgaagttatccgcaccagcgatgataactcagttctgaatt

SEQ ID NO: 85627 - DNA, 829 bp, Zea mays
  misc_feature: Ceres CLONE 1571990
  misc_feature: Encodes the peptide sequence at SEQ ID NO. 85628
ggagctccccgcggtggcggccgctctagaactagtggatcccccgggctgcaggaattcgtctcacccctagaaaaaatggacgcacgcctcccggggctctcgtgtccctgtccgtctcccgtttgcggcctccacagcaacgcggcgcgcggggtggcggtgctctcgcgatcctcgtgtcgattccagcggcgggggtgccattccctcccctggccgttgcccgcgcctcgcggtcgcgcaccggaaccggagccccgccgcgaatcgagggttgcctccgcctcgccccctcctcccgagactcctagcggcaggaattaggacgagggtaacaggcgacagaggctgcgaaggacgccccttcgtcaaatgcgccggcgaccgatccgtggaggagcagccggagcacgcaggagttgaagggcaagctttgaaaatgtcatccactgtgccgaagtcatcaaatatcttctggcatgattgcctagttggcaagactgatcgccagaagctactcaaccagaaaggctgtgttgtctggatcacaggccttagtggctcaggtaaaagtaccttggcatgtacattaggccgggagctccacacaagagggaagcttgcatatgttctttgacggtgataactttaagacatggtctgaaacaaagatcttggcttttaagcttgaaaaccgtgctgaaaatattaagaaaagttgggtaagtgtctcacccattttggataaaaaagggaccgaccctagtggctgggtggggaagggaataacccaagacaagccctttaccctgcaattggaatcgaa

SEQ ID NO: 85628 - protein, 65 aa, Zea mays
  misc_feature: Ceres CLONE 1571990
  misc_feature: SWISSPROT Homolog: EC 2.7.1.25 Adenylyl-sulfate kinase
MSSTVPKSSNIFWHDCLVGKTDRQKLLNQKGCVVWITGLSGSGKSTLACTLGRELHTRGKLAYVL

SEQ ID NO: 85629 - DNA, 738 bp, Zea mays
  misc_feature: Ceres CLONE 1571993
  misc_feature: Encodes the peptide sequence at SEQ ID NO. 85630
  misc_feature (498)..(498): n is a, c, t, g, unknown, or other
ggagctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtgggggggagccacctacgacctcgccacgtgctcngctttctcgccgtcttcggcttccaccatctccgtcttacatcatggtccagggcccaaggcccgggggacccttaattgaacttttgcaatggttaaaaaagccggggccaaaaaaaaatttaaggggggggtcccaagggggggggaaattttttcttcgaaaccctggggggcgcgcccaaaaatttccccgggggggaaaaaaattttttttctacaaaaaagaaagaaaaaaaaa

SEQ ID NO: 85630 - protein, 128 aa, Zea mays
  misc_feature: Ceres CLONE 1571993
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGGATYDLATCSAFSPSSASTISVLHHGPGPKARGTLN

SEQ ID NO: 85631 - DNA, 856 bp, Zea mays
  misc_feature: Ceres CLONE 1571994
  misc_feature: Translation starting site: 441
  misc_feature: SWISSPROT Homolog: EC 5.3.1.5 Xylose isomerase
gagctccccgcggtggcggccgctctagaactagtggatcccccgggctgcaggaattcgtctcacccctagaaaaaatctgcgagagtttcatttgggggctctaaaatagcctcgccctcctcgtgccttatcttcatctcacctcctctttctcctccgtgctgatcggcagtctctaagctttgcaacaactgatagccgaattccgcgcgccggtccctaaaaaaatgcaagtactaggtagtagataagatgcatttcccagtaatttttcgttattatatatacgcagcacgggaaggaggggagacactctgttcaaccaccagccgagttcgcagcggcactccaggtccagcagtctcttcggctcttcgttggtggtgcgtggacaccggaaattacctcggggattgcgttcctgatctaagcccggcatgaagtgctgctcagagcgtttgctgctcctgctcctgctgctgctggcatcgtcgtcgttactgtccgtcgtggttgccgcgcagcagacttgccctgccgacctcgacagcaaatgcgacggtggtgcgcctgatgactggggaggggaattcttccctcggcgtcccgaaaatcaagtatgaaggtccaacaagcaaggaccctctttgcttataagtgggtatacaagggagggagtcattcttcggaaagaagatgaaggactggatgcgctttcagtggtgcgttctgggcacacgtttcgtgggtactgggcgccggatcctttttggtgcggcctaccaaaggttttggcctttgggaggacgggcaccaaattccgtttggcccatggcctaaagagaaggaatgg

SEQ ID NO: 85632 - DNA, 1221 bp, Zea mays
  misc_feature: Ceres CLONE 1571996
  misc_feature: Translation starting site: 272
  misc_feature: SWISSPROT Homolog: EC 5.2.1.8 Peptidylprolyl isomerase
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (67)..(67): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (1221)..(1221): n is a, c, t, g, unknown, or other
ntttttnnnttttcttnnnaaactctaataaatgagcgatgaaaatcaggctntnnnttnnnanagnntnnnnnaaagctggagctccccgcggtggcggccgctctagactagtggatcccccgggctgcaggaattcgtctcacccctagaaaaacatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaaagctgcttcaaggagggcgagggctgggagactcccgaggtcggcgacgaggttgaagtgcattacacgggcacgctccttgaagggacaaaattcgactcaagcccgtgatcgtgggagaacccttcaagtttcaagcttgggacaagggtccaagtgattaaaggggttggggattcaagggaattcaaagaacccttggaaaagaaaagggaagaaaaaatggcctatttttttacccaattttccttcccagaaagcctggggcgctttaatggagaaagccatttctgtgggtttttaaaccttttcgccaagattttattcgtccaaatccctccaatttgtgcccaaaaacaccccctgtgctagaagttttttaggtaatgtggttgtgatgggaagagctgtggacactttttttcgagctgggagggaccccccagagtggggtgtctcacaaataaagacactatttttgtgtgccaaaaaatattattgggggcgcggggcgccaaaatatctgttccacaaagtaaagaagaatctccctctttaaacagacaaatggggggaagagaagaaaaatagtggggggaaggaaacacccccaacaaaagggggtatctccttgatattctaacaaattcacccgttttgcttaaacaaaaaatattaagagggaccccccttcttcttggaaacaaaaataggcgctccctctgttggtgtattcccccaaaggttttagagaggggggtgtttcaagagatttatatcggcgtggaaacaaatagcgccgccttn

SEQ ID NO: 85633 - DNA, 760 bp, Zea mays
  misc_feature: Ceres CLONE 1571998
  misc_feature: Encodes the peptide sequence at SEQ ID NO. 85634
ctcaccgcggtggcggccgctctagaagtagtggatcccccgcggctgcatgaattcctctcacccctagaaaatcgcatccgcataattgaatgtcctcctcatctccccctcactgcagcgcatccacatctggcaatttctccacctcatcctcctcgcccctgtgcctcaacatcacatatccgctccatctatagaaggccaccacgcgccatggatcaccgctctctaccgccacctcaatagaaggttcaccgttctctacgacggatacgccacgtcctcctcggccggcgtcaataaaaggtcccagatctcctctcccattacttctctccccattaccgcgctcgaggtctgccatttttggaggtccgcgacttactgctctgctcgccgtcaatggaaggtcctagatatcctcgacctattaccgcgctcgagtcagagagaggtccgccatttctggaacgtacgccacctcctcatcgaccgtagcaatatggcgtgtgagatccgccaccttctaatcagtccgaggctaagatggtgtgggagatcagccacctgaactactccattctgactcacgagcctgatatgaaatgtccacagatgggactctgacgtctaggtcatggctgaaccgaaccccttctccccctgcctcgcgcgcggcggccaaaatggtggtgggctggggtggttcggaatggtgggtctaacctggccctccctggtattcttccccccaaag

SEQ ID NO: 85634 - protein, 40 aa, Zea mays
  misc_feature: Ceres CLONE 1571998
MAEPNPFSPCLARGGQNGGGLGWFGMVGLTWPSLVFFPPK

SEQ ID NO: 85635 - DNA, 826 bp, Zea mays
  misc_feature: Ceres CLONE 1572000
  misc_feature: Translation starting site: 528
tggagctccccgcggtggcggccgctctagaactagtggatcccccgggctgcaggaattcgtctcacccctagaaaaagttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaacatggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctccaaatgcatgatcatgggggcctcggcgtcatcggtttggtacaacctccaggtgtcgcacccgaccaaggaggcgccgtcatcgactacaagctcgcgttgctcttccagcccatgcttatgctcggcataaccatcggcgtagagctcagcgtcatcttcccatactggctaatcactgtcctcaataataatcctcttcgaaggcacctcgtcgagatccttctacaggggattctgatgggggagggaggagaccaggattctgacggagacacgcggggcgagagagcaatccagta

SEQ ID NO: 85636 - DNA, 1129 bp, Zea mays
  misc_feature: Ceres CLONE 1572001
  misc_feature: SWISSPROT Homolog: EC 1.4.1.2 Glutamate dehydrogenase
  misc_feature (17)..(17): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (1037)..(1037): n is a, c, t, g, unknown, or other
ggagggggaagtagtanaacggatagtgtcgtctgtattttnngnnngnggggggggggggggggnnnnnnnnnnnnnggggctccccgcggtggcggccgctctagaatagtggatcccccgggctgcaggaattcgtctcacccctagaaaaaaaagaggagaccaagaagctcgggaccgtgatcggtatcgatctcggtaccacctactcctgtgtcggtgtgtacaagaacggtcatgtcgagatcatcgccaatgaccagggtaaccgtatcacaccctcatgggttgccttcaccgatagcgagaggctcatcggtgaggctgccaagaaccaggcagccgtcaaccctgagaggaccatctttgacgtcaagcgtctcatcggaagaaagttcgcggacaaggaagtccagagggacatgaaacttgttccctacaagattattaacaaggatggcaagccctacattcaagtcaagatcaaggatggggagaacaaggtcttcagccctgaagagatcagtgccatgattctttggcaaagatgaagggatacttgctgagggcattaccttggcaaagaagatcaaatgattgctggtccgtcacttgtttcccttgcctaactttcaaatggaatgcgccagaaaggccagggccaacccaagggaaggcctgggggtggttcattttggcccgggcccctccaatgggtttggcctcaaggggatttcatttcacaatgtgaaagcccccaaaacttggggcctggaccgtggcctataatttgggccacctaatggggggtttttggggaaaccaaaaaaaaagggggttggtgccaaaaaaaaaaaaaaaacactccccctttgggtcttctttgaaaacccttgtggggggggggggggaaaacattttttgtgaatggttccaggttatttcttgtggaccacaattggaaaaaaaccggggtggtggtttttttagaggggggttttggccccaaccaaagtggggggacaaccctcccnttcttggggaaaggtggggaggaaacttgtttaacctccaggaggattcttttgggagagtttttttattatcagactttgaacaaagaaag

SEQ ID NO: 85637 - DNA, 852 bp, Zea mays
  misc_feature: Ceres CLONE 1572002
  misc_feature: Encodes the peptide sequence at SEQ ID NO. 85638
  misc_feature (823)..(823): n is a, c, t, g, unknown, or other
tccccgcggtggcggccgctctagaactagtggatcccccgggctgcaggaattcgtctcacccctagaaaaaagcgagccacagtgaactcgtcgcgtgccccgccttatttaacgccctctccccgcagcagcagcggcacctccggacgaaatctgacccgggccaccgtcggcactgctctgacatggcgatccgctccaaggcctggatctcgctgctgctagcgctcgccgcggtgctctccgcccgggcggaggagcccgccgcggcggaggctgaggccgtgctcaccctcgacgtcgacagcttcgacgaggccgtcgccaagcaccccttcatggtcgtcgagttctacgccccatggtgtggacattgtaagaaacttgcttcagagtacgagaatgcggccaaagaacttagcaagcctgacccaccggattgttccccctaaggggtgatgctaacccagggaaaaaaaaaacgggccccctttgtctttccccggggttcccaaaaaaaaacccagggggggggtctcccccccccccccccccccaaaaaaaatttttttttttaaaaaacaacgggggggggagaaaaaacaaaaataatttttcttcttaaaaaaaaaaaaaaaaagagacacccgcccccaccctcctatagaaaggggagagagagagaaaaagcggggacggccagacgttgttttgttttttttactttttttcttctcttctgtgagaaaaaacaaaaccaagcaggggggggggggggggaggagggtgggtggtgtgttgtcggtcgcgcgtcctcttntggtgtttgataaacaaaaaaagaaaaag

SEQ ID NO: 85638 - protein, 88 aa, Zea mays
  misc_feature: Ceres CLONE 1572002
  misc_feature (33)..(87): Pfam Name: Thioredoxin Pfam Description: Thioredoxin
  misc_feature: SWISSPROT Homolog: EC 5.3.4.1 Protein disulfide-isomerase
MAIRSKAWISLLLALAAVLSARAEEPAAAEAEAVLTLDVDSFDEAVAKHPFMVVEFYAPWCGHCKKLASEYENAAKELSKPDPPDCSP

SEQ ID NO: 85639 - DNA, 1082 bp, Zea mays
  misc_feature: Ceres CLONE 1572003
  misc_feature (17)..(17): n is a, c, t, g, unknown, or other
  misc_feature (19)..(19): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (611)..(611): n is a, c, t, g, unknown, or other
  misc_feature (1082)..(1082): n is a, c, t, g, unknown, or other
gggggggcggggggcgngncggggagtccggcgggccatggggcgagcgatattatatatatagatannnnccaagctggagctcaccgcggtggcggccgctctagaatagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggcgcgcccgagttcgtcgaggccgcggcggagtccggcgaagccgcccacggctgcagctgcggtggcaactgcaagtgcgacccctgcaactgctgatcacatcgatcgacgaccatggatatggattattatccaacctaagcctgggggggggtgggtttgaaacaaataataaaccgaagggccgaaaccttggcttgcccctaaaataaggggaatttggggtggggggggggtttgttcccccnggtacggggggggaaaaaccccgggggtgtttccttcccaaggtttttttggccctaaaaaaaaaaaaaaaaaaaaaaaaaaaaaatttcccccgcgtttcaaaccaggttttttgtgggggggggaatatatattcccccgggggggggtttgttttataaaaaaaaacaccgcgggggggagagaaaaaccccccgggggcgccccccccccacgcctctcttattatacaaaccaacccaccccccccgcgaaagacccccgccccagaataacaaaaaaattcgcgccgttcttgaggatgtttttcccatcttttgtcccccccaacaaagaaaccccccccggggggaaaacccccacccccatattcgccttttttttcccccacccccccacgagggagagagggcggggttttccacctctttttctgtggaggcgataagtcagaggcggccgcgcccacn

SEQ ID NO: 85640 - DNA, 829 bp, Zea mays
  misc_feature: Ceres CLONE 1572004
  misc_feature (829)..(829): n is a, c, t, g, unknown, or other
ccccgcggtggcggccgctctagaactagtggatcccccgggctgcaggaattcgtctcacccctagaaaaaggcagggaggcgctcacgcaaaactacgcataagtctccgattgacggtttcactactgttgctgccgccacgccatgagagacggaggctgtttgttccctgccgccgtctgattataattctagtcaacctccgcatgctcttacctcaagacaccgtctcctccggagccccaccaacaatcgtctcgcgtgcacctcacgactcgacgccgtgagccagtcccgcggacactctacgagcggctgctccaggtctcacctgctgagacccaatacgtccaaaccgctgttgatgtagaggatggaagagggatcgctgaaggcgatcaactgggaactgaagagatggaggaactggatcaacgacagccaaccaaggattgactgaatagcatgcagcagcagcaagaacatgatgaatcctcggcatgcgcaacacggactaagctcatcaaaggcatatagatatctaccgagaatgcttatctgattggccgttgagatcaaacagaacagatggaacctgatgtgcatacacgtagtcccttaaggagctgatagccttaggttgataccgcagggacttttggtcattggggtcaacctattaggaagattactcccccgaatgcgagggacttaacatgggttaagggaaaggtttgggaaaatctcggactgcaaggcccatgttccttggaagtggaaaattgccaattttgaaggattagtaatttttcccccggggggaaan

SEQ ID NO: 85641 - DNA, 789 bp, Zea mays
  misc_feature: Ceres CLONE 1572005
  misc_feature: Encodes the peptide sequence at SEQ ID NO. 85642
ctccccgcggtggcggccgctctagaactagtggatcccccgggctgcaggaattcgtctcacccctagaaaaaacatctgccttttgatctccgattgcgcgcttctgttcctcctcctctattcctgattttatgtgcggagtgctactgggcggccgtggatgccctcctacggcatctgtccaggttgtcctagcgcccttctgcggacgcctaaatcgtacgggtgaggcagacatcagccatggctttgtaaggcgagctccagcgacaaccggaccaagagcacgggatcctctgtgcatagtgattggcatgaggtgcttcttatacatcctccgggcgtggaacaacagcgggttccagcagggggacagcatcccgctggaggtcaccaagcggctgcagtggactgacatggccaaccatgccttcgacacacaccagtactagagacggtgaagactctagcaccctcgattgctcgcctacaacaacttcttgcagtgccctgatcgcaagacggacttgaagctctggccagactgatacagggtgatgacatacgatgtggagaacatgaatgacagtgagcgggattgctatgttcacaaggagaactgctctggttggttccacacccgggatgctatgtagcctctcttctgtggacgaaagcctggactatgtctctctggcaaattcattctatgagagattgacaatcgagatggcatactgaagtgggtccgatatgagggcagtgaatcatagttcctggaagatg

SEQ ID NO: 85642 - protein, 106 aa, Zea mays
  misc_feature: Ceres CLONE 1572005
MCGVLLGGRGCPPTASVQVVLAPFCGRLNRTGEADISHGFVRRAPATTGPRARDPLCIVIGMRCFLYILRAWNNSGFQQGDSIPLEVTKRLQWTDMANHAFDTHQY

SEQ ID NO: 85643 - DNA, 841 bp, Zea mays
  misc_feature: Ceres CLONE 1572007
  misc_feature: Encodes the peptide sequence at SEQ ID NO. 85644
ggagctccccgcggtggcggccgctctagaactagtggatcccccgggctgcaggaattcgtctcacccctagaaaaagccagttcacctccgcctccgctcctcccctccccctcccgtcctgccatggccaccgcagcacgcgccctcgtcgccgcacgcccggcacggccgctgctgccgtctcggcgcctcccgtcctcctcttccatccgtcccgcgcggcaacgtgctggcgtcgggtgcgtccgctgcatggctcggcggccggattccacctattccccgctgcgttcgggccagggcggtgaccgtgcaccgactgaaatggcgcctctgttccctggctgcgactacgagcactggctcatcgtcatggacaagcccgggggcgagggcgccaccaagcagcaaatgatagattgttacatccagacccttgcccaggtggtagggagtgaagaggaggcgaagaagaggatatataatgtgtcctgcgagcgctattttggattcggatgcgaaattgacgaggagacctccacaaactcgaaggccttccaggggttctttttgtgcttcctgactcttacgttgatgctgagaacaagggatatgggtgctgagttatttgtgaaacggtgaaatcgttcagcgatctccaagaaagcagagaggggtggagccagtgcctcagagagctcaggatcgaccacggtacagtgaccggacccgctatgtgaagcggaagggagaacaaatcttaccagaaaagaatgtttcggtctctgaagaagtaaaaaagtcagggttttccacaagtggccaaaatgcgggaata

SEQ ID NO: 85644 - protein, 172 aa, Zea mays
  misc_feature: Ceres CLONE 1572007
MATAARALVAARPARPLLPSRRLPSSSSIRPARQRAGVGCVRCMARRPDSTYSPLRSGQGGDRAPTEMAPLFPGCDYEHWLIVMDKPGGEGATKQQMIDCYIQTLAQVVGSEEEAKKRIYNVSCERYFGFGCEIDEETSTNSKAFQGFFLCFLTLTLMLRTRDMGAELFVKR

SEQ ID NO: 85645 - DNA, 791 bp, Zea mays
  misc_feature: Ceres CLONE 1572010
  misc_feature: Encodes the peptide sequence at SEQ ID NO. 85646
  misc_feature (550)..(550): n is a, c, t, g, unknown, or other
  misc_feature (608)..(608): n is a, c, t, g, unknown, or other
  misc_feature (609)..(609): n is a, c, t, g, unknown, or other
  misc_feature (643)..(643): n is a, c, t, g, unknown, or other
  misc_feature (670)..(670): n is a, c, t, g, unknown, or other
ctccccgcggtggcggccgctctagaactagtggatcccccgggctgcaggaattcgtctcacccctagaaaaagaaggcagacgccgaaccaaaccaaaaggcgaaggcgaagaagaccaaccaaagcaaagccaacgggatctccctctcattccagaggactccgcgtcgccaggcccgcttcgcgtgcgacgccggcatatagggtttcgccggcgccggcgatggacccaccccccgtgagccccgatcgctgggggcccagtcagggcgctggcgtcgggccctccggcctccgccgatatggcctcaatttctccgcctccagcctcctccaggcccccatcgcggccctccttgagtactccggcgtagtccagtccggccctgccctggcggcgcaccacccgtccgcggggccctcgtcgccgttgtccgcgtcggaggtcgatggtcttctctccgctgccgccgctggggacggggaggtttcgatccggattcagggcggcccaggcgacacggaggccacgggcgggccggatgcngggacctcgtccgaggatttgatcgaggcgaccgccggctctgaggttgacccagccnntcgctgcggcaggggtgcaggtgctacggatgcngaggcaaacggtggcggggccggcacntcggggaacgggggcggggaacgcgcgtacaagcgctacaacgtggaacccgttggcggggggggttcgaacagaaatttggccggtttccgtgggtttttaaccggggggttttaaaaga

SEQ ID NO: 85646 - protein, 186 aa, Zea mays
  misc_feature: Ceres CLONE 1572010
  misc_feature (128)..(128): Xaa is any aa, unknown, or other
MDPPPVSPDRWGPSQGAGVGPSGLRRYGLNFSASSLLQAPIAALLEYSGVVQSGPALAAHHPSAGPSSPLSASEVDGLLSAAAAGDGEVSIRIQGGPGDTEATGGPDAGTSSEDLIEATAGSEVDPAXRCGRGAGATDAEANGGGAGTSGNGGGERAYKRYNVEPVGGGGSNRNLAGFRGFLTGGF

SEQ ID NO: 85647 - DNA, 827 bp, Zea mays
  misc_feature: Ceres CLONE 1572012
  misc_feature: Encodes the peptide sequence at SEQ ID NO. 85648
  misc_feature (652)..(652): n is a, c, t, g, unknown, or other
  misc_feature (735)..(735): n is a, c, t, g, unknown, or other
tccccgcggtggcggccgctctagaactagtggatcccccgggctgcaggaattcgtctcacccctagaaaaaagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgaacccatggccagcagaagaaccctatctctgcacagcacccatcaaggtaactaataactgttcgcaactattgtatcgggccggctctaaaaggccttcgtgagaaaactgaattcgtatgtgctgtgctgctgcatgggtgatgggcgcagtatcagttcgccaactactctgcgaactacatctactggggcaagggcagcatccggctgcagctcatncaccagcgctccgacttctccttcgccctcttcaccggcggcctcagcaccccgaggttgatcgcggtgtcggagcccatatncggtcagacccccaaggcgcccgtgttcccgcgcctggcgcagggcacgtcccacacgagatgacggtgacgtggaccagcggctacgcatt

SEQ ID NO: 85648 - protein, 130 aa, Zea mays
  misc_feature: Ceres CLONE 1572012
MAVALLAALVASAAMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKVTNNCSQLLYRAGSKRPS

SEQ ID NO: 85649 - DNA, 844 bp, Zea mays
  misc_feature: Ceres CLONE 1572013
  misc_feature: Encodes the peptide sequence at SEQ ID NO. 85650
  misc_feature (844)..(844): n is a, c, t, g, unknown, or other
tacccgcggtggcggccgctctagaactagtggatcccccgggctgcaggaattcgtctcacccctagaaaaatttcccgcctgcctccccaagctacccagctacctacctaccttccccctgcgccgtcactagcgaaccggcaccatgctccgggcgctcaacccgtccccgtcccagctccgcgcgcgtccggcgtgccgcgccgcgccgcgccggcgcccgcgcggggcctgggcgcgcccccgtgccgcggcggtcccgcagcagccgccggtgcgccggccctccggagaccggctgcgcgcgccgtcacggggcgccgccgccgccgaccagctgccggcgcctgatgttggcgcggcggcgcccggggcgcggggcgagctggaggcgttcctggagattgtgcccgcgaggatgcagcgcgggctggcgcggcaccaggagctgcgggacctcgtcgaggtcatcatggacctcggccgccgcccgatcgcgcggttcccgtccggggactgggccatctccgaagagcccgtcaccaccgatgacctccgccaggccgtctacaaggtaagtgacttctctgaggacaacctatctgggatcaatcactcgttgcaccggatcaacgctatccggaaccgggaaagctcaaatcatacgcctcacttggccgtggttggtcgaaatatttcttgcaatgccaagaatgatccgggactttggtgggaaatggggggttcaataattggcggattggaccctcctgggaactggggaaaaacccctctggatcaaggaaaaaaccctagaaattttggccaataggaaaggtan

SEQ ID NO: 85650 - protein, 228 aa, Zea mays
  misc_feature: Ceres CLONE 1572013
MLRALNPSPSQLRARPACRAAPRRRPRGAWARPRAAAVPQQPPVRRPSGDRLRAPSRGAAAADQLPAPDVGAAAPGARGELEAFLEIVPARMQRGLARHQELRDLVEVIMDLGRRPIARFPSGDWAISEEPVTTDDLRQAVYKVSDFSEDNLSGINHSLHRINAIRNRESSNHTPHLAVVGRNISCNAKNDPGLWWEMGGSIIGGLDPPGNWGKTPLDQGKNPRNFGQ

SEQ ID NO: 85651 - DNA, 960 bp, Zea mays
  misc_feature: Ceres CLONE 1572014
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (70)..(70): n is a, c, t, g, unknown, or other
  misc_feature (71)..(71): n is a, c, t, g, unknown, or other
  misc_feature (814)..(814): n is a, c, t, g, unknown, or other
  misc_feature (815)..(815): n is a, c, t, g, unknown, or other
nttttnnnnnnnaattctctcccctctccccttccctgattatggaaatggtgttatgtaaaaaaaaaannaaagatgggctccccgcggtggcggccgctctagaatagtggatcccccgggctgcaggaattcgtctcacccctagaaaaacggccggacaagtaaacgctaaggccgcatccagctttaaaatcaaaaccaggccgcacgagcacactctctcctctcactcgcgtccgcacaaatcccgtgctcccccgtctgaaaaccctccccacctccggcggcggcggcggcgctggcgaccgggtgtcttctccggcgagtctcccccctagtaacaagaaaatatggatgtacctgttgatgaccctgtgggaagaaccttcactgggaagtccctagtaccccctttgggcaaatgagggaaaaaaaacccccctacctttatggcctaaaaggggggccaaaaaattccaagtccccaagggggaaaaaaaaaacccccggaaaaaaaaagcgcctttttttttcccggaaaggggggaaaaaccccccccaaaaaaaggaacaaaccccccccacaaagttgtgcgccccaaagagaaaaacccccgcaaacaagtgtttttttttgtggggggggggggttgttaaaaaaaccacccccccaaaagggggggggggggcgccaaaattaattgttggttttagaaaacaacccccacttttgttaaaaacacacaacaaaattgtgtggaaaaaaaaaatatttttttttttgtgggaaaaaagaaggcccccccccccnnaaaaccccaacaagggggtgggggagaaaaacccaaaaaagagtttttacacccccccccacccaaaagaaaaacacccccccgggggcaaaagaaaaaaaaaacccgggggggggggaaaaaaaacacacccccctttttttgc

SEQ ID NO: 85652 - DNA, 831 bp, Zea mays
  misc_feature: Ceres CLONE 1572019
  misc_feature: Encodes the peptide sequence at SEQ ID NO. 85653
ctccccgcggtggcggccgctctagaactagtggatcccccgggctgcaggaattcgtctcacccctagaaaaagcaaatcccacaccaaccagagccaccctgccgtcgtaggcgcacgcgccgtagataggaagcttattaagctagcgcgtgtcgctgcgccatcctgccatggaggatcaggcgctggcgccgctgctgcagccgctcccgctcggcgaaacgggggccatcaaggggcgcgcgaggcgggcggcgctggagtggtgggtggagtcgaagaagctatggcacatcgtgggcccggccatcttccaacggatcgcgctgtacggggtcaacgtcgtcacgcagtccttcatcggccacctcggcgacctcgagctcgccgccttctccattgctgccaccgtcgtcgggggcttcaacttcggtttcctgctgggaatggcgagcgcgctggagacgctgtgcgggcaggcgttcggcgccaagaagcaccacatgctgggggtgtacctgcagcgctcctggatcgtgctcctcatcttcgccgccgcgctgacgccgacgtacatcttcatggaggacctgctgctgctgatcgggcagtccccggagctgtcccggctggcggggcaaatgagcgtgtggctgctcccgcagcacttcgccatggcgatgctgctcccgctcacgcggttcctgcaaaacagctggagaactggggtgaccgccaataccgcgggccgtcgcggctcgccatccaagttggtcgccacccaaggtggtaggggggtttccttcaactttgggaatcgttgggggt

SEQ ID NO: 85653 - protein, 219 aa, Zea mays
  misc_feature: Ceres CLONE 1572019
  misc_feature (45)..(201): Pfam Name: MatE Pfam Description: MatE
MEDQALAPLLQPLPLGETGAIKGRARRAALEWWVESKKLWHIVGPAIFQRIALYGVNVVTQSFIGHLGDLELAAFSIAATVVGGFNFGFLLGMASALETLCGQAFGAKKHHMLGVYLQRSWIVLLIFAAALTPTYIFMEDLLLLIGQSPELSRLAGQMSVWLLPQHFAMAMLLPLTRFLQNSWRTGVTANTAGRRGSPSKLVATQGGRGVSFNFGNRWG

SEQ ID NO: 85654 - DNA, 826 bp, Zea mays
  misc_feature: Ceres CLONE 1572021
  misc_feature: Encodes the peptide sequence at SEQ ID NO. 85655
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (681)..(681): n is a, c, t, g, unknown, or other
agctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgaaaaaaagagaaacagagttcttcagtttgctaaaaaaaaaaaaaatcccgtcacgttcggcgattccggggtataaaaaccgggagcacgcgcccccnnntctacaccacgcagccgcagcacaatcgcctcgccttccctttccccacagcccccgtctctctctctctctttctctctcncgtagccgcgtccacctcgcagcagcaagcaagcgcgaccaaatggcgccctctagagacgggcgagctgctgcccgcggcgcgtcaaacaactgggtgtgtcgttcggcgagatgctgatcgactttctcccgacgtggcccgg

SEQ ID NO: 85655 - protein, 76 aa, Zea mays; identical to SEQ ID NO: 8464
  misc_feature: Ceres CLONE 1572021
  misc_feature (1)..(76): Pfam Name: Metallothio_2 Pfam Description: Metallothionein

SEQ ID NO: 85656 - DNA, 790 bp, Zea mays
  misc_feature: Ceres CLONE 1572022
  misc_feature: Encodes the peptide sequence at SEQ ID NO. 85657
  misc_feature (505)..(505): n is a, c, t, g, unknown, or other
  misc_feature (517)..(517): n is a, c, t, g, unknown, or other
ccccgcggtggcggccgctctagaactagtggatcccccgggctgcaggaattcgtctcacccctagaaaaagaaccctcgcgccgccgcctactccagcctccagcgtgatctgagtcctgaccaagccctaaacgccaccgccctcgcaaatctcctttcccttcgatccatggccgccgccgtcgccgcccccgcgccatcccgcaagacggagacctacaccgacaccaagcgccgcgacgacgtgcgcggcgccaacatcgccgctgcgcgcgccgtcgccgacgccgtgcgcacctcgctgggcccccgtggcatggataagatgatcgcttcgggcgaccaggctcaggaggtcatcatcaccaacgacggtgccaccatcctttcccgcatggcgctcctccagcccgccgcgcgcatgctcgccgagctatcccgctcccaggacgccgccgctggggacggcaccactaccgtcgtcgtcctcgctggatccctncctcgcgcgccnagtcgctcctctccgcgggggctcacccaacgcggctgcgacgcccctcacgtctcggcacgcgcgctgttgagatcctcacggcatggcatccccatcgagctatccgaccggggatccctcggcaagtctggcgtccacggcttctcaactcaagggtcgtctcccagaaatccaacctttttttggccccttggcggttgagcccgccctttttgggggggggaccccggctaacccggaactttttgaacctccggggaaatcccggat

SEQ ID NO: 85657 - protein, 182 aa, Zea mays
  misc_feature: Ceres CLONE 1572022
MAAAVAAPAPSRKTETYTDTKRRDDVRGANIAAARAVADAVRTSLGPRGMDKMIASGDQAQEVIITNDGATILSRMALLQPAARMLAELSRSQDAAAGDGTTTVVVLAGSLPRAPSRSSPRGLTQRGCDAPHVSARALLRSSRHGIPIELSDRGSLGKSGVHGFSTQGSSPRNPTFFWPLGG

SEQ ID NO: 85658 - DNA, 1195 bp, Zea mays
  misc_feature: Ceres CLONE 1572027
  misc_feature: Encodes the peptide sequence at SEQ ID NO. 85659
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (64)..(64): n is a, c, t, g, unknown, or other
  misc_feature (66)..(66): n is a, c, t, g, unknown, or other
  misc_feature (73)..(73): n is a, c, t, g, unknown, or other
  misc_feature (74)..(74): n is a, c, t, g, unknown, or other
nnnnaaaccccaccccccttcccgacaacgacaccctacgcgccatcaacacacgtattaaacntnaaataannaaaactggagctccccgcggtggcggccgctctagaactagtggatcccccgggctgcaggaattcgtctcacccctagaaaaaagcctcggctggacatcgagtttgtaccgggaaacagcttggtagtataaccactgaagatggtcagtgggaggccgcatggtgaattggactcatggttcaagagcctcatggtgacctctagcagcgagagggggcaggctgggagtggtggtccagcgccaacattaacaggatggaaggaccttccgatggagctcctggtgcggataatatccccagttggagatgataggatggtcatcgtggcgtctggtgtttgcacaggctggcttgacgcgctgggatgggggggcactaatctttcactttcatggtgcaaactggagcatgaataattttaaatgaaatctcttgccccacaaattcacgaaagtatgcaagttctccactctcccggcgaaactaaactctcagcctttgaaaaaacaatgcccataaaaagggctggtgtgccaaacttacgtggcccattggacctatacgttggaggtttacgaacccctccaacccaggaaaacctttccagggctcttttaaaaggaaccgcggcccccccattaagaaaaataccagccgtggggactccctactgggagaaagtgtcgccccacccccgaggggcctttaatacatcgagataacatcttcataacaccttctttccaaaggggggcgagatggtggtgtgcacagaggtttgtttcaaccgacacatacacaacatggtaccctgtaggaaaaatattttaccccactaataacctagggaccctcgtccgtgtgataaaaagaaaacccctttccatgggttgtttcacattaaactctcttgttgtgttcggaaatacacccctaacgaggggcgtatggtatgtacctggacgcaaatgagctttttttgccaagtgctatttttactatgacataaagtgggtgggtgaaaattcttaccacatttttctatacaccataagacactgggcgggtcaagaaagatttgtaccccaataagagggagtcgaccccgaacttga

SEQ ID NO: 85659 - protein, 92 aa, Zea mays
  misc_feature: Ceres CLONE 1572027
MVSGRPHGELDSWFKSLMVTSSSERGQAGSGGPAPTLTGWKDLPMELLVRIISPVGDDRMVIVASGVCTGWLDALGWGGTNLSLSWCKLEHE

SEQ ID NO: 85660 - DNA, 1223 bp, Zea mays
  misc_feature: Ceres CLONE 1572028
  misc_feature: Encodes the peptide sequence at SEQ ID NO. 85661
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (285)..(285): n is a, c, t, g, unknown, or other
  misc_feature (512)..(512): n is a, c, t, g, unknown, or other
  misc_feature (942)..(942): n is a, c, t, g, unknown, or other
  misc_feature (1015)..(1015): n is a, c, t, g, unknown, or other
  misc_feature (1053)..(1053): n is a, c, t, g, unknown, or other
  misc_feature (1160)..(1160): n is a, c, t, g, unknown, or other
ttggggggggnnnntnnnnccccgctctctcacccccctnnnnnnnnccacatnnnnnnnnnnnccccaannnnnnaaccatggggctccccgcggtggcggccgctctagaactagtggatcccccgggctgcaggaattcgtctcacccctagaaaaagcgccacgctctcctctccagtctccaccaacgtcctccccccaccgcaccgcaccgcaccgcaccgccctccccaccccgcgcgtgcgccgccgccgcgagatccggggcgcgatgtggcgcanctgcgtctcgcggggtctctccagggccaaggcctccgcctccaggctcctctccacggcatcgtcgtcctacacggtgggggaccacacctacgacgcggtcttggtgggggccgggcgccccggggtcccggcggccatgtttttcccccccccaggggggggggggggggggggttatccaacctcttccccccccctctcaaaaaaaagaacacaaaacacgncagggttaacgggcgggagcgtgggaaacctggaaggaacgaagaagtggggagggcgtcacaacgcgccggaccgcccgggaagcgggaaagagaattgcgcttcccgtgcacccaagcgaattcccagtgtcacggcggagtggcgacccggcaaatggactcccgtgaactcgggggtcctgagggaacgcggcccgcgaaccacacacgagggagagggccgcctggctcgtccacgcataacctctcagaccggacgccgcgcggcacggcaagcggatccacctcgctgtgtggtcgtcaccctttcttcgaggcagaacaacatacaatccttctgcgaaaggatggtttggtggcagcgacaagccggcgtgcgtagcctcgagcgaccgattccccgcgctggtcaaccacaaccaatttnggcggcggtacctgcctgtgtatatacgcagtccccgtcagtacgctcatacgtgacagactagcgcggtggnccagatgacgagagtaccgccgcggtgtccgcgataanactggaggtttgcgtgtgctgcgcgtacacacttatgcgatggtcgcacccctcacggcaagcatgcggtacaacctcggctgctgttagcgccgcgtctgagccanacgcggagtcccgtcattatcaagcgggtgctactgacatccgaacgtggacgctcaccgccg

SEQ ID NO: 85661 - protein, 243 aa, Zea mays
  misc_feature: Ceres CLONE 1572028
  misc_feature (4)..(4): Xaa is any aa, unknown, or other
  misc_feature (80)..(80): Xaa is any aa, unknown, or other
  misc_feature (223)..(223): Xaa is any aa, unknown, or other
MWRXCVSRGLSRAKASASRLLSTASSSYTVGDHTYDAVLVGAGRPGVPAAMFFPPPGGGGGGGYPTSSPPLSKKRTQNTXGLTGGSVGNLEGTKKWGGRHNAPDRPGSGKENCASRAPKRIPSVTAEWRPGKWTPVNSGVLRERGPRTTHEGEGRLARPRITSQTGRRAARQADPPRCVVVTLSSRQNNIQSFCERMVWWQRQAGVRSLERPIPRAGQPQPIXAAVPACVYTQSPSVRSYVTD

SEQ ID NO: 85662 - DNA, 843 bp, Zea mays
  misc_feature: Ceres CLONE 1572030
  misc_feature: Encodes the peptide sequence at SEQ ID NO. 85663
  misc_feature (812)..(812): n is a, c, t, g, unknown, or other
ctccccgcggtggcggccgctctagaactagtggatcccccgggctgcaggaattcgtctcacccctagaaaaaactcctccccaaaccacgggatctatcctactccctcctccattcggcagtgccgcgtggcacacctatatataaacacccggactccacactccccccgcatcgccgccccccgtcccgacgaattggaatacggaaagcgaaagatgatggatctcgccgacccccagcagcagcagcggctcatcgccggcgcggcgctgctgctggcaaccgcggccttcctcaggctcctcctgggctcccgctcccggggcggcaagcgcctgccgcccaccatcccgggggcgccggtgatcggcggcctcgtcaagttcatgcgcgggcccatccccatgatccgggagcagtacgcccgcctcggcagcgtcttcaccgtccccatcatcacccgcaggatcacgttcctcgtcggccctgaggtgtccgcgcacttcttcaagggcaacgaggccgagatgagccagcaggaggtgtacaggttcaacgtgcccacgttcggccccggggtcgtcttcgacgtcgactactccgtcaggcaggagcagttcaggttctttaccgaggcgctccggggcgacaagctgcgcagctatgtcgaccagatggttgctgaggctgaggagtacttctcaaagtgggggagaaagtggcactgtttgattttgaagtatgagttgggagcacctcttcataactgacagctagcccggtgcttgcttggaaagggaggtggcnagaaaagcttgttccaacaaggttttctgca

SEQ ID NO: 85663 - protein, 184 aa, Zea mays
  misc_feature: Ceres CLONE 1572030
  misc_feature: SWISSPROT Homolog: EC 1.14.13.70 Sterol 14-demethylase
MMDLADPQQQQRLIAGAALLLATAAFLRLLLGSRSRGGKRLPPTIPGAPVIGGLVKFMRGPIPMIREQYARLGSVFTVPIITRRITFLVGPEVSAHFFKGNEAEMSQQEVYRFNVPTFGPGVVFDVDYSVRQEQFRFFTEALRGDKLRSYVDQMVAEAEEYFSKWGRKWHCLILKYELGAPLHN

SEQ ID NO: 85664 - DNA, 810 bp, Zea mays
  misc_feature: Ceres CLONE 1572035
  misc_feature: Encodes the peptide sequence at SEQ ID NO. 85665
  misc_feature (555)..(555): n is a, c, t, g, unknown, or other
  misc_feature (620)..(620): n is a, c, t, g, unknown, or other
ctccccgcggtggcggccgctctagaactagtggatcccccgggctgcaggaattcgtctcacccctagaaaaagctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcggcggcttcggtgtaggcctgggcagcactggtggcggtggccgcatcggcggcggaggactcggcttctcgtcctctgccggtggtgggcacggggcttctatccccacattatcttctcagagcagcgcacctcagtactcctcttatggtggatatcagggntacagcaaaaagattgaattccaaatgggaggggttggtggtatcattggaaaagccggggaaanctataggtttttcaacttcaatccggagccaagattccagtcccaggaaacatggagcctgaccttgtggactgacaagcaagttgaactttcttggcaaccttagcagaaaagcaagctgaaaggttgttcaaaaaattcttggaaaagccaaatttgggtcatccggggtgggaaaaggggggcccga

SEQ ID NO: 85665 - protein, 194 aa, Zea mays
  misc_feature: Ceres CLONE 1572035
  misc_feature (160)..(160): Xaa is any aa, unknown, or other
MADDHYSSKRKYDDPSPPPRRTGFSSGPPPASPLAGGAPSYNSVPPPPDEIQLAKQRAQEIAARIFNAAEAKRPRVDNGDDDSGGFGVGLGSTGGGGRIGGGGLGFSSSAGGGHGASIPTLSSQSSAPQYSSYGGYQGYSKKIEFQMGGVGGIIGKAGEXYRFFNFNPEPRFQSQETWSLTLWTDKQVELSWQP

SEQ ID NO: 85666 - DNA, 879 bp, Zea mays
  misc_feature: Ceres CLONE 1572036
aagctggagctccccgcggtggcggccgctctagaactagtggatcccccgggctgcaggaattcgtctcacccctagaaaaaggctcccagttttttgtgccctgcgtatttgctcccctggctccccacctcctggccctgcctgagaggcgtgggggacataataactggcctatttttgcgtggagaatcggctttgtttgtctcgtgcccgggtctggctgactagcgacgacttcaaggccagaaattcatgccatgtgaacctgatcctgctcgccaccttgctactcaagggcgtgtccgcttcctcggtccactacactaccatcttctaacggagctctcccggagcaagtctggtgcatggaactctgccgtgatcgatgaaactccacttgctgactcgtctgcgacctccgacgttccagaagctgcaaaaagactgcgtctgctacaaagacgcctgctctactacgaccccctgattctcattaggctgacgtatacacgcatttcagaatatattttctgacgactacattgtgactaatcttctagactgctgctacgtgaccacggacccggtccggattcgaggcgtctctgcactcctctcttctacatctcccgcatagtagttctgcattcaactgcacccatgggatgttctatgtggggagggcagactccccactgtctaccggaagtttgccttaggggggtaagcgacatggcgcaattgaaatcccggtatcttaagaccgggccttgttttttgtaggtccccttcgggcggggctggttatgcgggggtccctcttggaaggggtttcccaaaaacaattactttttaaagggaagagttgcctccttg

SEQ ID NO: 85667 - DNA, 822 bp, Zea mays
  misc_feature: Ceres CLONE 1572039
  misc_feature: Encodes the peptide sequence at SEQ ID NO. 85668
  misc_feature (708)..(708): n is a, c, t, g, unknown, or other
tccccgcggtggcggccgctctagaactagtggatcccccgggctgcaggaattcgtctcacccctagaaaaaactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggtgatataacgacaanccacttcctccctatccgtcgtgaagccccctgcttcgttgagcaggccactgagcagcaaattcttgtactgggatcaaggtcgtggatcttcttgcaccctacaaaagagtg

SEQ ID NO: 85668 - protein, 220 aa, Zea mays
  misc_feature: Ceres CLONE 1572039
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (183)..(183): Xaa is any aa, unknown, or other
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDITTXHFLPIRREAPCFVEQATEQQILVLGSRSWIFLHPTKE

SEQ ID NO: 85669 - DNA, 1040 bp, Zea mays
  misc_feature: Ceres CLONE 1572042
  misc_feature: Encodes the peptide sequence at SEQ ID NO. 85670
  misc_feature (385)..(385): n is a, c, t, g, unknown, or other
tcaccgcggtggcggccgctctagactagtggatcccccgggctgcaggaattcgtctcacccctagaaaaaccgttgctcgctcgccttcacaacctctccatccaggccacagctcgagaccaacgaccgacgcctagacgcggctgggcggtcggcctcacctcgttccccctcctcccttcttcctgctccgcgtctcgatctcgactcccccgccgcgtcgcgcgacccggccagatctcgcccaccctgcgccgcggccatggataacttgatcaccctcgtcaacaagctgcagagggcttgcacggctctcggagaccacggagaggagagctccctccccaccctctgggggtggggggggggggtatcgccctcntttgaaggacagagctttggtaaatcattctgggttggaaaagcgggggttggggaaagattttcctaccccgggggtttccggcgtttgtaaccccgtccggcccccgtggggcctccaacctccccaaagaatttgatgggggcgccggagataaatatccagaagtgtccgtggcttctttttcgcatgaataagaagttttggccgccgtttttggcccccctcttgcaaaagaaaatggtataacatacttcctatggtacataattagtccccctcttaaatcacaccgcccgtgtgggtgcacgggacaaggataatttatcacttgttttccttctcgtactgcctctgttcccgctgtagtgcgtgttgttattccccactgaggtgtaggaggggaagggttaatctcgctttgtggattacatcgcagtcccgtgcggttcttagttgggtgggcgaagctggttgtgagtagcgtcatggatcgcggtctgtctgcatagtgcgtctgcgcctctctatccgttgagtagtctagagcggtgctgctacacgtttcatccggaaggggccgcctcgtggtcgactagctcgcttctgccgctccggcttgcttcttcatagcagtgttctgccccatgtgacg

SEQ ID NO: 85670 - protein, 70 aa, Zea mays
  misc_feature: Ceres CLONE 1572042
MDNLITLVNKLQRACTALGDHGEESSLPTLWGWGGGVSPSFEGQSFGKSFWVGKAGVGERFSYPGGFRRL

SEQ ID NO: 85671 - DNA, 847 bp, Zea mays
  misc_feature: Ceres CLONE 1572044
  misc_feature: Encodes the peptide sequence at SEQ ID NO. 85672
acccgcggtggcggccgctctagaactagtggatcccccgggctgcaggaattcgtctcacccctagaaaaagccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccacaccgccgtcctcatcgagaccctcaccgcgctcggcgccgaggtccgctggtgctcctgcaacatcttctccacgcaggaccacgccgccgccgccatcgcgcgcgactcggcccgccttgttcgcctggaagggggagacccctcgaggaatactggggggtgcaccggagggccttcctcaactgggggcaaggcgggccggcccctaactccttcgttggacaaagggggggcaaaccccacgcctttgtcatcaaggaggggggttcaaggcccacaggagggtttccgagaaaaagcggggcaagaaccccccgcaccccggaagtcccccctcccaaacgtgtgaaattgaggatccggggcctccgcctgcgatccctcgcacgggggttccaaggtatgggaccccgagaagaagataccccgcatagaatcagtaatggaataaggcttttttcccctcacttctttgcaagcggcgttacactcctctcgg

SEQ ID NO: 85672 - protein, 182 aa, Zea mays
  misc_feature: Ceres CLONE 1572044
  misc_feature (12)..(164): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIHTAVLIETLTALGAEVRWCSCNIFSTQDHAAAAIARDSARLVRLEGGDPSRNTGGCTGGPSSTGGKAGRPLTPSLDKGGANPTPLSSRRGVQGPQEGFREKAGQEPPAPRKSPLPNV

SEQ ID NO: 85673 - DNA, 885 bp, Zea mays
  misc_feature: Ceres CLONE 1572045
  misc_feature: Encodes the peptide sequence at SEQ ID NO. 85674
  misc_feature (778)..(778): n is a, c, t, g, unknown, or other
ctccccgcggtggcggccgctctagaactagtggatcccccgggctgcaggaattcgtctcacccctagaaaaattggttggggtggaggaccgtcgccttccccgtttcgtcttccggtcctcgttttatcccctcgcccttgcactcctccgccgcacccctttcctccttccgccctccgccgcgcctggctttctcccttcccgagaggccccgctccatccccgcccgcgctgcctcccctggcgatcggcggcgaccgcggcccaacgaaagcgtcgtggtcggccgctgtcacgcttcttgcagacgctgggcggactgggaacaagcgccaatggggatcgcggtggtggctctacacaccatgccgggggcgttcaccacccactccccggcatccattctgtcccttcggccagactttacgaggataaacagccgcaccaattcggtgccaaacgccaggacactgcaaggcgtcctaaggatcccgaggctgaggtcggtcaggcggctgtgccagcggatcgatgaccgggttacagaggggaacggtccttgggtcaaggatgccatgaataacgctagccaggttcttggcgacatcagcgtgctttggtcaagctgtaagtggcaatgggtgtctaaaatgggagtgctgcccaagactcccccctcaagaggcgggaagtccctctttcgggttgaaggaatgaggccctggggaaacttcctgcaggaagtcaaagggttttacctatttgtgggcgagntccttggtttggggaacgaatttggctgcgccaccggattcccacaaatggaacaggtggaattcccggtgtggaaacttaccgcaatccaagggggggtttttatt

SEQ ID NO: 85674 - protein, 182 aa, Zea mays
  misc_feature: Ceres CLONE 1572045
  misc_feature (147)..(147): Xaa is any aa, unknown, or other
MGIAVVALHTMPGAFTTHSPASILSLRPDFTRINSRTNSVPNARTLQGVLRIPRLRSVRRLCQRIDDRVTEGNGPWVKDAMNNASQVLGDISVLWSSCKWQWVSKMGVLPKTPPSRGGKSLFRVEGMRPWGNFLQEVKGFYLFVGEXLGLGNEFGCATGFPQMEQVEFPVWKLTAIQGGVFI

SEQ ID NO: 85675 - DNA, 855 bp, Zea mays
  misc_feature: Ceres CLONE 1572048
  misc_feature: Encodes the peptide sequence at SEQ ID NO. 85676
  misc_feature (855)..(855): n is a, c, t, g, unknown, or other
tccccgcggtggcggccgctctagaactagtggatcccccgggctgcaggaattcgtctcacccctagaaaaagattggccgctactagtactaccagctaggccactgctcctctgctacccgctaacctcgcgccggagtcgtcgcccacgatggcctaccgatccgcagtgctcttgcccgccctcctactggccgtcgccgtcgtcgtggcctccgccgccgccggggacgggaggtggcgggaggagcaggcgcgggaccgggtgccgcgggtgccggggcaggccttcaacaccagcttcgcgcagtacgccgggtacgtgaccgtcagcgagcagcgcggcgctgcgctcttctactggttctttgaggccgagaaggacccggggtccaagcccctcgtgctctggctcaacggagggcctggatgctcgtccattgcttttggacttggagaagaagtaggacctttccatgttaacgcagatggggaaggggtccatgtcaatccttattcttggaacaaagttgcaaatttactgttccttgattcacctgttggtggtgggtactcatattcaaacacctctgatgatgcttttaaaaatggggatgcaagaactgccacggattcattgggcttccttacttgaagtggcttggacccttttcctcaaatacaaggaacgcgaaattttatttgacagggggagagttaatgctgggtcacttatgttcccccaacggggctcaagcccataaaaagagccccctggaggcttacctgggggacaaattcaattttattcctaaaaggggttatttttgtgtaggggaaatggcttttcccn

SEQ ID NO: 85676 - protein, 167 aa, Zea mays
  misc_feature: Ceres CLONE 1572048
  misc_feature (43)..(168): Pfam Name: Peptidase_S10 Pfam Description: Serine carboxypeptidase
  misc_feature: SWISSPROT Homolog: EC 3.4.16.6 Carboxypeptidase D
MAYRSAVLLPALLLAVAVVVASAAAGDGRWREEQARDRVPRVPGQAFNTSFAQYAGYVTVSEQRGAALFYWFFEAEKDPGSKPLVLWLNGGPGCSSIAFGLGEEVGPFHVNADGEGVHVNPYSWNKVANLLFLDSPVGGGYSYSNTSDDAFKNGDARTATDSLGFLT

SEQ ID NO: 85677 - DNA, 852 bp, Zea mays
  misc_feature: Ceres CLONE 1572049
  misc_feature: Encodes the peptide sequence at SEQ ID NO. 85678
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (780)..(780): n is a, c, t, g, unknown, or other
  misc_feature (782)..(782): n is a, c, t, g, unknown, or other
ggagctccccgcggtggcggccgctctagaactagtggatcccccgggctgcaggaattcgtctcacccctagaaaaaagccgtcatcgtttcgcgtccgcctcagcccgccgcaaggggaggtaagttcatgagacaccttcgagaagctgaaatggctcctaaagctgctcctgccaagaagggtgatgccaagacccaggccttgaaggttgccaaggctgtgaagtctggggcagccaagaagaccaagaagatccgcacatctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaagtcaacaccttgatcaggcctgatgggaagaagaaggcttacgtgaagctgactcccgactatgatgctcttgatgtggccaacaaaattggcatcatctaagtgctgcattaggcatctgtggtttcctagttcatctgttgtgtcctaggtctatgtgaaaccaagagttttgtagctatggctctccatcggttcattaccatgtggttatgcccccttctggatttgatatcatccaaggtgacccggttgaaaaaannnnnnnnnananaaaaaaaaaaaaaaatttctttttctcctcggggacacaaaaaaaaaggggggcaggcacaaaaaaaaaa

SEQ ID NO: 85678 - protein, 151 aa, Zea mays; identical to SEQ ID NO: 73630
  misc_feature: Ceres CLONE 1572049
  misc_feature (69)..(148): Pfam Name: Ribosomal_L23 Pfam Description: Ribosomal protein L23
  misc_feature (11)..(63): Pfam Name: Ribosomal_L23eN Pfam Description: Ribosomal protein L23, N-terminal domain

SEQ ID NO: 85679 - DNA, 807 bp, Zea mays
  misc_feature: Ceres CLONE 1572050
  misc_feature (479)..(479): n is a, c, t, g, unknown, or other
ctccccgcggtggcggccgctctagaactagtggatcccccgggctgcaggaattcgtctcacccctagaaaaaagagtccagactccaggactaccagtctaccaccacttcgtctcgtcctcacacctcactccaccacctctgccttgcaaagccttccacaccgatccgccgcctcgtccgcgcgctcgcaggcagcagtgtggactacccgccccatactccatcccctactcgaaggatacaccgtgagtaggcgtgatggtgcttgataccccgttttcgtgcagcttgttgctaattcgttttagtttgagggatcaagaaccaccttgttctttctttctttctttttttgactacgatgaatcattgcaaatctcttgaatacatttttcactataaaatactgccttgcctttgagctccttggttcacgtgcaatgtttctttgtcctccgattttgcaggacctcnagttaagttgggcgaggagaagtgggtcattccagcagggatccttctcgtgagcccagtcgatctgaccgtcttggtatctggggggggttgtcctgtactcccctcttaatttgggagtcctgacagggtctttgaagtgcaattggttaaaaattttaatttgtaaaagaaaaaaaaaaatttggctaaaattgggcgtttggcagggacctcccaaaagaaggggctgggaatagattccccctttggaaattttcccgggcggaaagggggggttttttccccccccgggtcccggtttaaatccctttttttgggcgcaaaa

SEQ ID NO: 85680 - DNA, 1134 bp, Zea mays
  misc_feature: Ceres CLONE 1572051
  misc_feature: Encodes the peptide sequence at SEQ ID NO. 85681
  misc_feature (14)..(14): n is a, c, t, g, unknown, or other
  misc_feature (16)..(16): n is a, c, t, g, unknown, or other
  misc_feature (67)..(67): n is a, c, t, g, unknown, or other
  misc_feature (71)..(71): n is a, c, t, g, unknown, or other
attttttttttggncnttatatccccttattgcgcaccttttctctcattctcctctgtaataaatnaaanaaaagctggagctccccgcggtggcggccgctctagaactagtggatcccccgggctgcaggaattcgtctcacccctagaaaaaactgacgagctcgccatggcctccctctcctctgccgccgtcaccgccccttccttcgccgcaccaccgccagcccgcgccgctggtcagaaggaggtccttcaccgtgcgcgcctctctccgcaaggccaccggcaccgccgccgtgtaaatggctgccagcgccatgcttgccggcggtgtcatggcccaggacgtgctgctgggcgcatgcgactgctggctcttcttcgagcccagccagttcgccgtgcaggccggcgacaccatctcatttaagaacaacgccggcttcgcgcacaacctcgtcttccacgaagaccaagtgccggaggagggtcgaccccgaccagaattcttcggaaggaaggaataccttcaacgggccctggcgaaagaccaaaattccggtcaacccttcaccctttgcccggggaaacctacccggacttcttacctgggggagccacccccttccaagggaatccccggggaatgggttcccgggcaaaaaaattcctcccccccccaaacctttaagtttaaaaagctttcggcctttatctccaaatttcgggaaaagatgcccccctttttcacacgggggaaatttaaaaaaaaaagatgggttagggcacctttgcaccccttgcgccttttgtgtgaaaaaccgagccggccccccaaattattggttgcccacagttctccttttcacaggggggtatataatggggggcttttctttcttccgccgctagaaaaaaaagcccctttttctcccccccctttgttttgccccaaaacttcccaaggtccccccggtggcccgacataaaaaaagggtgtttggggaaatcccgtggggattttttttaggcggggggtgccccccccgccctcttttctgcccccccaatttttggcctatatccccacaaacgggaattgcccacctcctttgtttgtgggcgcccc

SEQ ID NO: 85681 - protein, 228 aa, Zea mays
  misc_feature: Ceres CLONE 1572051
  misc_feature (14)..(119): Pfam Name: Copper-bind Pfam Description: Copper binding proteins, plastocyanin/azurin family
MAASAMLAGGVMAQDVLLGACDCWLFFEPSQFAVQAGDTISFKNNAGFAHNLVFHEDQVPEEGRPRPEFFGRKEYLQRALAKDQNSGQPFTLCPGKPTRTSYLGEPPPSKGIPGEWVPGQKNSSPPQTFKFKKLSAFISKFREKMPPFFTRGKFKKKRWVRAPLHPLRLLCEKPSRPPKLLVAHSSPFHRGVYNGGLFFLPPLEKKAPFSPPPLFCPKTSQGPPGGPT

SEQ ID NO: 85682 - DNA, 858 bp, Zea mays
  misc_feature: Ceres CLONE 1572052
  misc_feature (299)..(299): n is a, c, t, g, unknown, or other
  misc_feature (314)..(314): n is a, c, t, g, unknown, or other
  misc_feature (323)..(323): n is a, c, t, g, unknown, or other
  misc_feature (330)..(330): n is a, c, t, g, unknown, or other
  misc_feature (336)..(336): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (640)..(640): n is a, c, t, g, unknown, or other
  misc_feature (787)..(787): n is a, c, t, g, unknown, or other
ggagctccccgcggtggcggccgctctagaatagtggatcccccgggctgcaggaattcgtctcacccctagaaaaagtggccacgccgcggcgcgaccctgacgcccgccgtctccggcacccgataggcctcctccccacacccctcgcgtggcttccgtggcccgtagcccggcgcgcttcccttcaaagccactgcttcgcctcctccttctacttaagcgcagccggccccggccggcactcgcatccggtagctcgatcacttcttcctctggattttgggaaggaggcatcnggaacgtcggatgcnatgacacanctcattngcattnaggcgcctacgccctacccgcaaagtgggaaagcccttatgggaattttcaaaggcaaagcgccttccttctctggggaacaaaaaatcttttctggggccctttttgggggggttttttaaaaaatttttcccccccgggggggggggcctttcccaaaaaaatatattttccccccccctttcttcgggaaaaaaaaaaaaaaaagaggggggcgcccccccccccccaaaaaaaaagagaagggggggcccccccccccttaaaagaggggggggtgtgaaataaaaaannnccccccccnccccccacaaaaaaaaaattttttttttttttttcccccccccgcgggagaaaaaagaaaaaaaaccccccccccccccgaaaagaaaaaaaaaaaaaacaaaaccttttttttttttgtgtggggggggaggaagaaaaaaaaaanaattttatttttttttttggggttgtggggggggggggggggagaaagaaaactaaaaaatacaccccccc

SEQ ID NO: 85683 - DNA, 814 bp, Zea mays
  misc_feature: Ceres CLONE 1572054
  misc_feature: Encodes the peptide sequence at SEQ ID NO. 85684
tggagctccccgcggtggcggccgctctagaactagtggatcccccgggctgcaggaattcgtctcacccctagaaaaacgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctgggagaccctgtggaaaacattggagctaaaatggtcaggcaagctgcagctaagaccacgatcttgctggagatgggaacaccacctctgtggtctttgctcaggggctgattgcttgagggggttaaggtcgaagcaactggggccaaatcgtgtcagaattacccgggggattgggaaaaaccgcttaaggcctttttggaagaactaccggagttgttctaaggaggttgaaaaaaagtgaccctggcaaaattttccctcccatttaggggggggcaaccacttttgaaattgggcaaccttgac

SEQ ID NO: 85684 - protein, 132 aa, Zea mays
  misc_feature: Ceres CLONE 1572054
MASTFGATSTVGLMAAPTGKNVRLQRRANFRVKAAKELYFNKDGSAIKKLQTGVNKLADLVGVTLGPKGRNVVLESKYGSPKIVNDGVTVAREVELGDPVENIGAKMVRQAAAKTTILLEMGTPPLWSLLRG

SEQ ID NO: 85685 - DNA, 841 bp, Zea mays
  misc_feature: Ceres CLONE 1572057
  misc_feature: Encodes the peptide sequence at SEQ ID NO. 85686
  misc_feature (746)..(746): n is a, c, t, g, unknown, or other
ctggagctccccgcggtggcggccgctctagaactagtggatcccccgggctgcaggaattcgtctcacccctagaaaaagctcttgcctccaaaattcaccttcgccgattgccgccgtgggccgccgcgatggcgttgcggacgcctcgtaccacctccgtcgcattctccgctgactcccccctcggcggcgtcccaatacgctcctcaacagcctgctccgttcccacgccacctcctctcgctccgctgtgaccaccgaggaccaccagagcgggacgccgcggaactcgtcggccacgtcctggccgtcgcgcatgctgacgacgaggctgttgccctcccgggcgccctcggcgcggagctcgcacgcgtcctgcgagcgcgcggcgccgctgaggcaccgggcgcgccggcggaggaacaagttgaagtaggtccggaacagaggacagggagggacctaaaattcaagcccaaaggaccaaagcccgaagtttcttttcttccccgcaaagaaagaaggcaagagttctcggcttctcgcaagtcgcgacagagaaagaggcggagttgcggagaagatgcagagcagcagcatgaagagggagatcagcgaggcccacgacaccattcgcttcggcatcaacgccggcgtcaaagcggacctcgccccgccgcacccgaatgaaatcccagaatcatttcttcgttctaaattgaaataggtgtttggtgacaggnaagtctagaaaatagtgtttatagattcatcgcgacacgatcttcaccagaaaagggtacaagagaaatgcagagatttattctatggagaaagt

SEQ ID NO: 85686 - protein, 47 aa, Zea mays
  misc_feature: Ceres CLONE 1572057
MQSSSMKREISEAHDTIRFGINAGVKADLAPPHPNEIPESFLRSKLK

SEQ ID NO: 85687 - DNA, 958 bp, Zea mays
  misc_feature: Ceres CLONE 1572060
  misc_feature: Encodes the peptide sequence at SEQ ID NO. 85688
tggagctccccgcggtggcggccgctctagaactagtggatcccccgggctgcaggaattcgtctcacccctagaaaaactccccttctcctccttgcgggcctcctcgcccagcggactcctactctgctgcgctccgctccgttccgttccgctcccctcctcgcggcagcaatcgaatgtctcccgacgtagacgccgccgtggcaaccgccgtcgctgccgggggaggctgcggcggtgacggagaggcgggcggtggcgcgtcgtcgtccccggcgtccgcggcggcggcgaacgggcgggcgttggtgcggtgggatcagatcctcccgcgccgctccctgcgggtcctcctcgtcgagcacgacgactccacgcgccaggtcgtcaccgcgctgctccgcaagtgcggctaccgcgtggccgcggtcgcggacgggatgaaggcgatgcggggtcatgcggggagcgcggcctacgccgttcaacctttgtcctcaccggaggggtcgccaaggccccctcccttctccgggcaattccagctggcttctccaaggaatcgttccccccacccaaaccaggtggcaaggaaacattccccccgttcggtccatggaattgttcatttcccacaagaatttctaaatttgggcaccccgggggctttaaagtgtgtatagcccaaaaagggggtgccgggtgggaactttccctttgtgtgaaaacccactggtgggaaaagagattgaaactgggcgtaaaaccttatggggcaacctttggttttgggcagccccggcaaatcacaatggaaatttgcccgaaaacaaatgggaatacaaaaaaaaaatagggcgcccccgccaaagtctaaattagggtgcccaagcttttcttaagtggggggcgaaaaaatgggagaaatacagtggaccgaaggaaagttgattcc

SEQ ID NO: 85688 - protein, 168 aa, Zea mays
  misc_feature: Ceres CLONE 1572060
MSPDVDAAVATAVAAGGGCGGDGEAGGGASSSPASAAAANGRALVRWDQILPRRSLRVLLVEHDDSTRQVVTALLRKCGYRVAAVADGMKAMRGHAGSAAYAVQPLSSPEGSPRPPPFSGQFQLASPRNRSPHPNQVARKHSPRSVHGIVHFPQEFLNLGTPGALKCV

SEQ ID NO: 85689 - DNA, 833 bp, Zea mays
  misc_feature: Ceres CLONE 1572063
  misc_feature: Encodes the peptide sequence at SEQ ID NO. 85690
  misc_feature (802)..(802): n is a, c, t, g, unknown, or other
agctccccgcggtggcggccgctctagaactagtggatcccccgggctgcaggaattcgtctcacccctagaaaaaatatctcgcctccacttcgtcacctcctcgccattctatcccaccagctgcatatatccctggtgtgtgaggtcagctgttttagctcagcgcgcgcggcgtggcagcaaaggaagcaaggagggagagcagcggcggcggcgtagcatgcagcggtgagagcgagggagctagggatcttatagccgagagagcgagagccagaggatgatgcagctgccgcagcatcacaagccgtccgcccactcctgctgcccgtcgtggatccggaggtccccgccgtcgccgccgccgccgccgccgccgcacaagaagccgggcggcgggaggagccggtatgcttgccgcctcgtgcccctgctcgtgctcaccgtgtacagcgtcgtcaccgtgcttcgcatccccagcgcctccctcgtcgtctccaccgccgattcagagcgcgtggacaggcgggaggacttggaggcgctcatcaagacccacctgccgtcgaaccagaacagcctcgaggcccgcgaggagacgcggtcggtggcctccctcccctgctccgccttcatcagcggtgaggcggggcacggcgaagaagggcgtcctgtgctgcgaccggagcactaccgcagcgacgtgtgctacctgcgcggcgacgtgcgcacggacccgtccacctcgtcggtgctcctgtacaacgcggcccgcgggatcggcccccgagaaggtgcnggcgtacacgcgcaagttcgaggacagcgtg

SEQ ID NO: 85690 - protein, 183 aa, Zea mays
  misc_feature: Ceres CLONE 1572063
MMQLPQHHKPSAHSCCPSWIRRSPPSPPPPPPPHKKPGGGRSRYACRLVPLLVLTVYSVVTVLRIPSASLVVSTADSERVDRREDLEALIKTHLPSNQNSLEAREETRSVASLPCSAFISGEAGHGEEGRPVLRPEHYRSDVCYLRGDVRTDPSTSSVLLYNAARGIGPREGAGVHAQVRGQR

SEQ ID NO: 85691 - DNA, 901 bp, Zea mays
  misc_feature: Ceres CLONE 1572067
  misc_feature: Encodes the peptide sequence at SEQ ID NO. 85692
  misc_feature (468)..(468): n is a, c, t, g, unknown, or other
ctccccgcggtggcggccgctctagaactagtggatcccccgggctgcaggaattcgtctcacccctagaaaaatcggcacctcgccgtcctcgtgtgcaatccccagctctcctcgcccctccctcccaaactccagcggccccccctgaccaagctccggggacggatggacggaggagccggctttccgggcacgcagccggtctcccgctcgccggaggacgtcttccgggactaccgcgcgcgccaggccggcctgatcagggcgctcaccaccgatgtggagaagttctacgtgatgtgcgacccagagaaggagaacttatgtttatatggacttcctaatgagacatgggaaataaacttgcctgctgaagaggtccctcctgaactgccagagccagctctttggaattaattttgctcgtgatgggatgggatgaaaaaagatgggctatcacttggntgcagtgcatagtgattcttgggctaatgtctgttgcattttaatttggaagcaaggttttggattccaaaaagaatcccggggattccatttggttttaattccaaaaaaagaatttttagggtttgaccggtaataaaaaaaggttctcttggcccaggggcaccccccttaaaatattccccaaattaaggaaacccttttttttgtttttccaaagatttttttttttttggacaggaagaggtttcaaaaccccgggggttgggggatttttaaaaaaaccctccccccccccggggttttcccccccggggggaaaaattttgggggggggggaaaaaaaacaccccccttgtggggccggctttataaaaaaagagggggcgccccccccccccccaaaaaataaattagggtgtctctagggccc

SEQ ID NO: 85692 - protein, 83 aa, Zea mays
  misc_feature: Ceres CLONE 1572067
MDGGAGFPGTQPVSRSPEDVFRDYRARQAGLIRALTTDVEKFYVMCDPEKENLCLYGLPNETWEINLPAEEVPPELPEPALWN

SEQ ID NO: 85693 - DNA, 787 bp, Zea mays
  misc_feature: Ceres CLONE 1572068
  misc_feature: Encodes the peptide sequence at SEQ ID NO. 85694
acccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctcgggtagctgctttcagggaccaaaatatcaagacccctttccggcttcctccgtggctgctggcatctgctttgaaacaagggcatcctggaatttgtgttggtgccccccccccgttctttggattggggtcaagggttttaaaaaaccctctggaaaacccttttctgagggcccttgttttgggtgaaccccccggaaaaggggaagtggtggcctcttccgggggccccaaaaaacatctttgtttttta

SEQ ID NO: 85694 - protein, 51 aa, Zea mays; identical to SEQ ID NO: 13325
  misc_feature: Ceres CLONE 1572068
  misc_feature (1)..(51): Pfam Name: AdoMetDC_leader Pfam Description: S-adenosyl-l-methionine decarboxylase leader peptide

SEQ ID NO: 85695 - DNA, 1233 bp, Zea mays
  misc_feature: Ceres CLONE 1572071
  misc_feature (64)..(64): n is a, c, t, g, unknown, or other
  misc_feature (971)..(971): n is a, c, t, g, unknown, or other
tttttttattttatcttcccacaccccactagattagaggatggggtggggtggtcgtggtatntttcacgcagccgggaaactggagctccccgcgtggcggccgctctagaatagtggatcccccgggctgcaggaattcgtctcacccctagaaaaacccccggccctcgccatcctctcccgctaaccccaccccgtcgccccggcctcctcggtccagcggcgagcgggtccgtccggtcccgacgccgcaccacatcaccgcctgctcccacggccgtcctcactcgacctcgatcggaacccccggatcggaggtaccttcgcgcgcggctccgctccgacctcgtcctccatcggttggcatcggaagcggcggcggcggcgggttcccagccagctttcgaaaggttttattccgtgattgcaggcaatcaatcgtcaggctttttgggagctgtgttggggggacccgggggaagagtgaagttactgcagaggctaacatttaggttgtcgagtgatggcgacagggcgccaatttcccgtggtttcatttggccgccctgcgatgggccattaatcggcgggtgtagaaaactgtgggccgggaaaaccttcgtggtgaacaatgggagccgttccttacccaggaaaggcttaacggggggaagggggctttcccaaaacaattggattcggggagtttggaacaaatccccctgtccaacacatgaggcctatttggccggccgcgaatccccggcggccactaggggccacaaatgtggggggtacgagggggaaaatttctcccacattgtcggaacgcccccaagtgtttggtatcccccgggcttgggggggaaccccgatatatccaaaggccgcggtgcccaaagaatgggttttttgggcgggcctttttgctgaaataccagagagggtggagatctctttccgccgcngacacaagatggggggggcgaatgggcccgattgtagacaaacaaatctccccatgggggagtgccgtgtcaaaaaaaagggggagacctcttggggaccactttgcgcgctggggggccacaagctctacactctccgagggtgtggggggggcataccaaaatcaattgtctatgtgcgcgggcccctcacggtgccgggggggattgtccaccaacctgcgcttttgtggggggtggagagcaaacccccacccgctgg

SEQ ID NO: 85696 - DNA, 869 bp, Zea mays
  misc_feature: Ceres CLONE 1572072
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (328)..(328): n is a, c, t, g, unknown, or other
  misc_feature (330)..(330): n is a, c, t, g, unknown, or other
  misc_feature (331)..(331): n is a, c, t, g, unknown, or other
  misc_feature (333)..(333): n is a, c, t, g, unknown, or other
  misc_feature (339)..(339): n is a, c, t, g, unknown, or other
  misc_feature (355)..(355): n is a, c, t, g, unknown, or other
  misc_feature (361)..(361): n is a, c, t, g, unknown, or other
  misc_feature (365)..(365): n is a, c, t, g, unknown, or other
  misc_feature (366)..(366): n is a, c, t, g, unknown, or other
  misc_feature (384)..(384): n is a, c, t, g, unknown, or other
  misc_feature (395)..(395): n is a, c, t, g, unknown, or other
  misc_feature (396)..(396): n is a, c, t, g, unknown, or other
  misc_feature (412)..(412): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (436)..(436): n is a, c, t, g, unknown, or other
  misc_feature (440)..(440): n is a, c, t, g, unknown, or other
  misc_feature (441)..(441): n is a, c, t, g, unknown, or other
  misc_feature (452)..(452): n is a, c, t, g, unknown, or other
  misc_feature (479)..(479): n is a, c, t, g, unknown, or other
  misc_feature (480)..(480): n is a, c, t, g, unknown, or other
  misc_feature (666)..(666): n is a, c, t, g, unknown, or other
  misc_feature (687)..(687): n is a, c, t, g, unknown, or other
  misc_feature (689)..(689): n is a, c, t, g, unknown, or other
  misc_feature (694)..(694): n is a, c, t, g, unknown, or other
  misc_feature (722)..(722): n is a, c, t, g, unknown, or other
  misc_feature (723)..(723): n is a, c, t, g, unknown, or other
  misc_feature (729)..(729): n is a, c, t, g, unknown, or other
  misc_feature (736)..(736): n is a, c, t, g, unknown, or other
  misc_feature (739)..(739): n is a, c, t, g, unknown, or other
  misc_feature (748)..(748): n is a, c, t, g, unknown, or other
  misc_feature (752)..(752): n is a, c, t, g, unknown, or other
  misc_feature (753)..(753): n is a, c, t, g, unknown, or other
  misc_feature (762)..(762): n is a, c, t, g, unknown, or other
  misc_feature (779)..(779): n is a, c, t, g, unknown, or other
  misc_feature (780)..(780): n is a, c, t, g, unknown, or other
  misc_feature (782)..(782): n is a, c, t, g, unknown, or other
  misc_feature (791)..(791): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (849)..(849): n is a, c, t, g, unknown, or other
  misc_feature (856)..(856): n is a, c, t, g, unknown, or other
  misc_feature (857)..(857): n is a, c, t, g, unknown, or other
  misc_feature (859)..(859): n is a, c, t, g, unknown, or other
  misc_feature (863)..(863): n is a, c, t, g, unknown, or other
tggagctccccgcggtggcggccgctctagaactagtggatcccccgggctgcaggaattcgtctcacccctagaaaaatctccgcatccgcttgctgctgccgcccctgctccggctgggacgagcgagcctcctctccctccttgtcgcgtcccacataactgtgcctcctcgccgctgcgccccacctctgctcaggcccacactgccctgatcccgccggagtgcccgcacgcgcgcccttgcctgggccggccgccggcgaggggtctgggcggtcggtcgacgtgcccccccccccccccaaannnnnnnnnntttnnnntntnntntttttntttttttttttttttntttttntttnntttttttttttttttttnttttttttttnntttttttttttttttntttttttttttttnnnnntttttntttnnttttttttttnttttttttttttttttttttttttttnntttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttnttttttttttttttttttttntnttttntttttttttttttttttttttttttttnntttttnttttttnttnttttttttntttnnttttttttnttttttttttttttttnntnttttttttnttttttttttttttttttttttttttnnnntttttttttttttttttttttttttttnttttttnntntttntttttt

SEQ ID NO: 85697 - DNA, 1102 bp, Zea mays
  misc_feature: Ceres CLONE 1572074
  misc_feature: Encodes the peptide sequence at SEQ ID NO. 85698
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (71)..(71): n is a, c, t, g, unknown, or other
  misc_feature (72)..(72): n is a, c, t, g, unknown, or other
ngggggggggnnnnnnnnntaattcaaaaatatattttattaaattatataaattatttacatattctaannttataaaactggaactcaccgcggtggcggccgctctataatagtggatcccccgggctgcaggaattcgtctcaccccctagaaaaactcgaaaccctagtcccctgctccattctcagccgccgccaatcccttcacgtgctccgcaaccgctaagtgagaaaaagagatggccggcaagggcgatagcccggctatcggcatctatctcggcacgacgtactcttacctcggcgtgtgggagcactaccgcgaccagatcattgacaacgaccagggtaaccgcaccacgccctcatacgtcacctacaccgactccgagcacctcatcgaagaatgtggtcaaaaaccaggtcgccatgaaccccatcaacaccctgtttgatgtcaagcgcctcatcgacagcgagccccatgatgcctgctgtccataaggatatacggtttttggcccccttcaaagaaattttcttgggccctgggggaaaagccccatggattggtaggtcccatcccccaagggctaaagacaaagcaacttttccaatcctgaaaaaaaaatttccatccctacgggcctcctaaagaaaaaaaattcccgggaaaaaatttcccttcaaaaaactttaacccttgggggttaaaacagcccaaaaaacaacaacaaggccttgtattggaacaccacaagagatccccccttcggaattagagtccttacaaatgtcacccctcacacaaaaaggcgcagggctcctcttttatatgtaaatctactccgggaggtgtgaaatatgtcccgcagcgcaccattaaagaaagcgcctcccgcaaaattacccccaagaaaaaggctcttaaaaacgttttcaacatctttttatccgccttgagcggtgtctttaaaccacaaaaagggcgctaccccagtgggttccgggtgataagcgacaagcgcgccgctcttgcttgagtacctctgttgactgtggggattacccttttgacattatcccggcccccggccag

SEQ ID NO: 85698 - protein, 71 aa, Zea mays
  misc_feature: Ceres CLONE 1572074
MAGKGDSPAIGIYLGTTYSYLGVWEHYRDQIIDNDQGNRTTPSYVTYTDSEHLIEECGQKPGRHEPHQHPV

SEQ ID NO: 85699 - DNA, 822 bp, Zea mays
  misc_feature: Ceres CLONE 1572075
  misc_feature: Encodes the peptide sequence at SEQ ID NO. 85700
ggagctccccgcggtggcggccgctctagaactagtggatcccccgggctgcaggaattcgtctcacccctagaaaaagcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtagcagctggtgctaatcctgttcagattactcgtgggattgagaaacagctaaagcactagttgaagaaactacggaagtgtctaagggaggtgaagatagtgagcttgcagatgttgctgcagttagtgctgggcaacactatgaaatgggaacatgatagcagaggcatgagcaaggtcggcg

SEQ ID NO: 85700 - protein, 160 aa, Zea mays; identical to SEQ ID NO: 85623
  misc_feature: Ceres CLONE 1572075

SEQ ID NO: 85701 - DNA, 799 bp, Zea mays
  misc_feature: Ceres CLONE 1572078
  misc_feature: Encodes the peptide sequence at SEQ ID NO. 85702
  misc_feature (720)..(720): n is a, c, t, g, unknown, or other
  misc_feature (735)..(735): n is a, c, t, g, unknown, or other
tggagctccccgcggtggcggccgctctagaactagtggatcccccgggctgcaggaattcgtctcacccctagaaaaaccctccctccctccttctccatctccgctttccctcctcgcctaggcctagcctagccgcccccgcacgccacgccacattcgcatctctggatccccctcccttcgccctctcccattacccgccgccgccgcctcgcgcccgcgacccacccggcctcccacttcgatcccgccccgttcgctgcccccgccccgattccgattcgtcactgtatcgcgcgcgcgcgggtggtaagacagcgatggctcgtggcgggggcctctcgccccgccgcgggtgatctctcctctagcggggagccttcccgcgtgcccaagcggaggatcccgtcgcagctggtgcctcacctatccctctccttcgcatctccgccgtgctctctcgcgcaccccctcgaccctaggtttgctccttccctcccttcctcgccacccgattcgatctcgctccctccggcctccggctaggctgctccgtctctcctccgccatgttctcgcacggcgctgattccgcccacgacgccgggggccgtcggcgtcagcagcggcggggctaccgtccccacccgcttcgtctggccctatggtggggaagagggtcttcgtctcaggctcctttcaccagggtggtcggaancatttggccgatgtnctcctatcgaaggctgcccccactggaatttcagggctattttgcagtctggtcttctgggggc

SEQ ID NO: 85702 - protein, 44 aa, Zea mays
  misc_feature: Ceres CLONE 1572078
  misc_feature (18)..(18): Xaa is any aa, unknown, or other
MVGKRVFVSGSFHQGGRXHLADVLLSKAAPTGISGLFCSLVFWG

SEQ ID NO: 85703 - DNA, 815 bp, Zea mays
  misc_feature: Ceres CLONE 1572079
  misc_feature: Encodes the peptide sequence at SEQ ID NO. 85704
  misc_feature (735)..(735): n is a, c, t, g, unknown, or other
  misc_feature (755)..(755): n is a, c, t, g, unknown, or other
ggagctccccgcggtggcggccgctctagaactagtggatcccccgggctgcaggaattcgtctcacccctagaaaaattaaagtttggataaaccattgcttcgtctggtgtctacaatacatctaatttatatagtactaatttcatttttaccagatcgaaaatttttatgttgaaaggaaaatttagagatccaatgtcacattctgtaaaaatttatgatacatgtataggatgcactcaatgtgtacgagcttgcccaacagatgtattagaaatgataccttgggatggatgtaaagccaagcaaattgcttccgcgccgagaaccgaagattgtgtgggttgtaagagatgcgaatccgcctgtccaacggattttttaagtgtccgcgtttatttagggcctgaaacaacccgcagcatggctctatcttattgatacgttacaaaaaactccacttgaatcgtctgattcctctttaccgaagaagcctgtgctcgaaataatcgagcatgggcttttctggtcaaaacgtatcttgtctttattactttatcatgagttattttccttggttaacaatacttgttgttttgccgatatttgcaggttcattaattttctttttacctcataaaggaaataaaatcgttaggtggtatactatagctatttgtttattagaattccttctaatgacttatgcattctggtatcatttccattggnaggatccttttatccaattnaaggaggattctaaatggatagatgttttcgatttccactgggagattggaatcgatggc

SEQ ID NO: 85704 - protein, 81 aa, Zea mays
  misc_feature: Ceres CLONE 1572079
  misc_feature (4)..(27): Pfam Name: Fer4 Pfam Description: 4Fe-4S binding domain
  misc_feature (41)..(64): Pfam Name: Fer4 Pfam Description: 4Fe-4S binding domain
  misc_feature: SWISSPROT Homolog: EC 1.8.98.1 CoB--CoM heterodisulfide reductase
MSHSVKIYDTCIGCTQCVRACPTDVLEMIPWDGCKAKQIASAPRTEDCVGCKRCESACPTDFLSVRVYLGPETTRSMALSY

SEQ ID NO: 85705 - DNA, 826 bp, Zea mays
  misc_feature: Ceres CLONE 1572086
  misc_feature: Encodes the peptide sequence at SEQ ID NO. 85706
ctccccgcggtggcggccgctctagaactagtggatcccccgggctgcaggaattcgtctcacccctagaaaaaatgacgacgctctccaggatgctgccgcggttgcgctcctccgccacgcgcgccctccgcaaggtgttcggactggaacccgcggcgccgccgcgacggctccccgcccctgaagccttcgtcgcgtctgagagatcactcctgcgccctcttcctggcctggacctcccgccgtgcctccccgacaacctgagccgcagccccacccgggtcaccacgctccccaacggcctccgcgtcgccaccgaggacatcccgggtccttctgcgtgcatcggtttcttcgtcaactccggctccgtctacgagtccggggagaccaccggcgtgtcatacctgctggagaggatgggcttcaaggacaccaagcaccggagccacctcagcatcgtgagcgagctcgagcttgccggggccagcgtcagcgtctccgcctcccgggagcagatggtctacagctacgacacactcaggggatacatgcccgaggctctcgagatcctcatcgactgcatgcgcaaccccgctcttctcccaggaagaagtccaccgcttggtccttgctcgagaaagattccaggagctgccgagggacccctgaaagattttctccctgaccaggctaaactttgttgggattttccgggggctcttgcggatccacttaataagctccgggagcatggtccttggctagaaattattgacacggatttatttcaaaagtttttttcctgggaaattttttcccg

SEQ ID NO: 85706 - protein, 244 aa, Zea mays
  misc_feature: Ceres CLONE 1572086
  misc_feature (73)..(216): Pfam Name: Peptidase_M16 Pfam Description: Insulinase (Peptidase family M16)
  misc_feature: SWISSPROT Homolog: EC 3.4.24.64 Mitochondrial processing peptidase
MLPRLRSSATRALRKVFGLEPAAPPRRLPAPEAFVASERSLLRPLPGLDLPPCLPDNLSRSPTRVTTLPNGLRVATEDIPGPSACIGFFVNSGSVYESGETTGVSYLLERMGFKDTKHRSHLSIVSELELAGASVSVSASREQMVYSYDTLRGYMPEALEILIDCMRNPALLPGRSPPLGPCSRKIPGAAEGPLKDFLPDQAKLCWDFPGALADPLNKLREHGPWLEIIDTDLFQKFFSWEIFS

SEQ ID NO: 85707 - DNA, 783 bp, Zea mays
  misc_feature: Ceres CLONE 1572089
  misc_feature: Encodes the peptide sequence at SEQ ID NO. 85708
  misc_feature (436)..(436): n is a, c, t, g, unknown, or other
  misc_feature (721)..(721): n is a, c, t, g, unknown, or other
aaagctggagctcaccgcggtggcggccgctctagaactagtggatcccccgggctgcaggaattcgtctcacccctagaaaaaactcccctacctccctcgaccctcggtactcgctccgtttctcgactttcgctcgcgcatcggttgggggcacgcagcccgggaggcgcggaaggacagaagcggcggccggcggcgcatcggcctcgcccaggcccagtcccagtcccagtcccagtcccgctcggtgcttggtccttctccggttctcccacagcctcgccccctcgaccctgtgccccaaccccagcggcctgcggcactgatccacagtccccagacccggaccccggccgggtgaggatccgctgaccacgcagcctccaacgccgcatggagatcgtgcgctcccagaggcaggttgccgccgcanccagtggcggcggcggcggcggcgcgggggccctgccgacctacaaggcggcgccgcagctcgaggtgcggctggaggagttcgagctcttcgccatcgaccgcctccgagttctcaaggggatttcggatggactctcgcgtgggaagaggccggaggagatggagaaactggtcagtgaattgtggaagacacacatgaggcaccaggatccagcagagaatttgaaaacaggatatatatcgcactttgtgctccgtctagtctactgcagaacggaagaanttgcggaagtggtttctctccatggagactacactttttcggtatcgctttcgggctgagat

SEQ ID NO: 85708 - protein, 127 aa, Zea mays
  misc_feature: Ceres CLONE 1572089
  misc_feature: SWISSPROT Homolog: EC 1.8.4.11 Peptide-methionine-(S)-S-oxide reductase
  misc_feature (14)..(14): Xaa is any aa, unknown, or other
  misc_feature (109)..(109): Xaa is any aa, unknown, or other
MEIVRSQRQVAAAXSGGGGGGAGALPTYKAAPQLEVRLEEFELFAIDRLRVLKGISDGLSRGKRPEEMEKLVSELWKTHMRHQDPAENLKTGYISHFVLRLVYCRTEEXAEVVSLHGDYTFSVSLSG

SEQ ID NO: 85709 - DNA, 818 bp, Zea mays
  misc_feature: Ceres CLONE 1572091
  misc_feature: Encodes the peptide sequence at SEQ ID NO. 85710
  misc_feature (658)..(658): n is a, c, t, g, unknown, or other
  misc_feature (694)..(694): n is a, c, t, g, unknown, or other
ctccccgcggtggcggccgctctagaactagtggatcccccgggctgcaggaattcgtctcacccctagaaaaagtgtgcgggcttcttcttctcctaccattacttgcttcagagctcagcacatctccggtaggccggggtcttttcttctgccagctatgggttcaggtctcttcaagccttgtgttcatccggacttccgtgttgttttctctaagatgtctttcggtgacaagattggctttctattcgttcatgcatttgacaagagaaacctgtggcacaagatgcctgttctgatcggtttactgtacctgaacacccgtcggaccctcctcgaaaaatacaacctgctagctgttgggagttctcatggtgctctgatcaccccaaggatcagttcatgtaccgcaccggagatggcaagtacaatgaccccgataatgctgaggctggtagccaatacacattttttgggagaaacatgaagccggttgatcaagagtatgagttgatgagcccagatccatttgttgtggcgacaaagctgttagccaggagagaatacaaggacacaggaaaacagttcaatatactagcagctgcatggatacagttcatggttcatgactggatggatcatatggaggataccnaacagattgaaatcacagctccaaacgaagtggccnaatagtgcccactcaaatcatttcagttctatgccacaaaagactgcctacgaattctgatggaataataagactggttactacatgtccgcacagcttggttgggacgggagtgcaatatatg

SEQ ID NO: 85710 - protein, 96 aa, Zea mays
  misc_feature: Ceres CLONE 1572091
  misc_feature (85)..(85): Xaa is any aa, unknown, or other
MYRTGDGKYNDPDNAEAGSQYTFFGRNMKPVDQEYELMSPDPFVVATKLLARREYKDTGKQFNILAAAWIQFMVHDWMDHMEDTXQIEITAPNEVA

SEQ ID NO: 85711 - DNA, 930 bp, Zea mays
  misc_feature: Ceres CLONE 1572092
  misc_feature (49)..(49): n is a, c, t, g, unknown, or other
  misc_feature (52)..(52): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
gggggggggggggggagttcattcttatcatcccgggcccgcgccaaanatnatnnnnnnaaaatgggctcccgcggggcggccgctctgaactatggtcccccgggctgcagattcgtctccccctagaaaaatcatgcctccagtgtccagtccagagtccaggctccaggactacccaccacttcgtctcgtcctcacacctcactccaccacctctgccttgcaagccttccccgatccgcgcctcgccgcgcgctcgaggcagcagtgtggactaccgcccatactccatccctactcgaggatcaccgtgagtagcgtgatggtgctgatacccgttttcgtgcagcttgtgctaatcgttttgtttgagggatcagaacaccctggtccttcttccttctttccgggaaccattttgagaaatcctttgcaaatctcttgaaaatattttttccacggaaaaaaaccggccttgccctttgaagctcccttgggttcaccgggcaaattgtttttttttcccccccccaaatttttcacggggaccccccaagtttataaatttggggcacaaaaaaaaaagtggggtttttttttctccccccggggggatttcctctttcccttgtggggggccccccccgcgaaatttttgtgcccccccctcctttggggtattttggggggggggggggggggttttcttcaaaacccccccccccccccaaaaaaaattgtgcggcgggggggaggaatacccccccccttgggggagaattttttttgggggggggaaggaggggggttttttctctccacaacaaacccgggttttatatacccttttttggggggagaaaaaaaagggggggccccccccccccctgggggggggtgtaaaaaaaaaaggggccccctctcccc

SEQ ID NO: 85712 - DNA, 830 bp, Zea mays
  misc_feature: Ceres CLONE 1572094
  misc_feature: Translation starting site: 151
  misc_feature: SWISSPROT Homolog: EC 1.1.1.95 Phosphoglycerate dehydrogenase
ggagctccccgcggtggcggccgctctagaactagtggatcccccgggctgcaggaattcgtctcacccctagaaaaactcgccctgcaaagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctcgcggcgcgcggcggggccggggccggcgcgcgtctccgcgtgcggtgcgcgatcttgtcgtcgcccgcgcccgtggcgcccaccgagtcgaggccggcgcgccggatctcgccgtccgcgccggacggcgcgctgcggcccaagccggcggtgctggtcgccgagaagctgagcgaggccgggctggccgtgctgcggcagttcgcggacgtggagtgcgcctacggcatgtccccccgcggagcacctcgccaaggcggcgcagttcgacgcgctcatcgtgcgcagcggcacaaggtgacgcgggaggtgctggaggccgggcagggccggctgcgggtggtgggccgcccgggcgtcgggatcgacaacgtcgacctccaggccgccacccgaggtcggggtgcctcggccgtcaaagcgccccaccccaataccatccgccgcggccgaacaagggaatcgcgctggctcgcctccctgggggcgcaaccgtctccgcaggggggacgccggcgcctccagggcccggtaaatggggaaaaggaaacaaggtacggtgggggggttttctccttgggggg

SEQ ID NO: 85713 - DNA, 1087 bp, Zea mays
  misc_feature: Ceres CLONE 1572097
  misc_feature (67)..(67): n is a, c, t, g, unknown, or other
  misc_feature (68)..(68): n is a, c, t, g, unknown, or other
  misc_feature (307)..(307): n is a, c, t, g, unknown, or other
ttttttattgaggggtggtatttcaacgacaagagatagattgccctaccttgcgccttattctcannaaaaaaaaactgggactccccgcggtggcggccgctctagaactagtggatcccccgggctgcaggaattcgtctcacccctagaaaaagtgtgtgtgtgtgaccgtgcgtgaggcgtgagtccgtgaccattcccgtcggccgtcccaaaagaagcgcaaatttacaacccagtccaccacgggccacacaatcccaaatctaaccctccgacggcgatggggatctcgagcatgccnggagccgcgggacagccctgctgggggtacctgggtgtacaacacggtggatctcgaatcgcggccctgggcggggcttggggcgggccggcccctggggtttcctgggacctgcaaggccccccctcttcccccccccgggggaaccaaacggcggggggaaacccaaatggggcgggcgttttgggggccccggggaaactggggcgggaaacccggtttttccctcaaggggggccctttttccgggccccggggggcctttttttaaaaaaaggggggcctttgggggtgtttctaaaagagggggagaaacaaaaaacaattttttccaaaaaagagggggaaaaaaaagggggggggggggtctctccccacaaaaaaggggggagggaaaacaaaaaaaaattttggtcacaaaaccgcggtgggtgtggggcgcccccctcttgggcgcccccccggggggggtgttttccccccccgcgggcgacaaaagaagagggcggcccccccgcgttggtggttaaaaaaaaaaaaaggggggctcaccctcccccctggggtggggggcgcacacccccctattcttttttatccacacacgctgggggcccttgttgtttctctatagaaaaaacacaccccggggccctcccccgcgggaaaaaaagaaggaacacgccacccccaccatgtgtggcccgcctctttttttggtccgcgcggcccccgccccagggaggggccccctcctccccccccgacaaaaaaaaaaaa

SEQ ID NO: 85714 - DNA, 837 bp, Zea mays
  misc_feature: Ceres CLONE 1572098
  misc_feature: Encodes the peptide sequence at SEQ ID NO. 85715
  misc_feature (709)..(709): n is a, c, t, g, unknown, or other
  misc_feature (726)..(726): n is a, c, t, g, unknown, or other
  misc_feature (745)..(745): n is a, c, t, g, unknown, or other
ctccccgcggtggcggccgctctagaactagtggatcccccgggctgcaggaattcgtctcacccctagaaaaagtcacatgcgctgacgcgcatcccccccggcgtggcgtgcgctttgatctagctcttcttctcgaatccagcccgaggcctttttcttctgcggtttcatccgtacccatcctgcacacgaagcctagaatagccctcccctgctccgccacctcctcggatcccgaccaccccacccccaccccagacaacaggttgatggaggctaagatgggacgcttcttcgagtccgtgagcaatttcttcaccggaggcgaccacatcccctggtgcgaccgcgacctcatcgccggctgtgaaggagagcttgtcaatgctgcaaatgaggaacagaggaatgaaagccttatgaggttgtcatgggcccttgtgcactccaggcagacagacgatgtaaaccgtggaatcagcatgcttcaagcttctttggataattctgccagtcctctgcagactagggaaaagctgtacttgttggctgttggattctacaggattggcgactactcaaaaagcaggcaacttgcaaatcgttgtttggagattcaagcggattggcggcagggcatatcgctgaaaaaagcaatagaagataaaattgccaaagatggtctgattggaatagggaatgcgancactgcggtcggacttnctgggtggtggaattgcanctgctgttgccaggaagaagtgaggtcaactttattggatcggcagctcattgtactaggggagctcccgtctctggtaattcaactttttc

SEQ ID NO: 85715 - protein, 188 aa, Zea mays
  misc_feature: Ceres CLONE 1572098
  misc_feature (146)..(146): Xaa is any aa, unknown, or other
  misc_feature (152)..(152): Xaa is any aa, unknown, or other
  misc_feature (158)..(158): Xaa is any aa, unknown, or other
MEAKMGRFFESVSNFFTGGDHIPWCDRDLIAGCEGELVNAANEEQRNESLMRLSWALVHSRQTDDVNRGISMLQASLDNSASPLQTREKLYLLAVGFYRIGDYSKSRQLANRCLEIQADWRQGISLKKAIEDKIAKDGLIGIGNAXTAVGLXGWWNCXCCCQEEVRSTLLDRQLIVLGELPSLVIQLF

SEQ ID NO: 85716 - DNA, 724 bp, Zea mays
  misc_feature: Ceres CLONE 1572100
  misc_feature: Encodes the peptide sequence at SEQ ID NO. 85717
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (58)..(58): n is a, c, t, g, unknown, or other
  misc_feature (59)..(59): n is a, c, t, g, unknown, or other
  misc_feature (106)..(106): n is a, c, t, g, unknown, or other
  misc_feature (492)..(492): n is a, c, t, g, unknown, or other
  misc_feature (592)..(592): n is a, c, t, g, unknown, or other
  misc_feature (686)..(686): n is a, c, t, g, unknown, or other
  misc_feature (706)..(706): n is a, c, t, g, unknown, or other
nnnnnnnnnnnnnnnnnnnnnnnnnnnnnnnnnnnnnnnnnnnnnnnnnnnccaaaannaaagcgggccccccggggcggcgctctgaatagtggatcccccgggnctgcaggaattcgtctcacccctagaaaaataaggctgcttctgagggccactcaagggtattatgggctacgtggaggaggatctggtttccaccgacttcaccggtgacagcaggtcgagcatcttcgacgccaaggcccgggattgccctgaacgacccacttcatcaaagctcggtctccttggtaccaacaacgagtgggggcttacaggcaacccgggggtttcgttccaaaaaccctgaaattccccggcccaaaaaattggttttcccaaaaaaaaccccccatgtttttggggggggggggggggttttttttttttggggggggggcccttttcccccttataaatatacccccggggggggggggggttttcccnttcccccccccccccccacaaaaaaaggggggggcccccccctttttttgggggggggccgccccccccccccccaaaaaaaaccccccccccttaaacntttttttttttttttcccccccccgcggggacttttttttttgttgggcccccccccccaaaaaaaaaacccccccccccagaaaaaaaagggnaaaaaaaattatatataacngtgggaggtggggggggg

SEQ ID NO: 85717 - protein, 60 aa, Zea mays
  misc_feature: Ceres CLONE 1572100
  misc_feature: SWISSPROT Homolog: EC 1.2.1.12 Glyceraldehyde-3-phosphate dehydrogenase (phosphorylating)
MGYVEEDLVSTDFTGDSRSSIFDAKARDCPERPTSSKLGLLGTNNEWGLTGNPGVSFQKP

SEQ ID NO: 85718 - DNA, 785 bp, Zea mays
  misc_feature: Ceres CLONE 1572101
  misc_feature: Encodes the peptide sequence at SEQ ID NO. 85719
  misc_feature (779)..(779): n is a, c, t, g, unknown, or other
ctccccgcggtggcggccgctctagaactagtggatcccccgggctgcaggaattcgtctcacccctagaaaaagtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccaagatccaggacaaggagggcattcccccagaccagcagcggctcatctttgctggaaagcagcttgaggacgggcgcacgctggccgactancacatc

SEQ ID NO: 85719 - protein, 213 aa, Zea mays
  misc_feature: Ceres CLONE 1572101
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(213): Pfam Name: ubiquitin Pfam Description: Ubiquitin family
  misc_feature (211)..(211): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADXHI

SEQ ID NO: 85720 - DNA, 840 bp, Zea mays
  misc_feature: Ceres CLONE 1572102
  misc_feature: Encodes the peptide sequence at SEQ ID NO. 85721
  misc_feature (840)..(840): n is a, c, t, g, unknown, or other
ctccccgcggtggcggccgctctagaactagtggatcccccgggctgcaggaattcgtctcacccctagaaaaaagccctcttcctcttcctcgctatagaggacttcacagcagagcacagagctgagacgaaaacgaggaagatcccatccactaccgcccggtcgccgtcctcccttcccgccgcgccgctccgcttgctcgccgcaaatcggcctcacgattttattcggccctccgactccgggctcgcttggatcgagatgggcgactgcgtgtccaaggccgactccgcctgctgctgatgctgctgctgccgcgagccgcacaacggggttactggcgacaggactgatgctgtacacgacatgacgaggaggcatacgcccatgcctgcggaccaagagtttaccttcgagcagatgactgctagctacatacaagcgtttgcggtggagaacatagtgtctgagcaggctgagaaggctcccaatgtggtatacaaggggacgctgcgtgaccagtggcgagtcaacgggaagcgctagatgcgctctgcatggaccgactcgcgcgagatggtgcaagaagctagatgagttgggctgctgcgaagattaatgtaggcaaataagcttggctgatgctgcgaagtcatgacaggatgcttcgtgcataagacatgcccgatgatgcgctcgtcgagcatcttttcacttgtcagtcgcggtcaatgaatggaccatgacatatgatggctgcatctctgtcctggctgacgcttatgaatattgcaccaagatggggcagggctctctacagtgatgctcatgacgttn

SEQ ID NO: 85721 - protein, 59 aa, Zea mays
  misc_feature: Ceres CLONE 1572102
MTRRHTPMPADQEFTFEQMTASYIQAFAVENIVSEQAEKAPNVVYKGTLRDQWRVNGKR

SEQ ID NO: 85722 - DNA, 1180 bp, Zea mays
  misc_feature: Ceres CLONE 1572103
  misc_feature: Encodes the peptide sequence at SEQ ID NO. 85723
  misc_feature (17)..(17): n is a, c, t, g, unknown, or other
  misc_feature (18)..(18): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
ggtggaggggtatattnnattagttatgtattattggagggggaaaggaaatcaactnnnnnnnnnnnccaagctggaactccccgcggtggcggccgctctagaactagtggatcccccgggctgcaggaattcgtctcacccctagaaaaagcttatacggtgcctatgcccacgcatcgggctgtgggaggcgggctctgtttcagactcatcagccgagggcgatggcggcggccgcggggaaggcgcgggcgatgagcctggcggcggcggtgcgtgtggtggcggcgacggcgcggccggtatcgagcgcagccgcggcggcgggtgtgggtgcgatggcgttgatcgtgcagggcgaggacacagccttcgggtcgctggagtggtgggcgtacgcgggcatctccttcttcctcgtgctcttcgccgggatcatgtccgggctcacactggggctcatgtcgctcggcctcgtcgagctggagatcctccaacgcagcggcactgacgccgaaaaaaggctcaggctgcctgcccgtccttccagttggttcaaaaacaacacccacttttcttgtcaccccagttggttgggtaaatggctggctgcccatggaaggccaccttccctatattttcctttggaccagaaacggtttccatccccgggttggtttgcgctgcttgaacaattttgttcaagttggaccttttttttgtttcttttttgcccatatttttgaaaaaacggggttttaatatacctcgtcaaagagccaacagatcctctgtgtttcccccagggaaatatttgggggccctcttaataacccacgagggaggggtggctcttacaacccttgtttggttaatttggggggttacccccaaaacccccatttttttcttccttatgggggccgaaaattttggagtatatatcccccaattttgtctgttgtacaccccttataattggtgcgaaaagaggggttctccggggacaccagtggcggccctcttcagttggggcgccccaaaatagttaggttttctggcgcccccctttattttgagggttgtaaaaaattttgggttgtaaaagaaggaggtcttcggtgtgtgtgacaaccccaccatgcgcaaaaaaaaacgcccttggcgtcatcggggg

SEQ ID NO: 85723 - protein, 173 aa, Zea mays
  misc_feature: Ceres CLONE 1572103
MAAAAGKARAMSLAAAVRVVAATARPVSSAAAAAGVGAMALIVQGEDTAFGSLEWWAYAGISFFLVLFAGIMSGLTLGLMSLGLVELEILQRSGTDAEKRLRLPARPSSWFKNNTHFSCHPSWLGKWLAAHGRPPSLYFPLDQKRFPSPGWFALLEQFCSSWTFFLFLFCPYF

SEQ ID NO: 85724 - DNA, 837 bp, Zea mays
  misc_feature: Ceres CLONE 1572105
  misc_feature: Encodes the peptide sequence at SEQ ID NO. 85725
  misc_feature (509)..(509): n is a, c, t, g, unknown, or other
ctggagctccccgcggtggcggccgctctagaactagtggatcccccgggctgcaggaattcgtctcacccctagaaaaactccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaggggcggcgtccacacaaccggaggggaggggggcaatggcgagcgtggcaggccactctgcacgtggctcgtcgccgcgtgcttatctgcggcatgcgacgctgaagagcancagcagaagcatttctgcgcaggcggaagccgcgctggggggcgtgtcatgctcgggcagcggcgccgcctcggcgcgcggcgtcgccgctttggcgcgctctggaatgactatgggctggttgccttacagctgaaagaagtggtcattgaaaagaagaaccccgaatttcaaccaaagaaaggtgggtgtcacctgcatggggtgtaatggaacccattggggccatgatccttgacagggttttacaacaatctttctttgaagggggttagcgggaaaaagggggaaatggagaaggtttttacatgtttccaaattttcccca

SEQ ID NO: 85725 - protein, 53 aa, Zea mays
  misc_feature: Ceres CLONE 1572105
MLGQRRRLGARRRRFGALWNDYGLVALQLKEVVIEKKNPEFQPKKGGCHLHGV

SEQ ID NO: 85726 - DNA, 795 bp, Zea mays
  misc_feature: Ceres CLONE 1572106
  misc_feature: Encodes the peptide sequence at SEQ ID NO. 85727
  misc_feature (473)..(473): n is a, c, t, g, unknown, or other
  misc_feature (795)..(795): n is a, c, t, g, unknown, or other
aaagctggagctccccgcggtggcggccgctctagaactagtggatcccccgggctgcaggaattcgtctcacccctagaaaaaaacagcactgcccttgcttctaccgttccccaagtgcgctccctctctcgccatccatctcgtgcacgactgggcaaccgttgccgctgtcgaggtgcccaggtcttcatcggtccctcgtcagttcttctccggcccttcgccgccgacaagctccgccaggttgctgtgttaagtccaagcttatcacatggattcaacacaagattttcaacccaggacattttctataaagttgtggccaccaagtgaaagcacacggctcatgcttgttgagaggatgacaaagactatgtccacagagtccattttctctcgcaaatatggtcttttgggcaagcaagaggctcatgagaatgcaaaaggattgaagaaacttgctttgcatncgctgatgagcatttcaaaaatgagccagatggtgatgggagttctgctgtccagctatatgcacgaatcagccagatgatgttggaaagtcttgaaaaaaagcccagggactactggcagattgggaagcacctgtaaaatgaacatctcttgggggctgctgaagcacccccggtgcttgctgaaaccggaactggaaatatctggggggggaacgtgccttttttttgagccgaataaagccaaaggaactggttttttccccctttccaaacccggggaatctattaaaaaaattttgctttaccaacgggagctttn

SEQ ID NO: 85727 - protein, 92 aa, Zea mays
  misc_feature: Ceres CLONE 1572106
  misc_feature (67)..(67): Xaa is any aa, unknown, or other
MDSTQDFQPRTFSIKLWPPSESTRLMLVERMTKTMSTESIFSRKYGLLGKQEAHENAKGLKKLALHXLMSISKMSQMVMGVLLSSYMHESAR

SEQ ID NO: 85728 - DNA, 790 bp, Zea mays
  misc_feature: Ceres CLONE 1572107
  misc_feature: Encodes the peptide sequence at SEQ ID NO. 85729
  misc_feature (754)..(754): n is a, c, t, g, unknown, or other
  misc_feature (790)..(790): n is a, c, t, g, unknown, or other
ctggagctccccgcggtggcggccgctctagaactagtggatcccccgggctgcaggaattcgtctcacccctagaaaaagccccatcggacttcccaagggtcggctaggtggtctccaagctttccgcctttccacgccaccattctccccacccgcgcctcagcaatccagcatcgccgtttcgccgcggcaccgacacctcaccggccatgggcgcgtcctcctcgactggtaacccgtccccagaggcgcacgagcagcgggagcaggagaccctcgcctccgccgccctctccctcccgctcctccgcgccgccttctcccgctccgccgccaacgcgctgtcggatgccctcgcgccgccgcccgcctcctttcgtctgcccggatccccggcgccgccgccgccgcacttccacgacatcctcggggggctcggccccgccatcgcctcccaattctttggccacgaagctgccgcggtgacggacgggggcgccgggtgggtccagttcctcagggggttcaaccgctgctgcgcgcgcgtgacggcctcccgctcgctcgcactgctcctccgcgtgtacgctgccgcctgcgccggcgcgggggcaccctgcggcgtccagctccagccggacgagggcggtggtgacgaggatgggaaggttcgtgggggagctcgcgccggaagagatcgcagtggtcctctgggtgtgctgggtcatggcgtggagcgcttcggcctcgnagggtggtcagtgacggaagaagataatcggagccn

SEQ ID NO: 85729 - protein, 192 aa, Zea mays
  misc_feature: Ceres CLONE 1572107
  misc_feature (181)..(181): Xaa is any aa, unknown, or other
MGASSSTGNPSPEAHEQREQETLASAALSLPLLRAAFSRSAANALSDALAPPPASFRLPGSPAPPPPHFHDILGGLGPAIASQFFGHEAAAVTDGGAGWVQFLRGFNRCCARVTASRSLALLLRVYAAACAGAGAPCGVQLQPDEGGGDEDGKVRGGARAGRDRSGPLGVLGHGVERFGLXGWSVTEEDNRS

SEQ ID NO: 85730 - DNA, 1167 bp, Zea mays
  misc_feature: Ceres CLONE 1572108
  misc_feature: Encodes the peptide sequence at SEQ ID NO. 85731
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (1167)..(1167): n is a, c, t, g, unknown, or other
nnnntttttttccaaggttatataagtggggtagccgtgtaagactctgcaccgtccaattttattaaaaaacaaactggagctccccacggtggcggccgctctagactagtggatcccccgggctgcaggaattcgtctcacccctagaaaaaatcaatccccaaccaaacaagtttagatataaaaatatagcatcgtccgcagctctggagtagtctggatcctcctgaacctccaggcaccaagcgatcaaaggagggacgcaagccgttagcctgatggagcaccttgatgtgcaatggatttgccttgcttattgggcatctctgctaccagcgatagcatctggaaatgtgggtgcagcacctccccatacggagagccgattacagaaaatagaacttcagaacctcttcggagactcccgactagtacaagatcttcatcgcttctgttcctggtggcttgctgagcaaagcgggggggaaacagcaccgggatccccttgattggtcgaagaagacgacaccgtttcgggctgccaatcgatttccaacacaagactgctgtgtgaaaaaaaggcaaggggaactttcccttaaagctttgcaagaatgggaatgctaatcgcaggagacccttacgttggatgggcctataaggttaaaaaaaggggcaaaggcggcttcggttgccccttccatttaaaagggagaaatttcagggtgcccggccacacattttttcttactcctacccggagggagaaacctctttggaaataagcttcattcacgggttgggggcctcacccgggtgtggaggaggaaaaagaaaatgttttacacaggatttcaccataagatatggtttaagggggggaaaccactaaactgtgtcactaaccttgatattaaaggggcgcaacaagtggacaccaatcagtagactgtatcctcccacggtctacaacagggcgtaaacggacacaaaagtggatatcccttagggacataacaacggcatagggtggcaatattcatacattaaattcctcaaacagagagacatcctttccacgtcccgcctgtgttaaatgggtgtacccacactgcgaataaaccttcacccggacaatagtaatctaaagtgtcacggggcctn

SEQ ID NO: 85731 - protein, 76 aa, Zea mays
  misc_feature: Ceres CLONE 1572108
MEHLDVQWICLAYWASLLPAIASGNVGAAPPHTESRLQKIELQNLFGDSRLVQDLHRFCSWWLAEQSGGETAPGSP

SEQ ID NO: 85732 - DNA, 834 bp, Zea mays
  misc_feature: Ceres CLONE 1572109
ggagctccccgcggtggcggccgctctagaactagtggatcccccgggctgcaggaattcgtctcacccctagaaaaatcctcgcctccccctcttcgtcagccccgcatctggcccggattagccgcctccggctccctcccggatcgccccaccaacagccagcctcgccaggtatgtctcgtgttccctcatctggacgcttctcccttctcggccggccgcctcgttggttgccatcagcggacgccgccgattcggctctccttgctgtgttcggcgtcgggtcgcgcgacagacgattctataatatggagtacatgcgtgccgcgcactgtttagtggttcctgcggtcgtccgtcgctgcgggaatgttcctttgttgctaacgaattcagtgattgtggtcgtacgggtgatgccaattcagtaatcgcctgccatctttaattgtctggtgagccagtcgagacgccggtttggcgttaggaattattggaattccacagcgcctggcatttcgttccatcccccatcttgtacggatccttgggagattctaggctccatctgatctcgctgcattatgttctttttcctgcagtccgaggcgcaatagataagttcgtgtctgtagttgctaccatttctctactctctacgtatggtatttagtcgcggggatatttattgaaatgttggtacggacgacagaaaaacaagggagaatcaggggttgttggattggatgtagcctgcgccaccatattttaacttcaaatccgttgagaaatccttcttttttcgggtctctttgataccttcctcctttg

SEQ ID NO: 85733 - DNA, 832 bp, Zea mays
  misc_feature: Ceres CLONE 1572114
  misc_feature: Translation starting site: 365
  misc_feature: SWISSPROT Homolog: EC 1.5.1.3 Dihydrofolate reductase
  misc_feature (638)..(638): n is a, c, t, g, unknown, or other
tccccgcggtggcggccgctctagaactagtggatcccccgggctgcaggaattcgtctcacccctagaaaaaaacgccgacgctgcaacttccgctccctccccgactcgcgctcggcacgcaggcacgcgactgcggtggcgctcaggctcgggctctcagcaacggcggggcagtcccagactcagcgtctccctctcgccaatcgccttgcgccctcgctccgttcctctgctcaccggccgattctgcgttgcaagattttccagcatagcttgctcacctacttctcaatttagaagacctcaatttctggatctgagcatcaaatcaagaccataccactttagtcagtcctgtctgatggcactgactgcagctccagccagtggtgattcacagagtggtcctcagaggaactatcaggttgttgttgctgccacttgtgacatgggcattggcaagggtggggtattgccatggaagcttcttggtgatcttaaattcttcaagaacttacactaactacaactgatcctgccaaaaagaatgcagttataatgggaaggaaaacatgggagagcattcctgttaagtcaagccactgccctggtcgtttgaatgtcatacttactcngatctggtagttttgattttgcaacagtaggagatgttgttattatgtggaaggtatgaaatctgcctttagagctgctagcatcaactccatactggctatcaatatgagaaaggttttggtcataggaggttgggcagggtacctgagagatattttgaatggaccctggcatgggaggctatccatctgaa

SEQ ID NO: 85734 - DNA, 880 bp, Zea mays
  misc_feature: Ceres CLONE 1572115
  misc_feature: Encodes the peptide sequence at SEQ ID NO. 85735
  misc_feature (347)..(347): n is a, c, t, g, unknown, or other
  misc_feature (880)..(880): n is a, c, t, g, unknown, or other
ccccgcggtggcggccgctctagaatagtggatcccccgggctgcaggaattcgtctcacccctagaaaaagtgccactgtctcgtcggctcgtcgctccgtagaccccgcgcctccgcctccccgccactcgccggaggctgccgccatcgttatgccatggccgtcatcctctcctccgcggcgccaacgatactgactcgtcccacgcgccctcggaggcagccgaggagcggcctccgcgggggcctcgcgcgcctctcagctgcgctcggcctcgcgcacgcgggcgccggcgccggcgccgcactcgccgcgccgctcttctacgaggagatgctgcgccntctcgtccgactccgggcggtgatgtttggcggggttcccgcctcccggaagcttcggcctcgaacggggctcgtttgacattcgttaaacgataacccttctcctcctcccgggcagggggttccgggccaatccaaatggccccttttttctttggccaaggttttccgggggggaaggggggaggtttccaagagccttaatttcgttccttgttcccccaaagggggggccctatcacagggggttgtgtttcgaaggaaaccccaaaaaccccccaattttttttttaaaaaaatatagggggcccccttccaagggggtgtcccccagaaaagggggcccgggccccccccccttgtatttttcttaggggaggggggtttaaaaaaaaaaaaaaagcggggtgggtccgcggcctcccttttaaaaaaagggggggggggggggaaaaaaaaacagggggtgtttttttttgaaaaaaaaaaatttgtgcccccccccaaaatatttttttgggggggggcgcccn

SEQ ID NO: 85735 - protein, 88 aa, Zea mays
  misc_feature: Ceres CLONE 1572115
  misc_feature (63)..(63): Xaa is any aa, unknown, or other
MAVILSSAAPTILTRPTRPRRQPRSGLRGGLARLSAALGLAHAGAGAGAALAAPLFYEEMLRXLVRLRAVMFGGVPASRKLRPRTGLV

SEQ ID NO: 85736 - DNA, 851 bp, Zea mays
  misc_feature: Ceres CLONE 1572116
  misc_feature: Encodes the peptide sequence at SEQ ID NO. 85737
  misc_feature (1)..(1): n is a, c, t, g, unknown, or other
  misc_feature (25)..(25): n is a, c, t, g, unknown, or other
  misc_feature (135)..(135): n is a, c, t, g, unknown, or other
  misc_feature (136)..(136): n is a, c, t, g, unknown, or other
  misc_feature (168)..(168): n is a, c, t, g, unknown, or other
  misc_feature (171)..(171): n is a, c, t, g, unknown, or other
  misc_feature (201)..(201): n is a, c, t, g, unknown, or other
  misc_feature (396)..(396): n is a, c, t, g, unknown, or other
  misc_feature (488)..(488): n is a, c, t, g, unknown, or other
  misc_feature (598)..(598): n is a, c, t, g, unknown, or other
  misc_feature (679)..(679): n is a, c, t, g, unknown, or other
  misc_feature (712)..(712): n is a, c, t, g, unknown, or other
nccctggccgccgctctaaaactantgaatcccccgggctgcaggaattcgtctcacccctagaaaaaatcacgcaatcgagaaaaacacaaaccgaaaaacctcctctacagtcccatctaggcgcccctcccnngctccaatccagtttcgccggcggccatgtcncanccggcggcgacggtggccgcggcggcgcanccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccaaaagggcgagccaatggatatgtggatgtatttgtcaaanaacgagaagttcaacgattttgctaatgaggatgcacttatttggcacgaggcaaacataccatatgcagtctggggacctaccagtactanaacacggtcattaacgtactatccgtcagaggctctcaagcataatggctctttgtatgctcatgtttacttcgccccgttcggttatcctgtggaccctacagatccanaatatgagcagaaatcttcttttgggaggacccatccctgttgtggcattcttgccaaaatcaaaagctggttaaaaaaanagctttgcttggagattcaaaaaagccctgaanagaaaacaccccccaataaaggagaataaaaaaacctgaaggataaaaatgaagggtcccgactggaatatattttcttattgggaaaaccaaatgtaaaacattaattcttggtttgaaaaattttcaccggggggat

SEQ ID NO: 85737 - protein, 192 aa, Zea mays
  misc_feature: Ceres CLONE 1572116
  misc_feature (3)..(3): Xaa is any aa, unknown, or other
  misc_feature (13)..(13): Xaa is any aa, unknown, or other
  misc_feature (78)..(78): Xaa is any aa, unknown, or other
  misc_feature (109)..(109): Xaa is any aa, unknown, or other
  misc_feature (146)..(146): Xaa is any aa, unknown, or other
  misc_feature (173)..(173): Xaa is any aa, unknown, or other
  misc_feature (184)..(184): Xaa is any aa, unknown, or other
MSXPAATVAAAAXPQGRGPAGRQGGLGQSIAGIVRMAVFWYFASKFFGPKRPPADPGMLMSNLFQKGEPMDMWMYLSXNEKFNDFANEDALIWHEANIPYAVWGPTSTXTRSLTYYPSEALKHNGSLYAHVYFAPFGYPVDPTDPXYEQKSSFGRTHPCCGILAKIKSWLKKXLCLEIQKSPEXKTPPNKGE

SEQ ID NO: 85738 - DNA, 1075 bp, Zea mays
  misc_feature: Ceres CLONE 1572117
  misc_feature: Encodes the peptide sequence at SEQ ID NO. 85739
  misc_feature (5)..(5): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (54)..(54): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
ttttntttccnnnnncaaaccaaaaacaaaaaataaagtacaggggaggaggcncctttnnnngttanannnnaaaaagctggagctccccgcggtggcggccgctctagaactagtggatcccccgggctgcaggaattcgtctcacccctagaaaaaacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgactttcctgcgcgccgcccgggtgcggacgccccgtgaatcgtggcgcttcttgacgggggaatccacgaagcgggggttccccccggaaaacaaatccccggaaccccccggccgggttcccccccgtgaaagtttcttcccccccccccgaagggggcaaccttggggaacccctgggttgggggcaaacaaaaccttttcccccggtgctttttcttttcaaatccccccgcgaaaacgggggaattttaaaggttttttcccccccccaacacgtgtgggattcctccacggccgctgtttataagaaagcccccaaaacccccccgcggggttctccacccctttgtgcccagggaaaaatactgcggggcggggggtgtgttttagaaaatttttccttgggtggggaaaccctccccccgaagaaaggaccgtgggcaaacccctttttgttttttccccccctttaaataaaaaaggtgggggggggtccctccccaaaaaacccccccccacaattaaaagggggttccgccgttaaaaaaaccatcaaaccttctctttaaaaccccccgggggaaaaagcc

SEQ ID NO: 85739 - protein, 99 aa, Zea mays
  misc_feature: Ceres CLONE 1572117
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFPARRPGADAP

SEQ ID NO: 85740 - DNA, 829 bp, Zea mays
  misc_feature: Ceres CLONE 1572120
aagctggagctccccgcggtggcggccgctctagaactagtggatcccccgggctgcaggaattcgtctcacccctagaaaaagtgtctagtgtcttccgtctcgatcccgcgggtgggactcgccggcgacaaaaacgaaaagcgacttgccctccgcggcctccggccttcccactccactcgccctcctctcctagcgtcggtgagccggtgcgctgcagtccccgctccccttccgcgtcgccgcgatggaggtcttccgggagcacggggacgacggagtgccctaggattccatcacgccgccaagcatcagtcccgcagccagggatttcttctccgaccccgaccttcatgtgagtcgcggccttcctcctcgaagcggatccggcggattggaggggccaaccatagcagattcgaaattttctagctcagcaccataaaagggcagacccagtgtcggaggatctcacatgagtggattctgggtaagggataaaccaagggaaagtctttcccccacaaatgcggagaagctgttttgaacccgtgacttggtacttcttgcgggtgtaagcatttcgctgcacttggagacgcttatttggagtatttgaagtatgagttggctctctgtcctgtcagttatgtgcctgtgcttcataaaaagagctacatttttctctactagggctttgagactgcccagatgaagagtagatttcctggttctctggtgccattggctgcgtcatggctcaaaagggagatgccaatgtcgtgctattgggggataatctgaacctgttctttgccggaaattc

SEQ ID NO: 85741 - DNA, 810 bp, Zea mays
  misc_feature: Ceres CLONE 1572121
  misc_feature: Encodes the peptide sequence at SEQ ID NO. 85742
  misc_feature (609)..(609): n is a, c, t, g, unknown, or other
  misc_feature (610)..(610): n is a, c, t, g, unknown, or other
ggagctccccgcggtggcggccgctctagaactagtggatcccccgggctgcaggaattcgtctcacccctagaaaaagcattttggctcctcactgccgcgccgccaccccctacaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagtgaagaagtgaggagaaggttctacaagaactggtgcaagagcaagaagaaggctttcacaaagtatgctctcaaatatgaaaatgatgctgggcagaaggaaattcagctgcagcttgagaagatgaagaaatatgcnntctgtatccgtgtcattgctcatacccagattaggaagatgaagggtttgaagcaaaaagaggctcacttgatggagattcaggtcatgggtggtaccattgctgaaaagggtgaaactatggctaacaattcttttgaaaaagaaggtccctgttgaaaggctgccctcccgaaagggatggaaatgatgaacttccta

SEQ ID NO: 85742 - protein, 209 aa, Zea mays
  misc_feature: Ceres CLONE 1572121
  misc_feature (50)..(208): Pfam Name: Ribosomal_L3 Pfam Description: Ribosomal protein L3
  misc_feature (158)..(158): Xaa is any aa, unknown, or other
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLNSVWAQHLSEEVRRRFYKNWCKSKKKAFTKYALKYENDAGQKEIQLQLEKMKKYAXCIRVIAHTQIRKMKGLKQKEAHLMEIQVMGGTIAEKGETMANNSFEKEGPC

SEQ ID NO: 85743 - DNA, 835 bp, Zea mays
  misc_feature: Ceres CLONE 1572122
  misc_feature: Encodes the peptide sequence at SEQ ID NO. 85744
ggagctcaccgcggtggcggccgctctagaactagtggatcccccgggctgcaggaattcgtctcacccctagaaaaaggccgtatcgttggcgcttgtcgtctccctatcgccccggctcctcgcctctccgtggccggccggtgctgatcacttctctgctcaccgctcgaatctgggctgtcgccgagccattctgatcaccgctgctgatcacttctctgctcaacggaaaggagacagattcgtggttcgtcagcggacgcggcggcgacttcatagggtgttctcggccgcttccggcgcgcaaagcggacgcacggcgtgcgcccgcccccagggatgaactgctccagattctacaaaggttagatctactgctgcatcttccgaatccgcgtgcgaatgcaccgccgagctcgataaggccctgtggccgcgccggcgctgtgcctcgtacgcctggccgcagggtcgttggtaggcgcgtacaaccccgccgctattgctcgcggatgggcccggtgcgtggctcgctgaggcagtgtgaggctgccgagggggccggtggggaaaacttggaatccggtcgttcggcgaacgtggcggtatctattgagctccgaatcctgggctcgtcatcccagcacgaatccatttccgcatcaggaattccggaacgtgcttatggcagcaaaaaccagcctttagcatgtggaaccaaaatttccgagccccgacctccggggaaatgggggccctaagggtggaatttcaatccgttggccgttttccagatatattggaattggctggcttagcctaacatcggggg

SEQ ID NO: 85744 - protein, 82 aa, Zea mays
  misc_feature: Ceres CLONE 1572122
MGPVRGSLRQCEAAEGAGGENLESGRSANVAVSIELRILGSSSQHESISASGIPERAYGSKNQPLACGTKISEPRPPGKWGP

SEQ ID NO: 85745 - DNA, 848 bp, Zea mays
  misc_feature: Ceres CLONE 1572123
  misc_feature: Encodes the peptide sequence at SEQ ID NO. 85746
ggagctccccgcggtggcggccgctctagaactagtggatcccccgggctgcaggaattcgtctcacccctagaaaaaaacgagcgtatctgcttggtttattgtgggtaaaaaatatttgtttttgcaaagctaactgctacgctgccaccgccatgcgccgatggcaccacctacagggcagcgccacacgggggcctcgtccctgcgcggcgcatcttccacagcatcagcagcgccgtcgcgtcacgctccggcgcctcgccatccaacctccccagtcggggcagctgaacgctgttgcttgccgccgccatggcaagggccgccaatgtccacggaggtcgcgggagtgctagaaccggtgttactcgaggcttcagccccgatgtgccgccagaggcactcgacaacatcaacccctgagcctagaagtgtcaatctcatccacagagatacatggtcaatcgtgcgccgaaacgtgcaaaggactgctcagaactccgcattcgcctccttttgaggcagagctccactgaaactgtgacatccccgtgctgtgaccacacggccttacccaattcccaagaagtacggacatcctgtcagaaatctagtctgcttgaacaaaggtgaaacggcagactttaaaccggggtagatcccttggaggggggccccccgaaaattccttttaaaaaattccccagaaagagcccaggggggaaattttggccctccggccctgggaaataaaaagggtttcgcaaaaatggaaaatgtggttgcgggggatatcccctcccccccaggaaagggaggttccattcgccagggcgggtaaaata

SEQ ID NO: 85746 - protein, 36 aa, Zea mays
  misc_feature: Ceres CLONE 1572123
MARAANVHGGRGSARTGVTRGFSPDVPPEALDNINP

SEQ ID NO: 85747 - DNA, 782 bp, Zea mays
  misc_feature: Ceres CLONE 1572141
  misc_feature: Encodes the peptide sequence at SEQ ID NO. 85748
  misc_feature (308)..(308): n is a, c, t, g, unknown, or other
ctccccgcggtggcggccgctctagaactagtggatcccccgggctgcaggaattcgtctcacccctagaaaattttttttttgcaaaccaacacaaacgccgaatcgagtcaatcggcattcggccgtccccagtccaccggaaataattgccttgatcagcaacgatggcgggagatccggccgccggggtcggcggcaacgcccaccccgcgtcggggagcaagagctcccgctcgtcgacgcggcaccgtcagttccgcgaccgagccaggtccgagtcgacgaccctacagagatgttctgcngcctccaaatccgctcgcaaggagagccgctccgccgacgcccgctgtcttcaaggagcaagtccacccaaatgctcccgcaagtgggggtgccaaggttaagggtcccatcccccgggtttccttttcccaaaaaatccccgggggaaacacccggggagggtttcggaatccccccctccggaaaaacccccccaacacttcttccactttggggggggcccccaaagaaggaaagaaaaaactcccccccaaaaaaaccccccgggggggccccttttttttttgaaaagacacccaaaaaaaaagggggggggaaaaaacgggggggtggccacaacatttttttttccccgggggggggaaatcatataaatagggggggggccgtttttttttttcttctaaaaaaatttttttttttgtgggggggggggggggggggggggagagatttttgtgaaaaaaaaaact

SEQ ID NO: 85748 - protein, 80 aa, Zea mays
  misc_feature: Ceres CLONE 1572141
MAGDPAAGVGGNAHPASGSKSSRSSTRHRQFRDRARSESTTLQRCSAASKSARKESRSADARCLQGASPPKCSRKWGCQG

SEQ ID NO: 85749 - DNA, 968 bp, Zea mays
  misc_feature: Ceres CLONE 1572142
  misc_feature: Encodes the peptide sequence at SEQ ID NO. 85750
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
ntttttttttttnnnnnncttccactcataaatgaggaaggaaaagcggagggagaggaggtgcggtgtaaaannnnnnnnnncgggggctccccgcggtggcggccgctctagaatagtggatcccccgggctgcaggaattcgtctcacccctagaaaattttgttccgtcgcttcaacggcacggaagagaatcgctacccagccaatcgaagtcttctcttgccctgctttatctcatatcctgttgcgcgagattcttggcgattctgctactgatttttatttttattttgctagttcttgaaatttcttgcacgagtgtcagtagccaactgctgataacaacatcctatcgttcctgtagcccctttccgtgaccttgccaaagaatttgctcttctctgtgcgtgtgcaatttcttccgctacagctcaaggatccgctactctgctgttttgggagattcgccatgggcggcggggccgttaacgaccacttcccgggggccagcgacccgctgctccccacgaagcgggatggggacggggacgaggacgacgcaggtgcctcccgcgttccacggagttcgacggcgccctcctttcgcccggcgcgggtggttcaaccctctcccaccacccatcggtcgggcgccggggccattcatggggcgcctaccccgggccaaccatggaaaagggtggctccgggttcttcgttccccttggggcctcggtccatggaaaagtgggtttgggccggcggctttccttcaaccggaaggccctccaattcaaggcttgcctccgtggcggggttccacccccggggcccccgggggcgccagctcttcccttaaaggggggggggccatgggcccgaaacccctttccggatgggggggggggtaagggaaggcttcccccccagggcctggcgttccgtccttcaaacaaacgggggc

SEQ ID NO: 85750 - protein, 129 aa, Zea mays
  misc_feature: Ceres CLONE 1572142
MGGGAVNDHFPGASDPLLPTKRDGDGDEDDAGASRVPRSSTAPSFRPARVVQPSPTTHRSGAGAIHGAPTPGQPWKRVAPGSSFPLGPRSMEKWVWAGGFPSTGRPSNSRLASVAGFHPRGPRGRQLFP

SEQ ID NO: 85751 - DNA, 779 bp, Zea mays
  misc_feature: Ceres CLONE 1572143
  misc_feature (726)..(726): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
ggagctcaccgcggtggcggccgctctagaactagtggatcccccgggctgcaggaattcgtctcacccctagaaaaaggttgctggagtctgatgtgtggtctgttgccgtccggttcatcaagatctgggccgaacgactaccccgtccgcaggggtacgccgagcacaccatactccaaacacggaatcgcgacgggttgataggactactgcccctccattcctctgggcggcacttcgacgagttgcttgcgatctccatcaacgcatttctcatcctgtaaccgcacgcgtcttgtcgagtccgaacccaaatcaccatggttcgacgaatcgcaaaaaccacggctgtcctaccagcggtctgcggagatctcaggcacaccaacatgtgtcgtgttagcgccaggtgcccaagagtcgcacgactcctgaacaccttctcccgagggagtgccgagtgtccgcgcggtttacatctgtcacccaagacatgaagatagagatggatcaactgactgttttcctcttagatgagggaccagattgtctgggaaatattcgaggcctacagagtcgctgtcgatagtctctatacgctccaggattccctggaggtcgagagccggctctagtagcctctgagatcatctagtgcagatccgatgacctcgaaatgttggctgcctatactccttacgccacagacgatgggaatgatgntggttttttttttnnnnnnaaaaaaaaatccccccaattttgaagattctggc

SEQ ID NO: 85752 - DNA, 819 bp, Zea mays
  misc_feature: Ceres CLONE 1572145
  misc_feature: Encodes the peptide sequence at SEQ ID NO. 85753
  misc_feature (47)..(47): n is a, c, t, g, unknown, or other
tggagctccccgcggtggcggccgctctagaactagtggatcccccngggctgcaggaattcgtctcacccctagaaaaaaaaaaaaaaaaaaaagacagcatcactggccgtgtagtgtagctagagcccctgcactggtccggattcgcagagcaaaacggaaatgatcactgtggcagcaccggaggcgcagccgcaggtggcggcggcggcggttgcggcgccggaggagaccgtgttccggtcgaagctgccggacatcgacatccccacccacctgccgctccacgactactgcttctcgagggcggcggaggccgcgggcgcgccgtgcctcatcgcggcggccacggggaggacctacacgtacgccgagacgcgcctcctgtgccgcaaggccgcggcgtgcctccacgggctcggcgtcgcccagggcgaccgcgtcatgctcctgctccagaactccgtcgagttcgtgctcgccttcttcggcgcgtccttcctcggcgccgtcaccacagcccgccacccgttctgcacgccgcaggagatcaccagcaattcagcgcctccggcgcgaaggtcgtcgtcacccacttcggcctacgtcgcccaagctcggcacgacgcctttcccaaaggatgggcctggacgggaatggcccttcccgtccttcacatcaaaggggacgcgggccgaaaccccgggaaggtgtccgggggttttgggaaacttgtttccgtttcggggaaaggggaaacccctccccggagggggtccattttcccgggaaggaacccctgggggcttcccctt

SEQ ID NO: 85753 - protein, 218 aa, Zea mays
  misc_feature: Ceres CLONE 1572145
  misc_feature: SWISSPROT Homolog: EC 6.2.1.12 4-coumarate--CoA ligase
MITVAAPEAQPQVAAAAVAAPEETVFRSKLPDIDIPTHLPLHDYCFSRAAEAAGAPCLIAAATGRTYTYAETRLLCRKAAACLHGLGVAQGDRVMLLLQNSVEFVLAFFGASFLGAVTTARHPFCTPQEITSNSAPPARRSSSPTSAYVAQARHDAFPKGWAWTGMALPVLHIKGDAGRNPGKVSGGFGKLVSVSGKGETPPRRGSIFPGRNPWGLPL

SEQ ID NO: 85754 - DNA, 785 bp, Zea mays
  misc_feature: Ceres CLONE 1572149
agctccccgcggtggcggccgctctagaactagtggatcccccgggctgcaggaattcgtctcacccctagaaaaaatccggccctcgctttgttaacgaagaattccctcatagccgccgccgccgccgccgccgccgctcatcgtcggggagaggtgacgggaccgaggaactcgccgagttctaagatagagaatcgcttttcacagcctggggtctgctgcgtagggtggtgttgaacgtggagaagtttccgatctgttccgctcatgacccgttgcgcgctcgctgatcgtgggttccagacatattcttcttcgttttgaatttgatgtactgctggagtcttccggtgggaagaagtcttgcactcgccgttccttgatgtctgatgctccccttggctacagccttgaggacgttcgatctggcggaagctcgaagaagttccagtctgctgcttactccaactgctcaaagaagcgatgctgatctctcttttggctgcctcgtactactagtggtaggatgtcttttctgactctgcgatgtcttaccaatccgcctgggctgctgctttgcatgacaagagaccagctcgccggtctggatccctgcgatcctccctcctccatctgcagggttgtgttcggactcacctgcagcgatggatgatctttctgctgctggtgctcccccagactcatctatcgcgtctgcacggctatgagaagcgccttgagatcgcttctctgaggcagctgtctatgtggaccgccgtggg

SEQ ID NO: 85755 - DNA, 807 bp, Zea mays
  misc_feature: Ceres CLONE 1572151
  misc_feature: Translation starting site: 113
  misc_feature: Pfam Name: 2-Hacid_dh_C Pfam Description: D-isomer specific 2-hydroxyacid dehydrogenase, NAD binding domain
  misc_feature: SWISSPROT Homolog: EC 1.1.1.95 Phosphoglycerate dehydrogenase
  misc_feature (504)..(504): n is a, c, t, g, unknown, or other
  misc_feature (539)..(539): n is a, c, t, g, unknown, or other
ctccccgcggtggcggccgctctagaactagtggatcccccgggctgcaggaattcgtctcacccctagaaaaaataccactccacaatcacacattcgacaccgccaatccatggccttggcgacgccgctgcggctccgccgccacctcctcctccccgccgggccgtccccggcgacccaccgcgccctgtcgctgcggcggggccgcctcctccccgcaagcctgtccgccgcagcgggcgggcggccgacggtgctggtgacggagacgctgggttccgcggggctggacctgctgcgcgccttcgccaacgtggactgctcctacgagctgacggcggaggagctccgcgccaaggtgtcgctcgtggacgcgctggtggtgcgcagcgggacgcaggtgacgcgggaggtgttcgaggccgcgcgcggcaggctccgtgtcgtcgggcgcgccggggtcggcatcgacaatgtggacctccaggcggccaccgaggnccggatgctagtcgtcaacgcgcccaccgccaacnacgtcgccgccgccgagcacgccgtcgcgctcctcgccgccgtggcgcgcaatatcgcgccgggcgacgcgtcgctcaagggcggcaaatgcagcggggcaagtatgttggcgttaccttggttgccaagaccctagttgtcatgggtttcggccaggtcgggtcaaaaggtggctcgaccccccagaggactcgggaatggacgtcgtccccccacgacccaataccttggcgccctatcgaaccccgggcggtcggggtttcaact

SEQ ID NO: 85756 - DNA, 817 bp, Zea mays
  misc_feature: Ceres CLONE 1572152
  misc_feature: Encodes the peptide sequence at SEQ ID NO. 85757
  misc_feature (816)..(816): n is a, c, t, g, unknown, or other
ggagctccccgcggtggcggccgctctagaactagtggatcccccgggctgcaggaattcgtctcaccccctagaaaaagcctctggacgggggcctggcgtgtatcgtggtgcgttgcctcccgcgccaccactactccgtctccaagtcgcgtcgtcgcactcgaatccatccatccatcgatcgccttcctctctttttatatcgcacccccccgcttccgctcgctcgatcgtcggagtaggcgggcggcatgctgcaggccagctcggagaggccggcgggcctgctgtgggtgcccgggacgagcccgtggccgacgatggacgcggggccgtcggcgagggcgcaggagatcgcgcggcggcgggaggagatgctggggatgctgcgcgacctcccggagtccgagtacgagctctcgctcaccgacctcgtcgagaaggccggggccgaagccgaagccgaagccgaagccgcgcccgcgaccgcccccaccaaggcagaggacgggaaggacccgggcgccgcgcggtcggcggcagctgcggggaggcacgagcggagggcgtcggcgcggcagcggggcagcggcgggagcagcttccgcagcagcagcgacggcgtcctgctcaacttctacatggcgcgctcgctcacccgcagctttcacgcgccgcgacccgccggggacggcgtcgttcgcctccggctggcggaggcccagcgtcgcatcgactgcaaacaagagggagagggacccggacgcgaagaccgtcaagtgctgggcgttgctgtgggaatcggcggtggcna

SEQ ID NO: 85757 - protein, 187 aa, Zea mays
  misc_feature: Ceres CLONE 1572152
MLQASSERPAGLLWVPGTSPWPTMDAGPSARAQEIARRREEMLGMLRDLPESEYELSLTDLVEKAGAEAEAEAEAAPATAPTKAEDGKDPGAARSAAAAGRHERRASARQRGSGGSSFRSSSDGVLLNFYMARSLTRSFHAPRPAGDGVVRLRLAEAQRRIDCKQEGEGPGREDRQVLGVAVGIGGG

SEQ ID NO: 85758 - DNA, 809 bp, Zea mays
  misc_feature: Ceres CLONE 1572156
  misc_feature (184)..(184): n is a, c, t, g, unknown, or other
  misc_feature (185)..(185): n is a, c, t, g, unknown, or other
  misc_feature (223)..(223): n is a, c, t, g, unknown, or other
  misc_feature (316)..(316): n is a, c, t, g, unknown, or other
  misc_feature (317)..(317): n is a, c, t, g, unknown, or other
  misc_feature (417)..(417): n is a, c, t, g, unknown, or other
ctccccgcggtggcggccgctctagaactagtggatcccccgggctgcaggaattcgtctcaccccctagaaaaatttttttcaccccgctcgatcgatcggcacccgcgcatcgcgtcggcattctctccagccgctactccctccctgcctctccacgatctcgcgaaccctgctagatccnnttgactcgccatgggtccaacccctgggggcggcatcngttggtgccggcgcgtgggcgctggacgcgagcgcgctgaggaggagagcgcgaccaccgcgggtccgtcccccgcccgccccgcgcgggttnncccagctcgcgaggcgcagcgggcgccgccggcagtccagaagaagacaaaggaacacgctctcgctctcggagttcgccggggtccgcccggggcggcngcaaaaccccgggcccccccggacccagggggcctccccacgggggaaaaaaaagatgccttcccacggggcccccaggggagggttcccgggaaaaaaatcccaattgggcccccgggggcctggggggggggggggtttccgctcccctaagggttcccgggaaaaccggggggggggggggtttttaaaaaaaaaaaaggcccccccggggggcccccccgggggggggggtctagaaatattaaaaaagccccccccccccccgccccaaaaaaaacaaccccatgggtgttccttaaaaaaaaaaaaaaatttttctcccccccttctctccccaaaaaaatgttttttttttaaaaaaacccacaaaggggggggcccccaggaga

SEQ ID NO: 85759 - DNA, 795 bp, Zea mays
  misc_feature: Ceres CLONE 1572157
  misc_feature: Encodes the peptide sequence at SEQ ID NO. 85760
  misc_feature (601)..(601): n is a, c, t, g, unknown, or other
tccccgcggtggcggccgctctagaactagtggatcccccgggctgcaggaattcgtctcacccctagaaaaaatcggcttccgcatctccccgcctccacccacggcactcgcaagcagcgctcattagtcactagggttttaaactttccccccgatccgcctcgccgccggcgtcgtcctccgccggaaatccaccaccctacacccagccggagacgactatggtgggtttcggctcgatggcgggctacgggatccagtcgatgctcaaggaaggccaccgccacctctccgggctcgaggaggccgttctcaagaacatcgacgcctgccgcgagctgtccgccattacgcgcacctctctcggcccgaacggaatgaacaaaatggttatcaatcacttggacaagctgtttgtcacaaacgatgctgccaccattgtgaatgagctcgaagttcagcaccctgccgctaagattctggtactggctggtagggctcaacaagaggagattggggatggggcaatctcaccatatcgtttgccggtgaactgcttgagaaggctgaggagctcatcaggatgggcttgcatccnagtgagatcatcattggctacactaaagcatcaacagacaattgagatcttggaggatctttgttgagaaggctcagagaacatggatgtgagaaccaggaagacgttgtgttaaagataaaacccgctgtgcggagcaacaatttgggcaggggaattaaggggccctcctggggctggagcctgcattcaaa

SEQ ID NO: 85760 - protein, 147 aa, Zea mays
  misc_feature: Ceres CLONE 1572157
  misc_feature (126)..(126): Xaa is any aa, unknown, or other
MVGFGSMAGYGIQSMLKEGHRHLSGLEEAVLKNIDACRELSAITRTSLGPNGMNKMVINHLDKLFVTNDAATIVNELEVQHPAAKILVLAGRAQQEEIGDGAISPYRLPVNCLRRLRSSSGWACIXVRSSLATLKHQQTIEILEDLC

SEQ ID NO: 85761 - DNA, 1144 bp, Zea mays
  misc_feature: Ceres CLONE 1572159
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (367)..(367): n is a, c, t, g, unknown, or other
  misc_feature (1144)..(1144): n is a, c, t, g, unknown, or other
nttaaaaaannnnnnnnccttaacttcgttatacagaacactaaaaggggagnnnnntttnnnnnnnnnnnaaaactggagctccccgcggtggcggccgctctagaatagtggatcccccgggctgcaggaattcgtctcacccctagaaaagcctatccgctcggccgttggcgctcaccaaaaccacccagaagcctccgcttgaccgcttcactcgctttccgcccgccgcgccatgagcgccgccgcctgcctgttcgctgccgccgtctccctatcattcccgtcgacctccgcaccctcttccgaaagaagccgccgcctccggaaccccaccaaccctcttccggtgctccccaaatcncccccgtggggccggtccgggggaaacccgaaaaggggtggcttcaaggccggggccgggggaccccaaaaatttccaaaccgttgtttatttttaggaaggcggagggtttcgcccccccccatgtaattgggtaaacaagggaaaatgggggtacttttttataacttcctccccggcagaagggttttgtgtggaaaaaaggcggcgtgggcgtcggccggatttaataatattcaccccttcgggggggagcgcagaaaacccccctcagttcgtctctctgtttaggaacagatgacgaatttcttctcccctccataccgctctctatactagtttctgtgggtggtatttcaacatgccaaatcagtgtgagatacggggcgcgcgcgaaccagtgcgttcttcaggaacttcaacagaggcaccaccccctccatgtacccgcataccatgggtcgaaacccaatacagcagtgaatgataaacattgcgacggggtcgttcgatctcagatgttagattgtatgactatacgccccccacaagagcagaacgtagacttcggacatacatccatcatggctcgccgcgggaccgtcttcagctaccgccgcttccgaggtttaaaggtgactatcgcgatcaagatgggtggcgcgatatgtgcagacaatcacggccagaattgtcgaatacatagagttgagacataagaacacaatgactcagtagaatagagcacagttgtccggcagctgcgtgttgattcan

SEQ ID NO: 85762 - DNA, 1167 bp, Zea mays
  misc_feature: Ceres CLONE 1572161
  misc_feature: Encodes the peptide sequence at SEQ ID NO. 85763
  misc_feature (5)..(5): n is a, c, t, g, unknown, or other
  misc_feature (6)..(6): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (58)..(58): n is a, c, t, g, unknown, or other
  misc_feature (59)..(59): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
ttttnntttttnnnnttccccacccctaatagaattattcaaaaaccgtggcgtgctnntttnnnnnnnnnnnnnnnaaaactggagctccccgcggtggcggccgctctagaatagtggatcccccgggctgcaggaattcgtctcacccctagaaaaagacccaattatcacatgcgtgtgcggctgtgcgccgccgctacactcgccggcgacgagccttcgtgtcggctcagagaaacagacagacatgcagagtccagaaatccaacagagaaacagggctccgacccactcgcgcgctggctcgctggcaccgcgcgtccctcgccacctccgcaccgccgccgcgctcgccgccgcggtgcagggcctcatcgacgcgtcccctgcgcggggcgagtcgcagaccatccacgcgcagctcctagcgtcgggactcgtcggcagtgccgacctctctgtcaagctcctcgttctgcacatacggtgcggctccctgcacaatgcccgcgcccctgttcgacggaattgccgagcccggagccgcgccgccgcacaaactacccttcgtccccggggataatttcccggcggggggcccgccccccgccggaaggcccctgggggagatccgtggccgggcaggcttttgccggggccgtcctcaccgggggagacggtgcttgggagaccgtttcttttcccgcccgcctaggttccccaatgggggcgcgccttcgaaaagagcgtgtgtgtccttttggccggggggccgccttggggggcgtcttctttggggccgcccgggagcgctgctcgccgtttcgcggccccacggggggggagagggggcgccctcaatctgcccggcgcggcgccggaggtgtctgtgaaagaggtgtctccccgttcgcacagaaacaagaaagtgccctcgagaacaggaaaaatactcgcccgcggactctcgccgcgcgggcgacctccctgaggggtggggaaacaccccccccccatactgtgtgtagaatgaaaagccgcgcgggggctcctgctgtttggggcttataacaccctctcgctcgccagcgggtgggtgtcaacctgggggtcacgtcaacctattcccctcccatcggcgggcgaaacgaccgcttcccatgt

SEQ ID NO: 85763 - protein, 115 aa, Zea mays
  misc_feature: Ceres CLONE 1572161
MGARLRKERVCPFGRGAALGGVFFGAARERCSPFRGPTGGERGRPQSARRGAGGVCERGVSPFAQKQESALENRKNTRPRTLAARATSLRGGETPPPHTVCRMKSRAGAPAVWGL

SEQ ID NO: 85764 - DNA, 1191 bp, Zea mays
  misc_feature: Ceres CLONE 1572162
  misc_feature (1)..(1): n is a, c, t, g, unknown, or other
  misc_feature (13)..(13): n is a, c, t, g, unknown, or other
  misc_feature (63)..(63): n is a, c, t, g, unknown, or other
  misc_feature (65)..(65): n is a, c, t, g, unknown, or other
  misc_feature (66)..(66): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (1117)..(1117): n is a, c, t, g, unknown, or other
ntttttttttttnttttaatagtcatttatatcgtctcatgaaacacagtcacaaataaattntnnggctnannnnntaaaatggaactccccgcggtggcggccgctctagaactagtggatcccccgggctgcaggaattcgtctcacccctagaaaaaaatccaatccctacctgctcgggaaccacccgtcgggctcctcccgcccccctcgccgcatctgcatgcggcggggatctccgggctcgctccgtcaccggagccccaatcaccgccacctcatccaagcccccgaatcccccgggcgcgcagcacaaccttgccgcgatcgcgcgcggggaacggccgctgattgggtcgtgaaacctcgattttggggcaatttgattcggaaaaccccccgtcattccaattttgggcccccctttccaacccgggatgggggttcccccctttccaaaaaaggaccttgttgtccccaccaggtgtaaattacgggaaaactccaaaggggatttccacaccctcccgggggggaaagggggccccgggtcccccaagggggattttacaaaagggaagggggaaaaacccccccccctgaaagctttgccccctgtatatacgcccccccgggaatttttttttccaacacgggggcccaaaaggggggccttaaaaaccaaaatgtgtggggagagcctatagtgtggaaatatgcgccccccaaagagggcctctggggggtcacacaccccttttgggggagaaaacaacatttttttctgcccctatgttgtgtgtgcctataaaaaaaaaaagtaggtttttttttgtccgagaacaaaaggggtcccactattttatttacagatcttctctccccccttggggggggaggagaaatataccgccttgctttttctctccccacccaactacagtattatttagtaaagaatatatcctcccccccctcccaattagttttcgccaaaaaaaaaaaaaaaagaaggggcgctctccattacaaacaatattatttgttgtttctcccccccccccacaaaaggggggcggggcgcgccccctagatttttctctttattttccgngcggggggggcgggaagaaaaacaaaaaaaaaaaaatatgtcctctctgcccctttttttttattgtttagaag

SEQ ID NO: 85765 - DNA, 837 bp, Zea mays
  misc_feature: Ceres CLONE 1572163
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (49)..(49): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (279)..(279): n is a, c, t, g, unknown, or other
  misc_feature (577)..(577): n is a, c, t, g, unknown, or other
  misc_feature (679)..(679): n is a, c, t, g, unknown, or other
ttttaatgtnnnttatttatatataccagaagaggcgagaatgggtatnttttnnnnnaaaggggctcccgggtggcgcgctctgaatgtggatcccgggctgcaggattcgtctccccctagaaaaatcctcctcttcccattccactctctcactctctctaatcacaatttcgacactgatcggtactctctagtgtccgactcgtcacagttttagcgagagagacagagagcgagcgagggagaggaggatgggttccacttccacggggaccnggtgaagcgggttcgcgggcgcccggaagcgggacattcgacgaaatctgcccgcgggaacggacggccaaactaacacgggggcttcaactcccgccttctggggttccctcccaaagcgccgccggggcgcccttgggcccccattccccgggggcaagggggccccctcccgcgttcccgggggccaaccggggcccccccgcgggggggggcccttaaacacccccttgggggggggcctttgaaaaacccccccctttttttttccccccccccccttttttgggccccggancccccccagaacctttttttgggggaaaaatattttccgggggcccccccctttttttggggggggggggggggccccctttatatataattcccccccccngtgtgggggggggggggggcccccccccccgggggggggaaaaaaaaaaacccccccccccgccggggggggttttttcccccccccccttgtgttgtgtggaaaaaaaaaaaaaaaagaagacccccccccccccccctccaaaaaaaagggggggg

SEQ ID NO: 85766 - DNA, 822 bp, Zea mays
  misc_feature: Ceres CLONE 1572164
  misc_feature: Encodes the peptide sequence at SEQ ID NO. 85767
ctccccgcggtggcggccgctctagaactagtggatcccccgggctgcaggaattcgtctcacccctagaaaactactcgtccccttccgcagacgtggccgccgaattcccccagcccaattcccactctccgctcgacagatccatacatgatgggagaggccaaggagaacaacatttatgaggaggagctcctggactaccaggaggacgacgacgagactgtcgatggctccgctgctaagcccaccggagaggtcgcaaagaagggctacttcgggatccacagttcctgtttcagagacttcctgctaaagccagagctgctccgtgctatccaggattgtggttttgagcatccttccgaagtgcaacactagtgtatccctcaagacattcttggaatggatgtcatctgtcaagctaaatctgggatgatgaaaactgctgtttttgtcctttcgtccctgcacaaattgaccctgttgcggggtcaggtagcagcacttgtactgtgccacacaacgaagctggcctatcagatatgctacgaattttgagaggttcagcaaatatcttactgactttaaaggtgctaggctctatggaggtgttcacttcaggaagcataaagatttgttgaagactgatgcccctctaatgggggttggcccccctgggaaggaaacttgctcttgccagggaaaaagatcctctcctgaaaaatgggagggcccttcctttcttgaaaaaatgggacaaaatggccggaattcctttgcctcggcgaaaaagatttttagggaattcttccaaaatgt

SEQ ID NO: 85767 - protein, 75 aa, Zea mays
  misc_feature: Ceres CLONE 1572164
MGEAKENNIYEEELLDYQEDDDETVDGSAAKPTGEVAKKGYFGIHSSCFRDFLLKPELLRAIQDCGFEHPSEVQH

SEQ ID NO: 85768 - DNA, 818 bp, Zea mays
  misc_feature: Ceres CLONE 1572165
  misc_feature: Translation starting site: 153
  misc_feature (673)..(673): n is a, c, t, g, unknown, or other
  misc_feature (739)..(739): n is a, c, t, g, unknown, or other
ccccgcggtggcggccgctctagaactagtggatcccccgggctgcaggaattcgtctcacccctagaaaaactactcgtccccttccgcagccgtcgccgcccaattcccccagcccaattcccactctccgctcgacagatccatacatgatgggagaggccaaggagaacgacgtttatgaggaggagctcctggactacgaggaggacgacgacaagacggtcgatggctccgctgctaagcccaccggagaggtcgcaaagaagggctacgtcgggatccacagttccggtttcagagacttcctgctcaagccagagctgctccgtgctatccaggattgtggttttgagcatccttccgaagtgcaacacgagtgtatccctcaagccattcttggaatggatgtcatctgtcaagctaaatctgggatggggaaaactgctgtttttgtcctttcatccctccaacaaattgaccctgttgcggggtcaggtagcagcacttgtactgtgccacacaagggaactggcttatcagatatgccacgaatgtgagagggtcagcaaatatcttactgaagtctaagttgctgtcgtctagtgaggtgttcacatcaggaagcatacagatttgtagaagatgatgccctcatattgggggttgcacncctggtaggatacttgctcttgccagggataagatctctccttgaagaatgtgaggcacttcatcntgatgaatgggacaaatgctggaatcactgacatgcggaaagatgttcaggagatctcaaaatgactctcatgatagga

SEQ ID NO: 85769 - DNA, 796 bp, Zea mays
  misc_feature: Ceres CLONE 1572166
  misc_feature: Translation starting site: 161
  misc_feature: SWISSPROT Homolog: EC 4.1.1.31 Phosphoenolpyruvate carboxylase
  misc_feature (722)..(722): n is a, c, t, g, unknown, or other
  misc_feature (731)..(731): n is a, c, t, g, unknown, or other
tggagctccccgcggtggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggcccccgccgacgccatcctcgtggcgagctccatcctgcacatgctcaacctcgccaacctggccgaagaggtgcagatcgcgcaccgccgccgcaacagcaagctcaagaaaagtgggttcgccgacgaggggctcgcccaccaccgagtccgacatcgaggagacgctcaagcgcctcgtgtccgaggtcggcaagtcccccgaagaggtgttcgaggcgctcaagaacagaccgtcgacctcgtcttcaccgcgcatcccaggaagtccgccccgcgctcgctcctgnagaaaacgnccggaatccggaatgtctgacccagctgaatgccaagacatcactgacgacgaccagcaggagcc

SEQ ID NO: 85770 - DNA, 778 bp, Zea mays
  misc_feature: Ceres CLONE 1572167
  misc_feature: Encodes the peptide sequence at SEQ ID NO. 85771
aaagctggagctcaccgcggtggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggcccccgccgacgccatcctcgtggcgagctccatcctgcacatgctcaacctcgccaacctggccgaggaggtgcagatcgcgcaccgccgccgcaacagcaagctcaagaaaagtgggttcgcccgacgagggctccgcccaccaccgagtccggaaatccaagaaaaaccttcaaagcccccccctgggtcccaaagggtcgggaaaacccccccccaaaagaaagaggggtttttaagggggccccctaaaaaaaaaaaaaaaaagagggggggaaacctcttttttttttttttccgggggggggttctccccccaaaaaaattatcccccccccccc

SEQ ID NO: 85771 - protein, 204 aa, Zea mays
  misc_feature: Ceres CLONE 1572167
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNSKLKKSGFARRGLRPPPSPEIQEKPSKPPPGSQRVGKTPPQKKEGFLRGPPKKKKKKRGGNLFFFFFRGGVLPPKKLSPPP

SEQ ID NO: 85772 - DNA, 833 bp, Zea mays
  misc_feature: Ceres CLONE 1572168
  misc_feature: SWISSPROT Homolog: EC 4.1.1.39 Ribulose-bisphosphate carboxylase
caaagctggagctccccgcggtggcggccgctctagaactagtggatcccccgggctgcaggaattcgtctcacccctagaaaaagttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgccttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgaacacggcctacttcttcacattcaccgagcaatgcatgcagttattgatagacagaaaaatcatgtaatgcattttccgtgtataagctaaaacattgcgtatgttgggggggaaaatcaaatccacctccggtccagtagtaaggtaaggtttgaagggggaacgcaaaaataacttttggggtt

SEQ ID NO: 85773 - DNA, 813 bp, Zea mays
  misc_feature: Ceres CLONE 1572169
  misc_feature: Encodes the peptide sequence at SEQ ID NO. 85774
  misc_feature (671)..(671): n is a, c, t, g, unknown, or other
  misc_feature (675)..(675): n is a, c, t, g, unknown, or other
  misc_feature (798)..(798): n is a, c, t, g, unknown, or other
ctccccgcggtggcggccgctctagaactagtggatcccccgggctgcaggaattcgtctcacccctagaaaaaattctcactcctcccactggcggtcggttcccacgcccgcccaacgccttcgcggtcgtccttgccatggccgtgcaagggcggcacctgtcgcacgacctagcagcccaggcggccggcggctacctgttcctggacgagtacgccgggtgcgcgccggccccggccccggcccggatcggggacgccacgacggcgctcagcgacttcccgcgcgtcgaggttgcctggtgcaactacgacggcttcctgccgaggaagcggccgcgcctggagacggcggcgccagcagcgggcggtggtctcttggaagaccagcgcgcgggtttgcctccggcgggcacggagctcctgctgccactgccagtggcaccgttcgtcgacgcgcggagccgccgggcggttgcggcctccggcacggcgtccaccagtgggagggtggcaagtggcgcgaccgtggcggcctcgcggggactgctgtcgtcgtggacgcaccgccacggcgtggagatcgacgcgctcgttagacttgaggcagagaggatgcgcgcggcgctggaggaggcgcggcggcggcacgcccgcgcgctgctgcgncccnttggggcgcgccgcagtcggggcggctgcgcgcgtcggagactgacctcgagcgcgcgctccggcgcggcgcggagcctttgaagaagaaggcccggcaggccgggcgcctagtgccaaagcnttggatgggcgtccc

SEQ ID NO: 85774 - protein, 205 aa, Zea mays
  misc_feature: Ceres CLONE 1572169
  misc_feature (179)..(179): Xaa is any aa, unknown, or other
MAVQGRHLSHDLAAQAAGGYLFLDEYAGCAPAPAPARIGDATTALSDFPRVEVAWCNYDGFLPRKRPRLETAAPAAGGGLLEDQRAGLPPAGTELLLPLPVAPFVDARSRRAVAASGTASTSGRVASGATVAASRGLLSSWTHRHGVEIDALVRLEAERMRAALEEARRRHARALLRPXGARRSRGGCARRRLTSSARSGAARSL

SEQ ID NO: 85775 - DNA, 808 bp, Zea mays
  misc_feature: Ceres CLONE 1572170
  misc_feature: Encodes the peptide sequence at SEQ ID NO. 85776
  misc_feature (609)..(609): n is a, c, t, g, unknown, or other
ggagctccccgcggtggcggccgctctagaactagtggatcccccgggctgcaggaattcgtctcacccctagaaaaagtcctatccttatctatcgagtggacgcgacgccaacagcgtcagcgcctcctcccgctctccggctcctgtcctgctcgcgctcgtcgcccccctgccgctcggctccccttggcccctccaatgccgccacccatggcactgctgccgctctcctccgcatccgcgtccgccgcgctgccgcccttccgctcctgcccgcccgctgcgatgctgcttcgcctcccctcccccgccccctcccatttcgcccgcccccgcgcggtctccaccgggtacgcggcgtccttctacggcggctcggcgatgtccgcggccggcggcgcggacgaggaggaggaggaggtcggctacgagtcggggttcggcccggggctagggctgggcggcggcggcctcgggatgtcggccgcggaagccgcgctggcgctggaggagcgcgagatgccgccctgcccacccggcctccgccagtacgagaccatggtcgtgctccgccccgacatgtccgaagaggagcgcctcgccttncatcagcgctacgaggagctgctcgtcgccggcggcgccatgtacggtggaggtcttcaaccggcgtgtcatcccgctggcatacagcatcaggaaagagaacaagcggcacggggctgcccgtcaactactacgacgggaatctacctccctcatcacctacttcacccaagccgggagtccaagggacgccctgcat

SEQ ID NO: 85776 - protein, 202 aa, Zea mays
  misc_feature: Ceres CLONE 1572170
  misc_feature (136)..(136): Xaa is any aa, unknown, or other
MPPPMALLPLSSASASAALPPFRSCPPAAMLLRLPSPAPSHFARPRAVSTGYAASFYGGSAMSAAGGADEEEEEVGYESGFGPGLGLGGGGLGMSAAEAALALEEREMPPCPPGLRQYETMVVLRPDMSEEERLAXHQRYEELLVAGGAMYGGGLQPACHPAGIQHQEREQAARGCPSTTTTGIYLPHHLLHPSRESKGRPA

SEQ ID NO: 85777 - DNA, 836 bp, Zea mays
  misc_feature: Ceres CLONE 1572174
  misc_feature: Encodes the peptide sequence at SEQ ID NO. 85778
  misc_feature (600)..(600): n is a, c, t, g, unknown, or other
tggagctccccgcggtggcggccgctctagaactagtggatcccccgggctgcaggaattcgtctcacccctagaaaaagaagtttcggcagcggtgtaggcagcggcggcgtgctcgtgtaatcccatcccgaagtctccggtcacctgtcactctacgcaaccatgtcgaggaggaagaccagggagcctaaggaggagaatgtgacccttggccccactgtccgtgaaggagagtatgtctttggtgttgctcacatctttgcatccttcaatgacactttcattgagggaaacactggttcggatcactggtgcgatgaaggtcaaggctgatcgtgatgagtcgttaccttatgctgctatgcttgctgctcaagatgctgcacagcgttgcaaggagcttggtattactgcactgaacattaagcttcgtgccattggaggcaacaagatcaagacccctggacctggtgctcagtctgctctcagggctcttgctcgttctgggatgaaaattggacgcattgagaacgttacccctgttcccactgacagcatccgcagaaagggtggtaggaagggggaaggaggctgtangcgtatttgacatctcttggaggtggccatcaagcagctagtcctctctggatagtgtttgctgttctatgcttgtcaagaggagctttgattttgctatatgttgatgaccatttaccgtgggtgaggaaattgagtgtcatatttatcttctagatatgcattttcacttataaacgtgggttcccgttagcttaaatgcgctgttttggctaaactgccggctcaggactcga

SEQ ID NO: 85778 - protein, 123 aa, Zea mays
  misc_feature: Ceres CLONE 1572174
  misc_feature (15)..(115): Pfam Name: Ribosomal_S11 Pfam Description: Ribosomal protein S11
  misc_feature (121)..(121): Xaa is any aa, unknown, or other
MSLVLLTSLHPSMTLSLRETLVRITGAMKVKADRDESLPYAAMLAAQDAAQRCKELGITALNIKLRAIGGNKIKTPGPGAQSALRALARSGMKIGRIENVTPVPTDSIRRKGGRKGEGGCXRI

SEQ ID NO: 85779 - DNA, 779 bp, Zea mays
  misc_feature: Ceres CLONE 1572179
  misc_feature: Encodes the peptide sequence at SEQ ID NO. 85780
acccgcggtggcggccgctctagaactagtggatcccccgggctgcaggaattcgtctcacccctagaaaaagtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctcagccacgtgctggccaccaagctgggcgcgcgcctcaccgaggtgcgcaagaacggcacctgcgcctggctgaggcccgacggcaagacccaggtggacggtggagtacgtgaacgagggcggcgccatggtgcccgtccgcgtgcacaccgtgctcatctccacccagcacgacgagaccgtcaccaacga

SEQ ID NO: 85780 - protein, 206 aa, Zea mays
  misc_feature: Ceres CLONE 1572179
  misc_feature (4)..(103): Pfam Name: S-AdoMet_synt_N Pfam Description: S-adenosylmethionine synthetase, N-terminal domain
  misc_feature (118)..(202): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MAAESFLFTSESVNEGHPDKLCDQVSDAVLDACLAQDPDSKVACETCTKTNMVMVFGEITTKATVDYEKIVRDTCREIGFTSDDVGLDADRCKVLVNIEQQSPDIAQGVHGHFTKRPEEIGAGDQGHMFGYATDETPELMPLSHVLATKLGARLTEVRKNGTCAWLRPDGKTQVDGGVRERGRRHGARPRAHRAHLHPARRDRHQR

SEQ ID NO: 85781 - DNA, 911 bp, Zea mays
  misc_feature: Ceres CLONE 1572180
ccccgcggtggcggccgctctagaactagtggatcccccgggctgcaggaattcgtctcacccctagaaaaatacactacatgaaaggtcgctcttcagctgaaactgaagtctgaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgccgcggcccgtcgaggttaggccgcaggcgtggcagctcctctccatctttctctccacaaatcgcggggctgggggctgggccctcttccttgtcgggagcatgggggctttcctcgggggtcacaagccgcgcggcgcccattcgggaagcctcccccattcacggcccggccttctccccccctttcctccaaccgagggcaagctggggcccagacggccaattgccttacttccttccggccccgggggtttcatacaagaacggggcccttggcctgaaccgagatcgcccccccttaatttcctcacaaagggggcttcgggagacggcgccccccttagggcctcttttcctctacggggtcttaaacctcttcacactcaaggagcttggaattctcccccccgggagccaatttcccagataaacaacagagggt

SEQ ID NO: 85782 - DNA, 851 bp, Zea mays
  misc_feature: Ceres CLONE 1572182
  misc_feature: Encodes the peptide sequence at SEQ ID NO. 85783
ggagctccccgcggtggcggccgctctagaactagtggatcccccgggctgcaggaattcgtctcacccctagaaaaaaccaacccatccatcctccagtcctcagtccagactccagagtcctcaccggcttctccccgactccccgtcaccgatggagctgttcgcgcgcgcgaaggtggtgcggctcaggagccaccacgacaagttcctgtacgcggacgaggacgaggtgcgcgtgacgcaggaccgggacgggtcctcggcgaacgcgcggtggaccgtcgaggcggcgccgcacagcgcgggcgccgtccgcctgcgcagccgctacgggcgctacctcaccgcctccggggagccgttcctgctggggatgacggggcggaaggtgacgcagacggcgcccgccgcgccgcgcccggccaacgcgtccgtggactgggagcccctgcgggacggcttccaggcgcgcctccgcaccaaggcgggccacttcctccgcgccaacggggggctcccgccctggaggaactccgtcacccacgacgtgccccaccgcaccgccacgcaggactgggtgctctgggacgtcgaggtcgtgcagctcctcaagcccgcgccgccgcccgagggcaccgggctccgcgcccgtcgccaagttgccggaattcgccggcccgcgccgggaccttcggcaaggccacggcaaggcgcaaggggccggaacaaccggcccaatcaaagtccctaaggggaacgccaccggcccaaggctttgaaacccaaagggggccggccagcccggccggccggttccagggccttaaataaagcttccaaggttcctc

SEQ ID NO: 85783 - protein, 199 aa, Zea mays
  misc_feature: Ceres CLONE 1572182
  misc_feature (1)..(145): Pfam Name: DUF569 Pfam Description: Protein of unknown function (DUF569)
MELFARAKVVRLRSHHDKFLYADEDEVRVTQDRDGSSANARWTVEAAPHSAGAVRLRSRYGRYLTASGEPFLLGMTGRKVTQTAPAAPRPANASVDWEPLRDGFQARLRTKAGHFLRANGGLPPWRNSVTHDVPHRTATQDWVLWDVEVVQLLKPAPPPEGTGLRARRQVAGIRRPAPGPSARPRQGARGRNNRPNQSP

SEQ ID NO: 85784 - DNA, 883 bp, Zea mays
  misc_feature: Ceres CLONE 1572187
  misc_feature: Encodes the peptide sequence at SEQ ID NO. 85785
  misc_feature (883)..(883): n is a, c, t, g, unknown, or other
ctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcatgacggggagttctccgaggacctcaagctgttcgtcagtaacctgccgttcagcgtcgacagtgcacagctggccgggctcttcgagcaggcgggctccctcaagatggtcgaagttggatacgatagaatgactgggcggaaccttggatttggattccttgacaatgccttcacctgaaaaaagcaggggatgctgtccaagcaattaaccggttatacattttcagggaaaaacctctgaagggggaaacgcggggcccaccgccccctttgaagagggaatccccccccaaaaaaaccccaaggggttggtggactttgggcaggcgcccgaccaccactttttgcccaattcaggggaacaaaggtatacgctgggggaaccctctggtaggggacgtttgaaacaactctaactcttgggaaaacctcttttcaggggaacaagggcaaaggagccttgatatctaacgggccttcttgcaaaagggaataggccggcaggggccaagggggggtttggttataacccccccn

SEQ ID NO: 85785 - protein, 128 aa, Zea mays
  misc_feature: Ceres CLONE 1572187
MAAALFSTSLSPRFLALSSPKPAAPAASAFLPFTLPLRSVSAPAPARRVFEPVAVAVSSEYGTEGAEQHDGEFSEDLKLFVSNLPFSVDSAQLAGLFEQAGSLKMVEVGYDRMTGRNLGFGFLDNAFT

SEQ ID NO: 85786 - DNA, 809 bp, Zea mays
  misc_feature: Ceres CLONE 1572188
  misc_feature: Encodes the peptide sequence at SEQ ID NO. 85787
  misc_feature (723)..(723): n is a, c, t, g, unknown, or other
ctccccgcggtggcggccgctctagaactagtggatcccccgggctgcaggaattcgtctcacccctagaaaaaacagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgagggctaccgtattgccggcgggccgctcggcgaggtcgtcgacccgctgtaccctggcggcagctttcgacccctcgggctggncgacgacctcgaagccttcgccgagctcaaggtgaaagagctcaggacgggcgcctcgccatgttttccatggttcggctttctcc

SEQ ID NO: 85787 - protein, 220 aa, Zea mays
  misc_feature: Ceres CLONE 1572188
  misc_feature (56)..(211): Pfam Name: Chloroa_b-bind Pfam Description: Chlorophyll A-B binding protein
  misc_feature (192)..(192): Xaa is any aa, unknown, or other
MAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFRPLGLXDDLEAFAELKVKELRTGASPCFPWFGFL

SEQ ID NO: 85788 - DNA, 877 bp, Zea mays
  misc_feature: Ceres CLONE 1572189
  misc_feature: Encodes the peptide sequence at SEQ ID NO. 85789
ctggagctcaccgcggtggcggccgctctagaactagtggatcccccgggctgcaggaattcgtctcacccctagaaaaaaacacctccgttagcacgagctgcagggagggagttgggaggagaaacagagctaccggggcgatgggcaccgtgctcgattcgcacttcctggcgctcaccgccatcgttactgtggggtaccagctgctgtacttcatcatcacagctctcctccggttcgataaggtcaccggtttcgcaggcagtacaaattttatcataatcgccatcctaacattagctttgaagggagcatggcatttccgtcagattgtgctgacagagcttgtcaccatttggggtcttcatctaggattatttttattgatgaggattttgcaatgcggtgaagaccgaaggtttgacaaaatgcctgataatttgaggaaattggcagttttttggattttccaggcagtgtgggtttggtctggcagcttgctcgtcaatgttgtgaatgctagtgacagaaacccctcgattgaagccagggatataatccgctggataatatggttggtcggggatatgtgtaaaagcaactcctgatccggacaaaccttgtgtttaaaaaaattctccacgtaacaggtgaaaagtggttgccacgccggtctttttgaaagtactctcccacccccaaactaccttgggggaaatattccttttgggggggaagtgttttataacccccgaccccattttttcttactaatgcgagaaagggtttgtaaattacttggcacctttaatccccgggaactcctcggggccggctttttccgcgtgcggggaaacccccctcccttgggaag

SEQ ID NO: 85789 - protein, 155 aa, Zea mays
  misc_feature: Ceres CLONE 1572189
  misc_feature (24)..(156): Pfam Name: DUF1295 Pfam Description: Protein of unknown function (DUF1295)
MGTVLDSHFLALTAIVTVGYQLLYFIITALLRFDKVTGFAGSTNFIIIAILTLALKGAWHFRQIVLTELVTIWGLHLGLFLLMRILQCGEDRRFDKMPDNLRKLAVFWIFQAVWVWSGSLLVNVVNASDRNPSIEARDIIRWIIWLVGDMCKSNS

SEQ ID NO: 85790 - DNA, 763 bp, Zea mays
  misc_feature: Ceres CLONE 1572194
  misc_feature: Encodes the peptide sequence at SEQ ID NO. 85791
  misc_feature (737)..(737): n is a, c, t, g, unknown, or other
tccccgcggtggcggccgctctagaactagtggatcccccgggctgcaggaattcgtctcacccctagaaaaaacggccattgacgctgaaacgctactgctgcttgcatggtgtgatcgtaggtgagttgacttggagtcgtccggccggttcccttgtctctccggttcacgacgccggctggctccgtccgatcgatcatacgcaatggcgaacgcggcgtcaggcgtggcggtggcggatgagtgcgtggcagcggattccaggagactgcgcggcggccgcgcgcaccgcttcctggtgttcaaggtctacgacacgctgcaccgcgtggtggtggagaacgcgggcggccgggccgccggcttcggcgacctcgccgcctgactcctcgccaacgactgccgctactgcgtctacgaccacgacttcacagtgcgcgtcagggactcagctgcgtccgcgacggcagctcaaggcgcccacggagcacgaatcgtctttcgtggcctgggccaccggaggcgagttgccgtaccggagcaaaaaccgggaaaatccccccccctgtggaggggtcccccatgtaacttaaagggcggcaagtggacactcatgcccaaacaatcccgggaaatggaatttttagttttttacaaaaacaaaccccctttaaaatgtccaaaaaaaaaaaaaaagccccctggttttccttaataccaaccaccgggttcgnccctattttgttgaaacttcccgggt

SEQ ID NO: 85791 - protein, 59 aa, Zea mays
  misc_feature: Ceres CLONE 1572194
MANAASGVAVADECVAADSRRLRGGRAHRFLVFKVYDTLHRVVVENAGGRAAGFGDLAA

SEQ ID NO: 85792 - DNA, 849 bp, Zea mays
  misc_feature: Ceres CLONE 1572196
  misc_feature: Encodes the peptide sequence at SEQ ID NO. 85793
tctccgcggtggcggccgctctagaactagtggatcccccgggctgcaggaattcgtctcacccctagaaaaataggttgctaggctcggccgtgtagagcagcaagagcacgccgcgccaagcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgtcgaaaatcgaggacgacggcaacccgcgattcgtcatcttcatccgcaccgccaatgtctacttctggtacccgctcaacatcatcacgggcggtacgacggcgaagatcatgctcgccgccaaggacaacttcctcggcaagtacatctacaaggacacgctcgccaggaacctcgccgccgtcatttacaaagacgaggacgtgatcatagacacagcgaaagagcagtaccgtgtgctcaagaccgaaaatcagtttcggtatggctacaaaagttgtggaagaaaaggaacataaaggtctgcctctgacaacaagccaatgtgattcaaacttccaaaaaaaggacgaagctccaaaaccggtggtttgacaagggtgaaaggaccttcttttggccaactttgactgcccggccccccaaaagaataccttttggggcacaattaaaaggggggcttgctcgttcaaacacaaggaaaggaagaaa

SEQ ID NO: 85793 - protein, 169 aa, Zea mays
  misc_feature: Ceres CLONE 1572196
MEVVGGVSLRPSPAPARIRTTLPPVDVGGRFLLRRVAGRQPARRALVVEARGGRGWSERQMQQQRRAPLLSKIEDDGNPRFVIFIRTANVYFWYPLNIITGGTTAKIMLAAKDNFLGKYIYKDTLARNLAAVIYKDEDVIIDTAKEQYRVLKTENQFRYGYKSCGRKGT

SEQ ID NO: 85794 - DNA, 893 bp, Zea mays
  misc_feature: Ceres CLONE 1572198
  misc_feature: Encodes the peptide sequence at SEQ ID NO. 85795
  misc_feature (540)..(540): n is a, c, t, g, unknown, or other
ctccccgcggtggcggccgctctagaactagtggatcccccgggctgcaggaattcgtctcacccctagaaaaaagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaggcgtggtggcaggaagaggcctgtgcctaaaggtattgtctatggcaagccaaagcaccagggtatcacccagctcaagttccagaggaacaagaggtctgttgctgaggagagggctggacgaaagcttggtggactcagggttctcaactcctactgggtgaatgaggatagcacctacnagtactttgagatcattcttgttgatgtgggccacactaccatccgcaatgatccaaggaatcaactggctatgcaatcctgtgcccaacccccgggagctccgggggtctcaccctccgcaggcaaaaaaattccgttggccctgcgggggaaaggggccacacttcaccaccaagaataaggcccgttcaaggagggggcacccttgggaaaccgccaacccagaacccctttcccttccgcgccgcttacccgggtgaagacacaaaacccccccttggaaggttttcgggccaaactggggaggaacacctggccctctaaggtgccaggcctctcggaaaataaaaat

SEQ ID NO: 85795 - protein, 187 aa, Zea mays
  misc_feature: Ceres CLONE 1572198
  misc_feature (2)..(188): Pfam Name: Ribosomal_L15e Pfam Description: Ribosomal L15
  misc_feature (128)..(128): Xaa is any aa, unknown, or other
MGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYXYFEIILVDVGHTTIRNDPRNQLAMQSCAQPPGAPGVSPSAGKKIPLALRGKGATLHHQE

SEQ ID NO: 85796 - DNA, 1216 bp, Zea mays
  misc_feature: Ceres CLONE 1572199
  misc_feature: Encodes the peptide sequence at SEQ ID NO. 85797
  misc_feature (20)..(20): n is a, c, t, g, unknown, or other
  misc_feature (63)..(63): n is a, c, t, g, unknown, or other
ggtgaggcgtgaaaataaancgaagggcataacaaacgggctttgcgcggaaaccacactccngccggctttttttaatactggagctcacctcggtggcggccgctctagaactagtggatcccccgggctgcaggaattcgtctcacccctagaaaaaagactccagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaagcgtggtggcaggaagaggcctgtgcctaaaggtattgtctatggcaagccaaagcaccaaggtatcgccccagctcaagttccaggaggaacaagaaggtctgtttgctgcagaataggggctggaaccaaaagctttgggtggacctccaggggttcctcaaacttcccctacttggggtggaaatgaagggactaaggcacccttacaaagggtacctctttggaagaataaaattcccatttggattgggaatggaggggccccccaccaaatttactccagattcgccggccaagaagtggagagttccccaacagggggaaatcataagaacacttggggggccgcttaaattggtggcaaatacctccccgctgtgcgtggtgcaccccccgataatccccacccccgcgggggggaaagagcccctcccccgagggggggagataccactacaacactatatccggctctagggggagaaaaaaataaagttttttcctcgcgggggggcccctgtggcctttggggtcaaaagagggggcactaaaccaccttcattccccagtagaggaaaaataacgggccccaccgtctccaagggaaggggggcccaccccctggggaaaaggcgacaaacccccagaaccccatttattcccctctccggtccgaatatgctggtgttgaaaaccacaaatcgatatctggaagattttgttggcacaatatcggggaacaccttgccccctatggcaaggcccctag

SEQ ID NO: 85797 - protein, 129 aa, Zea mays
  misc_feature: Ceres CLONE 1572199
  misc_feature (2)..(124): Pfam Name: Ribosomal_L15e Pfam Description: Ribosomal L15
MGAYKYVSELWRRKQSDVMRFVQRVRCWEYRQQPAIVRLTRPTRPDKARRLGYKAKQGYVVYRVRVKRGGRKRPVPKGIVYGKPKHQGIAPAQVPGGTRRSVCCRIGAGTKSFGWTSRGSSNFPYLGWK

SEQ ID NO: 85798 - DNA, 878 bp, Zea mays
  misc_feature: Ceres CLONE 1572201
  misc_feature: Translation starting site: 296
  misc_feature: SWISSPROT Homolog: EC 2.4.1.207 Xyloglucan:xyloglucosyl transferase
ctccccgcggtggcggccgctctagaactagtggatcccccgggctgcaggaattcgtctcacccctagaaaaaaaaacaagctcgaccaccaacccagctcgctcgtcccagctgatcaggtcgagcacctagtagcgacctgctcgatcatcagtgtagagtgtcggtaggtgtctgtctctcttggtggctggttgcaacggtcatggcgacctcttctcgtcgggtgcccttgctgctgctgtgcctgggcgtgctggtgtcctgatcctacgcggcgggcagcttggaccatgagctggacatcacgatggggcgacgggcggggcaaggtccttgacaacgggcggctgctgacactgtcgctggaccgcacgtccggctccgggttccagtcccagcacgagtacctgttcggcaagatcgacatgcagctgcggctggtgccgggcaactccgccggcaccgtcaccgcctactacctgtcgtcgcagggcggcgcgcacgacgagatcgacttcgagttcctgggcaacgtgtccggcgagcccctacacgctgcacaccaacgtgtttcctccgtgggcaggggcatcgggagcagcatttccgcctctggttcgacccccacggcgaatttcagaacctaacttcccatcctctggaaacccaagcaacttcatcttcattggtggaacgaaattgcccattaagggaactttccccacccctgtagaaacaaggggggtgggcgttttccccaaagaggccaggccgaaggcggggttctatttcccagccttgtgggaacaccgggaacaacttgggccaaacccaaaggtgtggggcaccggtcaaagaaaggaaacttggccc

SEQ ID NO: 85799 - DNA, 801 bp, Zea mays
  misc_feature: Ceres CLONE 1572202
  misc_feature: Translation starting site: 127
tggcggccgctctagaactagtggatcccccgggctgcaggaattcgtctcacccctagaaaaaacgcacctccgccagccagctccaaacacttgcgccgccgctgcctcacaggtaaggccgccatgatctccggttcgggcgtgtgcgcaaagcgcatccgagagtaccctctccacctcatgctgggccatctctcctccatcatagaccaggacctgctcaatgcgcacaacgtggccgacgtccgcttcgaggagatactgcatgtccggcgggctctgccataccaacatgaagtaccctcctcttcctcctcgagcggataaatcaccaacccgtcccacgggccaatccaattccatcgcccccccacagatgctgtgacacaccatccacctgataatacctcagactaccacacagaggggaggcagctcttgctaaactcaaaacatacgacggcctacctccgccatacgacgagaccaaacttatggacatccctgaagcacattaggttcgtgcgactacagcctgaacaccaggtactgccttctccgaaaaacctctctaaatgaagtcgggttggaacttcccttggcccccctcagggggaactttggggcccaaaccggagaagggaaaaaaggcccccgggttcccccccccccccgggggggaaaaaaaaacctttttggggggaaaaaaacccccttttttttttttgggggggaaaaaaaaaaaaccccccccccccagagaataaaaaaagagggggggggcgccccccccccccc

SEQ ID NO: 85800 - DNA, 765 bp, Zea mays
  misc_feature: Ceres CLONE 1572203
  misc_feature: Encodes the peptide sequence at SEQ ID NO. 85801
  misc_feature (757)..(757): n is a, c, t, g, unknown, or other
ctccccgcggtggcggccgctctagaactagtggatcccccgggctgcaggaattcgtctcacccctagaaaaaatttcctcgcagtcgcatcgcatccgccctccttgcttcacacgcgcgacgcgatttttctattctttttttgggtggtagttggccaggtcggcgtagggatggagacggcggccgcggcgatgctggaggccggggtggggcggttctcgcgggcgccggcgatggccgcggcgctgctggcggagatgtgggcgccgctggccgtggcgctagcggcgctggccacgctgcccagcctgctgcgccgcctgcaggtcatcgtcctgcgcctccgctcccgcgggaaggaggccatccagttgcacatggggacctactactcgtcctgcgacgacgacgacgacgacgaggacggcgacgaagacgagagctccgacgacgaggtcgacgccagctcctcgggcgacgacggcgaggatctgaagcgaatcgggttctacgagggggccgcggacggcgtcttcccctggggcggcgccgtagtccggacctggcatggcctcccgcgccgcttcacggcctgcgcgtcgggcgtgggagctgtcagcagcgccagcagaggagcgttccctgccgctgtcaggctgtggtgcgccagcaccgtcagcagccagacgatggtgccctgcagcgctgatgaaagcggctgccgctactgcgcggtctcagaagtggaccangtcgtctt

SEQ ID NO: 85801 - protein, 196 aa, Zea mays
  misc_feature: Ceres CLONE 1572203
  misc_feature (194)..(194): Xaa is any aa, unknown, or other
METAAAAMLEAGVGRFSRAPAMAAALLAEMWAPLAVALAALATLPSLLRRLQVIVLRLRSRGKEAIQLHMGTYYSSCDDDDDDEDGDEDESSDDEVDASSSGDDGEDLKRIGFYEGAADGVFPWGGAVVRTWHGLPRRFTACASGVGAVSSASRGAFPAAVRLWCASTVSSQTMVPCSADESGCRYCAVSEVDXVV

SEQ ID NO: 85802 - DNA, 891 bp, Zea mays
  misc_feature: Ceres CLONE 1572204
  misc_feature: Encodes the peptide sequence at SEQ ID NO. 85803
ccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaagccgggctccagatcttcagcgagggcggggctggactaccttcggaaacccaacctcatccacgcgcaaagcatcccttgctatctgggcctgcccaggtcgtgcttcatggggcgccgtcgaggggctaccggcatccgccgggggggccgcctctggggaaggttcgtcgaaccccgcttctaccccggggggggaagctttcaaacccgcgttcgggccttcgcccaagaaaactcccaaagggccttttcgccccgaaactttagggggccaaaggagagcctcaaaaaacagggcccgccctttcgccccatgtttttctcccaagtgttccggggaattttttc

SEQ ID NO: 85803 - protein, 222 aa, Zea mays
  misc_feature: Ceres CLONE 1572204
  misc_feature (65)..(189): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGLQIFSEGGAGLPSETQPHPRAKHPLLSGPAQVVLHGAPSRGYRHPPGGPPLGKVRRTPLLPRGGKLSNPRSGLRPRKLPKGLFAPKL

SEQ ID NO: 85804 - DNA, 842 bp, Zea mays
  misc_feature: Ceres CLONE 1572205
  misc_feature: Encodes the peptide sequence at SEQ ID NO. 85805
ggagctccccgcggtggcggccgctctagaactagtggatcccccgggctgcaggaattcgtctcacccctagaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagccccccggcagcgactagaacgcgcccggcggcccgcccccggcgggctagctagctagctagctcctgcgtgagctaatagctagtgccatggcgtcgtcctccggcgttcggttttgcttcgggtccaccggggtaccctttgcctggcctgggtttcttcctttcccttttttccctttttttttcctcctttttcccccgggcaat

SEQ ID NO: 85805 - protein, 170 aa, Zea mays; identical to SEQ ID NO: 73892
  misc_feature: Ceres CLONE 1572205
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 85806 - DNA, 802 bp, Zea mays
  misc_feature: Ceres CLONE 1572206
  misc_feature: Encodes the peptide sequence at SEQ ID NO. 85807
ccccgcggtggcggccgctctagaactagtggatcccccgggctgcaggaattcgtctcacccctagaaaaaaaaccctagatctcgtcttgtcgccccgttcctccgatcccatcctatccgatcctcatggattcctcctcgtccagcctcagccagcagcccgagttcgactacctcttcaagctactccttatcggcgactccggcgtcggcaagagcagcctcctcctccgcttcaccgccgactccttcgatgacctctcccctaccataggtgatctctttgacttcgattatattccccgatctgaccgcttcaccgccgactccttcgatgacctctcccctaccataggtgttgacttcaaggtgaagatggttagcattggtggcaaaaaactcaagcttgccatctgggacacagctgggacaagagaggtttaggaacttgaccagctcttactacagaggggcacagggggatcattatgggggaatgaaggtcaggccaacaaaaaaacgttcaaccaatcttttctgaaaatatgggcccagggaaaatggccctggttttccaacccacccgggaactgggtaaaaaaaatgctttgttttgggaaaataaaaggttaaaccccgggaaaaagttgaaaaaggggcttttccccccaaaaaaaaggggggggggaattttgaattttttcccccggggggaaaaacgggggtggttttgtttttcttttgaaaaaagggcggggggggggaaaaaaacaaaaagtgtataacgtggttgaaaaac

SEQ ID NO: 85807 - protein, 105 aa, Zea mays
  misc_feature: Ceres CLONE 1572206
  misc_feature (19)..(106): Pfam Name: Ras Pfam Description: Ras family
MDSSSSSLSQQPEFDYLFKLLLIGDSGVGKSSLLLRFTADSFDDLSPTIGDLFDFDYIPRSDRFTADSFDDLSPTIGVDFKVKMVSIGGKKLKLAIWDTAGTREV

SEQ ID NO: 85808 - DNA, 843 bp, Zea mays
  misc_feature: Ceres CLONE 1572207
ggagctccccgcggtggcggccgctctagaactagtggatcccccgggctgcaggaattcgtctcacccctagaaaaaaatgaacctccagctttctctctctccttccctcctctccagttccacagaaggctccgtgcctagatcccgtggagaatgtgttggggatcaaggagtggttgattggatccatcccctcacgtgcttccctcatcaagtttcaaatccccatctgcgcgaggaactcctctctcaaggtatctttcctcgatctacctttctagcgagtttgggttaatccctttggagtaataacgaaagttcatctgccttatctctaatggaccattatttggtttgaattgataatttgggggagggaaatcgctcgtaactgtgcaaacacttgttgctcgacccccctcaatcaatcgaacccgtggaggttcgctggccccccctctccttaaagaaagggtgcccccgaagggaaaccccattccctttatttaaaagaaaggggttagtgggaatttctgaaaaaaaaaccccccggggggtgggagaagtttcttttggccccctttcccaaaaatcggggttctttggttttaaaaaggccccacccccccggggggaaaaaatttttgtggggggggagatagatttttttcaaaaccacccctggaaaaaactttccaaagggcgccccttccaaaaaaaaaaaaaggtgggtcctttaagaacccccctcccccaaaaaaaattttttttttaaagggggttttataaaaaaattgtgcccaatttttgcccccatagaaaaccctcgggaaaaaaaaa

SEQ ID NO: 85809 - DNA, 775 bp, Zea mays
  misc_feature: Ceres CLONE 1572209
  misc_feature: Encodes the peptide sequence at SEQ ID NO. 85810
ctccccgcggtggcggccgctctagaactagtggatcccccgggctgcaggaattcgtctcacccctagaaaaaatcccatcccctcaggcctcagtcgtcagtccctcacacactcactatacactgctctgctgcagcaagaaagaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaagacccctccgtgagcgtcgccatcgtggagcagtccgtgtccccgggcggcggcgcgtggctgggctggcagctgttctcggccatggaggagcgcaggccggcgcatctgttcctggacgagctgggcgtgagctacgacgaggtcgaggactacatggtggtcaagcacgcggcgcttgtcacgtccaacgtgatgagccggcgtctggggcggcccaacgtgaagctggtccacggcgtggcgggtggaggacctgaacgtgcgg

SEQ ID NO: 85810 - protein, 197 aa, Zea mays
  misc_feature: Ceres CLONE 1572209
  misc_feature (62)..(197): Pfam Name: Thi4 Pfam Description: Thi4 family
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPSVSVAIVEQSVSPGGGAWLGWQLFSAMEERRPAHLFLDELGVSYDEVEDYMVVKHAALVTSNVMSRRLGRPNVKLVHGVAGGGPERA

SEQ ID NO: 85811 - DNA, 832 bp, Zea mays
  misc_feature: Ceres CLONE 1572211
tggactccccgcggtggcggccgctctagaactagtggatcccccgggctgcaggaattcgtctcacccctagaaaaagcccactccaacacgtgacaccccgcggagcgcctccgccgcacgcccccactctctcaccgccaccgccgagatggccgcctgctcccacctcgacgcccgagtggctcttccctgccccgccgcatggttcattacccggcgcattcgtagtcgcgtcgcttcgcgccctcaggtcgagctgcgttctcgagagcagcctgtcggtagggagcaggcgactttcaggggtctccgcgagagaccgtcacgcggctccgtggcgaactggaggccggccagctccgggaagaagcccaccttgaaatttaaaaataggaaaggttaaccaaaaaacattttgccgttttttgggggaactttggattgaacttccgaaaaaaaccggccatgggtaaaaaggcccctttgaaaaggggtgaaagccccaaaaaacctcccggggggaaatttttttttttctcccgggggggccgggggaaacccccaaaatttttggggggaaaattttttgtggggctcgtcccttttaaaaagaggggaaaaaaaccccccccaattttttgggaggattttaaaaggggagccccccccctcccctttggggggggggattttttttaaaaaaaaaaaaaaatggggggcgctcttttttagagaggaaaataatggggaaaaaaaatctcctccccgtgtttttcccccccccgagataattttggagaggtgctcttttttgggggggtcccccacg

SEQ ID NO: 85812 - DNA, 1065 bp, Zea mays
  misc_feature: Ceres CLONE 1572213
  misc_feature (1)..(1): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (727)..(727): n is a, c, t, g, unknown, or other
ngtttttaggtttaaccatgcgccgcaggaatgggatggacagtattccttattcctttattttannnnnnnnnnnnnaaggtggggctccccgcggtggcggccgctctagaatagtggatcccccgggctgcaggaattcgtctcacccctagaaaaagcccactcccagaggctcttctcctcctcgcctcctctccctagcctccacgacgcaagggagagtgacggaaagcgacgcggcgcgagcgaggagggccaaggggaagaggggaagcaccgcaccaggacccttgttcgccgccgtcgcctctgatctccgcgaggttgtcaggattcaatatgtcgaccagcacattcgctacttcctgcacgctgttgggcaatgttagaacaacgcaagcctcccagacaggggggaagagcccttcgtctcctaaccttcttcagccaaggttaccaaaggttcccaaggccttgaaaaaacctcccaaaaaaaaactggggaatgtccccctgcgcctggggctggtctcccaaggggggaaaaccttgtccgggggccttgaaagggtgaaaaaaacccccaaatttttttaaagggcccccccaaaaaaaaaaaaccccttaaaattttccttttttaaacccacccccccccaaaaaaaaatttcccccccgggtggggtgggggaaaaattttctccccccataataattctctctnttttcacccccctgtttctcgtggggggggggttttttttttccctccccccccccttgtgggtgggcgggggggggaaaaaatatatatcctacttctttggggggggttcccgccggtttatacacacaacaacccccgagaggaggaggcgccccccctccccctctcctttataaagaccggggccaccccctggagggggaggaagggtgtgtttttgttgggtgtaaaaaaaaaggcgcctcccccccccccccccccataagagtgtcagaataagggggtttttctctcccccccccccccccccaggggagggagccacccttcttttc

SEQ ID NO: 85813 - DNA, 834 bp, Zea mays
  misc_feature: Ceres CLONE 1572215
  misc_feature: Encodes the peptide sequence at SEQ ID NO. 85814
aagctggagctccccgcggtggcggccgctctagaactagtggatcccccgggctgcaggaattcgtctcacccctagaaaaaatctcccgcaacgcaagcgcaacagaagcatactacgccgctacgcgctgggcggtgccgcacaggcacagctatagatagctagcagtgttgcatagaaatggacagcgccagcagcctcgtggacgacaccagcggcggcggcggcgcgtgcacggacaagctaagggctttggccgccgccgccgcctccgcctcggggccaccgccggagcgcatgggcagcggggccagcgcggtcgtggacgcggccgagccgggcgccgaggcggactccggctccgccccggcctccgtcgccgccgtcgcggcgggcgtgggcgggaaactgccgtcgtccaggtacaagggcgtggtgccgcagcccaacgggcggtggggcgcgcagatcctacaagcgcccacctggcccgtgtgggtttggaacctttcgcgggcgaagcccaaacccggggccgcgccctacaaaggtccgcggcgcaaaccggtttccccgggccgggaaaaccggccccccaaaatttccccccccgcttcggggaaaacccgggccccgggaaccccccccaccccaaacctcccgggttcccggggcggtccccccccccaaaggggccaaaaggttctttctaacaaatgctcccggcaaaaaaatcccgatatcatttttaaaaaaaaacctgcgcgccataaaaaaaaagagaggggacgcttttttgcacaccgcgccacgtgagatgagacttgatgg

SEQ ID NO: 85814 - protein, 211 aa, Zea mays
  misc_feature: Ceres CLONE 1572215
MDSASSLVDDTSGGGGACTDKLRALAAAAASASGPPPERMGSGASAVVDAAEPGAEADSGSAPASVAAVAAGVGGKLPSSRYKGVVPQPNGRWGAQILQAPTWPVWVWNLSRAKPKPGAAPYKGPRRKPVSPGRENRPPKISPPASGKTRAPGTPPTPNLPGSRGGPPPQRGQKVLSNKCSRQKNPDIIFKKKPARHKKKERGRFFAHRAT

SEQ ID NO: 85815 - DNA, 875 bp, Zea mays
  misc_feature: Ceres CLONE 1572216
  misc_feature: Encodes the peptide sequence at SEQ ID NO. 85816
  misc_feature (875)..(875): n is a, c, t, g, unknown, or other
ggagctccccgcggtggcggccgctctagaactagtggatcccccgggctgcaggaattcgtctcacccctagaaaaaactcctctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgtctggctgtgcggtccgctgtccggcctcctcgtccagcccctcgtcggccacctctccgaccgcatcggccccgccgcttcgccgctcgggcgccgcaggcccttcatcgccgccggcgccgcgtgcatcgccgcagccgtgctcaccgtcggcttctccgctgacctcggccgactcttcggcgaggacgtcaccccgggctcaaagcgccctcggcgccatccggggtctacctggaagggattctggcttgccccacgtgggcaactaacgggactgcagggggcccggcaggggggtttcctcgcctaaccctcccagagaaaggacccaagggaggaacccggaatcggctaatggcatactttttcacattgttatgggcccctggggaaaccttactttggcatttgccgcccggaaacttaatagggggacgggtatttcgcatattttcctttttctacggttaacagaacttcctggaggcaatcccgtctggtgagcaatcctttaaggtcn

SEQ ID NO: 85816 - protein, 163 aa, Zea mays
  misc_feature: Ceres CLONE 1572216
MPPRTAPAATSTPPRKVPLRKLLRAASVACGVQFGWALQLSLLTPYVQELGIPHAFASLVWLCGPLSGLLVQPLVGHLSDRIGPAASPLGRRRPFIAAGAACIAAAVLTVGFSADLGRLFGEDVTPGSKRPRRHPGSTWKGFWLAPRGQLTGLQGARQGGFLA

SEQ ID NO: 85817 - DNA, 826 bp, Zea mays
  misc_feature: Ceres CLONE 1572225
  misc_feature: Translation starting site: 190
  misc_feature (342)..(342): n is a, c, t, g, unknown, or other
  misc_feature (343)..(343): n is a, c, t, g, unknown, or other
  misc_feature (647)..(647): n is a, c, t, g, unknown, or other
  misc_feature (748)..(748): n is a, c, t, g, unknown, or other
  misc_feature (787)..(787): n is a, c, t, g, unknown, or other
ccgcggtggcggccgctctagaactagtggatcccccgggctgcaggaattcgtctcacccctagaaaaagcgctcgcgtctctcgtccccctcagatcgaccgactcgctctgagtctctgaccgccccttccgtcgtccccgttcgaaggcgcggcaagcgagcgattcagccagactcgattctacatgaatcccgagtaccactaccttttcaaacttctgcttattggtgattctggtgttgggaaatcatgctctgcttctcagatttgcggatgattcgtatttggacagctacatcagcacaattggggttgatttgaaaattcggacagtagnncaagatgggaagaccataaaacttcaaatttgggatactgctgggcaagaacgcttcaagaccatcactagcaactactaccgtggagctcatggaatcattattgtatatgacgtgacagaccaagaaagcttcaataatgtgaagcaatggttaaatgaaattgatcgctatgcaagtgacaatgttaacaagctccttgttgggaacaagagcgacctaactgccaacaaagttgtggcaactgagacagcaaaggcatttgctgatgagatgggcatcccgttcatggagacgagtgccnaatacgccaccaacgtggagcacgccttcatggctatggctgcgtccatcaaggacatgatggccagccaaccagccgcggccagcgcaacgccagcgacngtgcagatccgcgggcaacccgtctaccagaagacgtcntagctgctcagtcttaagctgcctgatctatctggatcc

SEQ ID NO: 85818 - DNA, 774 bp, Zea mays
  misc_feature: Ceres CLONE 1572226
gcggtggcggccgctctagaactagtggatcccccgggctgcaggaattcgtctcacccctagaaaaacttgcctcttggcccgatcatttcatttccccacctctctaaaaccctcgctcttgcccgctgttttacacctaaaagaaaggtcctcgccgtcgagccgccggctcccatctcccgcgccgtcgccgacgaggacacaccagacgcctcgctgatggccttggctcgcctcggacggtctcttgccggccgcctccaccgttctatctaccgtccaccggcgcccacagactaccatgcctccgtttcccgacccttcgctccgacccacacaggcgtatgcgtacgaggttttgcaagcttgacgtacaatgccagcagcatgattggccacaatctcgaggggccgttgccagtccacattgtgaaggttctggatctcgtagtacatatgaatcatgctagaccgatgtcaacagcagcagcatcaaaggtgcctgttgggagccccggaaagttgggtctgaaaaggttgcccatgaagagacccccgcggtttccatatttgacccgtaaggcccaggggaaccatttcccttttgggaaagaggggggtaaacacaagggggggggggaagggacaagggggggcccccccttttggggagtaaaaaaacccctttttttggtttttcagggggggaagaaaaaaaaaaaattggggttaaccccaaaaaaaaaaaattttcctcccgacacaaaaagg

SEQ ID NO: 85819 - DNA, 865 bp, Zea mays
  misc_feature: Ceres CLONE 1572228
  misc_feature: Encodes the peptide sequence at SEQ ID NO. 85820
tccccgcggtggcggccgctctagaactagtggatcccccgggctgcaggaattcgtctcaccccctagaaaaaactgcccccagagcctccaagctgcatatcggaagtgaagcgcctcgcagtcctcctctcggatctcgcggtggaagtcgccggtccactcgatcagcgagcgagtcggtgccgcgcggcggattccccgacccgagcaaaggaaccggacatgcggccgcggctggtgctcttcggcgactccataaccgagctgtccttcgcgtccggcggatggggggccgcgctcaccgaccgcttcgcccgccaggctgacgtggtgctgcgcgggctcagcggctacaacacgcggtgggcgctcaaggtgctgccgcgggccatggagggcgcggcgggcgcgggcgcgggcgcggacccggcggccgtgacagtcttcttcggcgccaacgacgcctctctgcccgaccaggtgcaggcgcaccagcacgtgccgctcaaggagtaccagagcaacctccgcgccatctgcgcctatttcaaggagcgatggccctccactgctgtcatactcatcactcccccacccgattacgagccagcgagaatccgagacatgtatggagacgacgagcctttcacgccaccagaaaaggagccatgaggctgcccggggcttacgcccaggcatggcatagatgttggccccggaattggaaccctcccggtttttagacatcttgggaccaaggatggcggaaattttccagaactgggcaaaacattctggcatttgggggggaacggggctccccctttccccccccagggaggggaaaaaaaggaattccttg

SEQ ID NO: 85820 - protein, 149 aa, Zea mays
  misc_feature: Ceres CLONE 1572228
  misc_feature (5)..(150): Pfam Name: Lipase_GDSL Pfam Description: GDSL-like Lipase/Acylhydrolase
MRPRLVLFGDSITELSFASGGWGAALTDRFARQADVVLRGLSGYNTRWALKVLPRAMEGAAGAGAGADPAAVTVFFGANDASLPDQVQAHQHVPLKEYQSNLRAICAYFKERWPSTAVILITPPPDYEPARIRDMYGDDEPFTPPEKEP

SEQ ID NO: 85821 - DNA, 1103 bp, Zea mays
  misc_feature: Ceres CLONE 1572230
  misc_feature: Encodes the peptide sequence at SEQ ID NO. 85822
  misc_feature (12)..(12): n is a, c, t, g, unknown, or other
  misc_feature (14)..(14): n is a, c, t, g, unknown, or other
  misc_feature (54)..(54): n is a, c, t, g, unknown, or other
  misc_feature (56)..(56): n is a, c, t, g, unknown, or other
  misc_feature (58)..(58): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
aaaagtatttancntttttgccgaccatataccaaaccacaacaacaaatcacntntngacttacaacaannnaacccaaaaactggagctccaccgcggtggcggccgctctagaactagtggatcccccgggctgcaggaattcgtctcacccctagaaaaactggccacccatccgatcccacccggacagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcacctcgtcgccaaggccaccggggagaacgccgtgagggcgcccgcacaggcgaagctgaaagtggcgatcaacggcttcggccgcatcggccggaacttcctccggtgctggcacggccggcgagggactcgccgaatcgacgtcgtccgtcgtgaactgacagcgcgaggcggtcaggtaaacgcgtcccacctccctcaaagtaacgaactcgaatgcttcggccacccttccaagggccgtaccgtccaagaatccgttgggacggaccacggaacccattcaagccggtcgaaacggggcaaaagcccccaattcaccgggggtcgggtccttcccaagaccaaagggaaaacccccgctctttcagaagccctccgctcaattgggagtggttggaagcacctccggggacaattttggaaacattaccgttccccattcccgaaggggggccaccccgcggaaaaggttcctcttccgtttacggaaagagggaaccccccgggggtcggtcccggggggcaaaggcccaacaattccccagtaggacccaggggcccgtcggaaaaaataaaaagggggcgaatctcaatacaaacgaggggtttctccccgtccccaaaaggggggtggaccccgagaaacatttctcccgtgaaccccttatattgttctcgcgtttccgggggaggatttaaaaac

SEQ ID NO: 85822 - protein, 299 aa, Zea mays
  misc_feature: Ceres CLONE 1572230
  misc_feature: SWISSPROT Homolog: EC 1.2.1.13 Glyceraldehyde-3-phosphate dehydrogenase (NADP(+)) (phosphorylating)
MATHAALAASRIPAGARLHSRAPASSRHGVQRLDFADFSGLRPGSCSVSAAAREASFSDVLGAHLVAKATGENAVRAPAQAKLKVAINGFGRIGRNFLRCWHGRRGTRRIDVVRRELTARGGQVNASHLPQSNELECFGHPSKGRTVQESVGTDHGTHSSRSKRGKSPQFTGGRVLPKTKGKTPALSEALRSIGSGWKHLRGQFWKHYRSPFPKGGHPAEKVPLPFTERGNPPGVGPGGQRPNNSPVGPRGPSEKIKRGRISIQTRGFSPSPKGGWTPRNISPVNPLYCSRVSGGGFKN

SEQ ID NO: 85823 - DNA, 834 bp, Zea mays
  misc_feature: Ceres CLONE 1572231
  misc_feature: Encodes the peptide sequence at SEQ ID NO. 85824
  misc_feature (29)..(29): n is a, c, t, g, unknown, or other
  misc_feature (344)..(344): n is a, c, t, g, unknown, or other
  misc_feature (701)..(701): n is a, c, t, g, unknown, or other
  misc_feature (717)..(717): n is a, c, t, g, unknown, or other
  misc_feature (748)..(748): n is a, c, t, g, unknown, or other
  misc_feature (761)..(761): n is a, c, t, g, unknown, or other
  misc_feature (762)..(762): n is a, c, t, g, unknown, or other
  misc_feature (784)..(784): n is a, c, t, g, unknown, or other
ggagctccccgcggtggcggccgctctanaactagtggatcccccgggctgcaggaattcgtctcacccctagaaaaaatacagaaatggtagggttcttcggcgcctctgctgcatctgatcactgtcgtttgctgacaagaaatggatcagttcaccatgaactgattagacgacaccatggcagaccaagaagtgcgatcaggtgctgcagcagcacggcaaggggaaggaccagggactattactaccaggtgctgggtatcgcaattcattccacacctcagcagatcaaggaggcttacaggaaactccagaagcaacaccacccagacatcgccggntacaagggccacgactacacgctgctgctgaacgaggcgtacaaggttctgatgcgggatgtttccagttccaggcacgccgatggaaggggcaggagtagggtggggtcagcagccggttacaccggggacggatacagttcttgggaagggcccgtgagaagccaagctctcttcgtggacgagaacaagtgcataggatgccgggagtgcgtgcaccatgccgctaggacgttcgccatggacgacgtcctcggcagcgcgcacgtggaggtccagttcggcgacctggagcagcagattcagctggctgtggagtcctgccccgtggactgcatccactgggtcgagagcacnaccctgccgtgctggnagtccctgtccggccgcagccgaaggaaggncacggcgtattcnngcggcggtgggagcggcccggnaacgttgttgcggcggcgaagaactcgcccaggagactggagagggagaa

SEQ ID NO: 85824 - protein, 249 aa, Zea mays
  misc_feature: Ceres CLONE 1572231
  misc_feature (53)..(114): Pfam Name: DnaJ Pfam Description: DnaJ domain
  misc_feature (211)..(211): Xaa is any aa, unknown, or other
  misc_feature (221)..(221): Xaa is any aa, unknown, or other
  misc_feature (226)..(226): Xaa is any aa, unknown, or other
  misc_feature (233)..(233): Xaa is any aa, unknown, or other
MVGFFGASAASDHCRLLTRNGSVHHELIRRHHGRPRSAIRCCSSTARGRTRDYYYQVLGIAIHSTPQQIKEAYRKLQKQHHPDIAGYKGHDYTLLLNEAYKVLMRDVSSSRHADGRGRSRVGSAAGYTGDGYSSWEGPVRSQALFVDENKCIGCRECVHHAARTFAMDDVLGSAHVEVQFGDLEQQIQLAVESCPVDCIHWVESTTLPCWXSLSGRSRRKXTAYSXGGGSGPXTLLRRRRTRPGDWRGR

SEQ ID NO: 85825 - DNA, 735 bp, Zea mays
  misc_feature: Ceres CLONE 1572232
  misc_feature: Encodes the peptide sequence at SEQ ID NO. 85826
  misc_feature (420)..(420): n is a, c, t, g, unknown, or other
  misc_feature (426)..(426): n is a, c, t, g, unknown, or other
acccgcggtggcggccgctctagaactagtggatcccccgggctgcaggaattcgtctcacccctagaaaaaacaagctcgaccaccaacccagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgaggttccagtcccggcacgagtaccctgttcggcaangatcgnacatgcagctgcggctggtgccggcaactccgcggcacgtcaccgctactactgtcgtcgcagcggcgccacgagagatcgactcgaagtcctgggcacgtgtccgggaagcctaacgctgggaacaacgtgttcccccggggcaagggcaacgggaacaaccaatcccgccttttggttgaaacccaccccccaaattttcaaacctatttccattcctttgggaacccccaagcaaggtttttttttttgggggggaaaaaaaaatgccccaaaaagggaaatttccccccaaccccggggaaaaaa

SEQ ID NO: 85826 - protein, 177 aa, Zea mays
  misc_feature: Ceres CLONE 1572232
  misc_feature: SWISSPROT Homolog: EC 2.4.1.207 Xyloglucan:xyloglucosyl transferase
  misc_feature (73)..(73): Xaa is any aa, unknown, or other
  misc_feature (75)..(75): Xaa is any aa, unknown, or other
MATSSRRVPLLLLCLGVLVSCSFAAGSLDQELDITWGDGRGKVLDNGRLLTLSLDRTSGSEVPVPARVPCSAXIXHAAAAGAGNSAARHRYYCRRSGATRDRLEVLGTCPGSLTLGTTCSPGARATGTTNPAFWLKPTPQIFKPISIPLGTPKQGFFFWGGKKNAPKREISPQPRGK

SEQ ID NO: 85827 - DNA, 763 bp, Zea mays
  misc_feature: Ceres CLONE 1572233
  misc_feature: Translation starting site: 350
  misc_feature: SWISSPROT Homolog: EC 1.11.1.11 L-ascorbate peroxidase
  misc_feature (268)..(268): n is a, c, t, g, unknown, or other
  misc_feature (331)..(331): n is a, c, t, g, unknown, or other
  misc_feature (430)..(430): n is a, c, t, g, unknown, or other
  misc_feature (567)..(567): n is a, c, t, g, unknown, or other
  misc_feature (600)..(600): n is a, c, t, g, unknown, or other
  misc_feature (632)..(632): n is a, c, t, g, unknown, or other
  misc_feature (659)..(659): n is a, c, t, g, unknown, or other
  misc_feature (661)..(661): n is a, c, t, g, unknown, or other
  misc_feature (714)..(714): n is a, c, t, g, unknown, or other
  misc_feature (728)..(728): n is a, c, t, g, unknown, or other
  misc_feature (729)..(729): n is a, c, t, g, unknown, or other
ctccccgcggtggcggccgctctagaactagtggatcccccgggctgcaggaattcgtctcacccctagaaaaagcccccagcagatcttgtgaccctcgctcagccgcgtcgcgtcccatcctacgatccaaaggtctctctgctcgcagccatggcgaagaactacccgaccgtgagcgccgagtacagcgaggctgtcgagaaggccaggcgcaagctccgagccctcatcgccgaaggaaggagtgctggctggcccccgtgcntcagtggcctccgccctcgccgtggcactccgcggggtacattcgacgtgtcgtctaggaccnggcggtccagtcggcacgatgaagcatcagtcgggagttggctcacgggcgctaacgcgggggctgggacatcgcggtgcgggctggctcgagccaatnaaaggaaggaattccccaatccctctctttacgccggatttctaacccaccttcccagggaatttttgggggcccccgggggagagggccccccgcggggggggggcctggagaaaaaaaaaatttccccccccttntccccccccccccccccccccccctttttgggngggggggggggaaaaaaaaaaaaaaaaaaatntttattttttttttttttttttttttntnccccccccccccccccccacaaaagagagagggggggggcgcccccccccccncctcctttcttttnnttctccctcttttgttatagcaacaaaaacaaag

SEQ ID NO: 85828 - DNA, 910 bp, Zea mays
  misc_feature: Ceres CLONE 1572234
  misc_feature: Encodes the peptide sequence at SEQ ID NO. 85829
tccccgcggtggcggccgctctagaactagtggatcccccgggctgcaggaattcgtctcacccctagaaaaaacactgaccgacacagcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgccgcccgtggaccacgccgccgccgcgaggaggcgccggaggaggagggccaacagggccgcccagctgctgggggctgctgcgggtgcgccgcagcaggggcgcccctcggtcggcgacatctgcgaggaggacagcagcagcaccggacccgtcaagggtcaggaaggcgggcgtcctgggaactccgcccggggagctgccccggggcggatgggggggaagccagtaccgggggaccttggagggggggggtcggtcccctgcccagggtttcgcggccgaacaggggtttctctggttcttgaatctggggcggccggggaaagggagggcgaaactcggtcgcggggttccaccccgcgaaccgacgaacggggggggtgaaaaaacaattaaggaagccaggcccaaaaccccccttccgccgaaggccgtgttataccgggattatccggggttacccttattttgtagaaaacccaaggggacccataggtttagagagaaatggtgggcctccccgacacagaagggg

SEQ ID NO: 85829 - protein, 148 aa, Zea mays
  misc_feature: Ceres CLONE 1572234
MRLLSLVPFGCRAGPIDDAPPPVDHAAAARRRRRRRANRAAQLLGAAAGAPQQGRPSVGDICEEDSSSTGPVKGQEGGRPGNSARGAAPGRMGGKPVPGDLGGGGSVPCPGFRGRTGVSLVLESGAAGEREGETRSRGSTPRTDERGG

SEQ ID NO: 85830 - DNA, 811 bp, Zea mays
  misc_feature: Ceres CLONE 1572235
  misc_feature: Encodes the peptide sequence at SEQ ID NO. 85831
  misc_feature (571)..(571): n is a, c, t, g, unknown, or other
  misc_feature (578)..(578): n is a, c, t, g, unknown, or other
ccccgcggtggcggccgctctagactagtggatcccccgggctgcaggaattcgtctcacccctagaaaaaaaggcaacattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggaagctaaatcacaagaacattcgttgggctaccccaactcacaagcttcagatgcttcgcaattgatttctcaagcttcctttgatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccggggatcggctnagcgatntcagaagaggaaagcagcacacttgaccgatcttgaatcacaggtttccaggtttacgtctgagaatgcatctttgctgaagcgactggctgatatgactcagaaatacaaggaacgcttcccggtgaccataaaaatctaacagttggatgttgagactatgggggagaaaaggttcgttccgtcttgaatgcatcaccgaacctttttccttcctttttttgggggaacgc

SEQ ID NO: 85831 - protein, 186 aa, Zea mays
  misc_feature: Ceres CLONE 1572235
  misc_feature (121)..(181): Pfam Name: bZIP_1 Pfam Description: bZIP transcription factor
  misc_feature (138)..(138): Xaa is any aa, unknown, or other
  misc_feature (140)..(140): Xaa is any aa, unknown, or other
MAGGGAGDDDVVVVSCGGRGGGDPGAYAAVLKRKLDLYCAAVAKSMEAKSQEHSLGYPNSQASDASQLISQASFDGDIDGASLVTNSNVIEDDDFQGKPTNSGTSKELSDDDGDLEENTDPANAKKMRRMVSNRGSAXRXQKRKAAHLTDLESQVSRFTSENASLLKRLADMTQKYKERFPVTIKI

SEQ ID NO: 85832 - DNA, 830 bp, Zea mays
  misc_feature: Ceres CLONE 1572237
  misc_feature: Encodes the peptide sequence at SEQ ID NO. 85833
  misc_feature (671)..(671): n is a, c, t, g, unknown, or other
  misc_feature (830)..(830): n is a, c, t, g, unknown, or other
tccccgcggtggcggccgctctagaactagtggatcccccgggctgcaggaattcgtctcacccctagaaaaaataggttgctaggctcggccgtgtagagcagcaagagcacgccgcgccaagcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctcgccgccaaggacaacttcctcggcaagtacatctacaaggacacgctcgccaggaacctcgccgccgtcatttacaaagacgaggacgtgatcatagacacagcgaaagagcagtaccgtgtgctcaagaccgaaaatcagcttcggtatggctacaaagttgtggagaaaaggaacataatgtctgctctgactancagcaatgtgatcgaacttccaagcaagacgagctcaaaatcgtggttgacaacgtgaaggacttctttggcgacgtgactgccggcgacaaagaatcctttgcgcagataacaaggtctgctgtcagcaatggaggaagaagaagcagacatctaaan

SEQ ID NO: 85833 - protein, 193 aa, Zea mays
  misc_feature: Ceres CLONE 1572237
  misc_feature (175)..(175): Xaa is any aa, unknown, or other
MEVVGGVSLRPSPAPARIRTTLPPVDVGGRFLLRRVAGRQPARRALVVEARGGRGWSERQMQQQRRAPLLPKIEDDGNPRFVIFIRTANVYFWYPLNIITGGTTAKIMLAAKDNFLGKYIYKDTLARNLAAVIYKDEDVIIDTAKEQYRVLKTENQLRYGYKVVEKRNIMSALTXSNVIELPSKTSSKSWLTT

SEQ ID NO: 85834 - DNA, 811 bp, Zea mays
  misc_feature: Ceres CLONE 1572238
  misc_feature: Pfam Name: zf-Dof Pfam Description: Dof domain, zinc finger
ctccccgcggtggcggccgctctagaactagtggatcccccgggctgcaggaattcgtctcacccctagaaaaagcagctttcctacatggcgccacgcatgccggattccgggtgccggcctgtactgtcgttcgcgggcgtcgacctcggccgctcccaggggctacccctctccggcggccacagaggcggaggatgattcggccacagctccggcgccgggcggcgacccgtgcccacggtgcgggtcgcgggacaccgagttctgctactacgacaactacaacacgtcgcagtcgcgccacttctgcgagtcgtgccgacgcttactggaccaaggagcgggtccctcactaacgtcgccatcgggggcggctcccgcaagagcggctacatcgtcctcagcatcggcctcggtaacgccgatcctctaccggctgccgcatccatagagcccgatgtcgtccaacaactccgagctttctccgccgtcagccccggccaccgggcgccggacccccgccctgtgtcaacggcagcttccccgattttacatccaagaacaagggttgccattccatgggaaacccccaaccttaaacccttggccccattcgaaaaaaccccacctcgggaacggaaacccggaaagggggcaaagggggggccccccccacgggaaaaaacccgtgtctccccacgcgggaccctctccataaaaaaagggtttttttttccccccccggggaaaaacccctcttggggggggggccttttttgagcgcgcttttttttggggggaaaaccct

SEQ ID NO: 85835 - DNA, 906 bp, Zea mays
  misc_feature: Ceres CLONE 1572240
  misc_feature (249)..(249): n is a, c, t, g, unknown, or other
  misc_feature (693)..(693): n is a, c, t, g, unknown, or other
cgcggtggcggccgctctagaactagtggatcccccgggctgcaggaattcgtctcacccctagaaaaaatactcccgaggccccgatccccctttcatttcaacttgcatctcccgcgccgcgacgccccagcacggcagaccaaatggacctgccagtggtagatatcacgccgtatatcggggccgaaaacggcggcccgaccgcgtcgggtgtggacgagctgcccgccctgtgcgccacagtgnaagccgcttagtgtctgccccgacactggggcgcgctcgctggtgatggacacgagcagcatcagcggggaaaaaggaacccattcttcggggtttttttaaaggaggaaaattcgccccaaaaaccccggaaggagaaaaaaaggttcccctcctaaaaaaagaggggcccccccccctcctaaaaaaaacaacaaatgggggggggggaaccccccccccccggggggggggggggggccgcccccccctttttttttttataaaaaaaaaaacacccccccccgcgaaaaaaaaaaaaaaaaaaaaaaacacccccccgctggggagagaaaaaaaaaaatttttttgttgaatccccccccctccctccatacgacacccgcgggcgcccgcacccccgaagaaaaaaaaagaaaaaaactttctttgtttttttttatnagggaggggggggggggagggggtgtattttatttctattccctcgcctaccacaaaaaaagaatgccaatatctctttctctttttttgtgtttgtggtgtacggattctcaacattataaaccaactccaaactcgtctcctctcatatatttttagtggggtggagtagaatttatataaccgcatatcgaaccggggtacggagagggg

SEQ ID NO: 85836 - DNA, 830 bp, Zea mays
  misc_feature: Ceres CLONE 1572243
  misc_feature: Encodes the peptide sequence at SEQ ID NO. 85837
ctggagctccccgcggtggcggccgctctagaactagtggatcccccgggctgcaggaattcgtctcacccctagaaaaaaagcacgcccagatccttgttgtgaacgtacgttccaaacttgctcatactactcagagcgcggcgacatgttcggctttctgaaacaacggaggcagaccccgtcagggttctcgtcgtcgctcagccgccgaggaggtcaccgccggcatcgatggctccggcctcgtcgcgatcgtcacgggcgcgtctagtgggatcggtgccgagacctgccgagttctggcgctgcggggcgttcgtgttgtgatgggcgtgaggacaccatctgcaagtgagcgcgtcaaggaagagatcgtgaagaacgtcgccgctgccggaatcgcattttctccttgtaccctttcggatgatggaattgagttacaatttgcaacaaattaccttggccattttctactcacgaaactgccacctgaaaagatgaaaatcacggccatggacagtggaatagcaggtagggttgtgattgctgcttctgacagctacaagcacacgtatctagagggaattcgttctgataaactcaaggatgcatcacgcaataaaggcatcctgccttatgggcaatcgaaggtggccaatatatagcgttcgcattgaactttcttgccgcttgcaggaagaatatgccaaagaagtactcaactgactgcatctcggcagatgttgccttcgaaatcacgcgtcatctggggatcataaaagatattccttctccaagtgcctaaactgtgtactaagggggga

SEQ ID NO: 85837 - protein, 113 aa, Zea mays
  misc_feature: Ceres CLONE 1572243
  misc_feature: SWISSPROT Homolog: EC 1.3.1.33 Protochlorophyllide reductase
MGVRTPSASERVKEEIVKNVAAAGIAFSPCTLSDDGIELQFATNYLGHFLLTKLPPEKMKITAMDSGIAGRVVIAASDSYKHTYLEGIRSDKLKDASRNKGILPYGQSKVANI

SEQ ID NO: 85838 - DNA, 796 bp, Zea mays
  misc_feature: Ceres CLONE 1572244
  misc_feature: Translation starting site: 167
gcggtggcggccgctctagaactagtggatcccccgggctgcaggaattcgtctcacccctagaaaaagcgtctttgggtgagcacaccgcgcaggaacgagaggggcgaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtccgcggcggaagccatgaaggccaagatctaccgccttttcgagccgggagaggcccgtccactccgtcctcggcggcggcaagcctgccgatcttatcctatggaggaacaggaagatctctggcagcgtacttgctggtgccacggtcatctggctcctattcgaggtcatggagtaccatctcctcaccgtggtgtgccactgtctcatcgtctcgactgccatcctcttgctgtggagccaatgcgtcactttcatcaacaagtccggacgaacattcgtgaaggcaaatctccgatgatgtgactgttaatcgtgccctgccactgagatatgaaatcaacaggggctttgctaccttaagggaaaattgggcatggccttgatctgaataaaatcccaaaatggtattggccggcctctggaattctttagggttctcgggaagctgctggaaatttcttgaaaagggtcccttaatggtcatttggggaacta

SEQ ID NO: 85839 - DNA, 783 bp, Zea mays
  misc_feature: Ceres CLONE 1572245
  misc_feature: Encodes the peptide sequence at SEQ ID NO. 85840
ggagctccccgcggtggcggccgctctagaactagtggatcccccgggctgcaggaattcgtctcacccctagaaaaagtgatctctgaccgcgtgcctgttgaagaatgagccggcgactcataggcagtggcttggttaagggaatggaacccaccggagccgtagcgaaagcgagtcttcatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgatagaaggaggcggcaggggtctctggagatctccgacgaagacgacgacgacggtgacggggaggcggacgacgacgacgacgatgacggggatgacgacgacgacgacgacgaggactcagacgacgaggaagaggtcgacggtgaagacgatcaggaggaggagctgggaaccgagtatctggttcagcctcttgagcgg

SEQ ID NO: 85840 - protein, 36 aa, Zea mays
  misc_feature: Ceres CLONE 1572245
GAPRGGGRSRTSGSPGLQEFVSPLEKVISDRVPVEE

SEQ ID NO: 85841 - DNA, 877 bp, Zea mays
  misc_feature: Ceres CLONE 1572246
  misc_feature: Encodes the peptide sequence at SEQ ID NO. 85842
acccgcggtggcggccgctctagaactagtggatcccccgggctgcaggaattcgtctcacccctagaaaaaagttcgctcctcccatggcggcgtcgcccgctctcgtctcgctgactcccgccgtctccaggcatccccacctcctcttctgctccccttgccccccgccgcgccacatccgcctcgcccctccaaccgccacacccgcctcggacggaaacggcctcggccccggccccggccccggtgtcttcctatcgccgcgcgcgctctcgcagctcgacgagctcgcggccttccgctacgagcacgccttcccgcacggactcctcactgtgcgcgccctctcgcgcggccccgacgacgacgccgtggccgaggcgctcgaccgcctcctcgcctcctccttctccgagaccgtgcgctgggccccggcccagcggtacgcgcagctcctcacgttcgtcatcagcaggtacctccacgaccgccgcgggctcgctccgcacaccgcgatgcgcgaggggttctaccgccccgccgaacgcgacgccggcgccgacaacgtcaacacctccccggaagacaactaacgggagggtggggataaaaggggaaaaatgaaatttgccgcaaaaagataccaatttaaagctttaaataaaaaaaaaaactacccttgcaaggaaccatttttcggaagtgctaaaatcccctaaccgaaagtaaaaatactaagatatataaaacaaacacttggttaaaaaccggagacaaaggggttaatccataatatcacttgcggaatgtaaaaaaaaatcaagggctccataccgggacactatagccaaaaataaggaaatcaaggctataa

SEQ ID NO: 85842 - protein, 169 aa, Zea mays
  misc_feature: Ceres CLONE 1572246
MAASPALVSLTPAVSRHPHLLFCSPCPPPRHIRLAPPTATPASDGNGLGPGPGPGVFLSPRALSQLDELAAFRYEHAFPHGLLTVRALSRGPDDDAVAEALDRLLASSFSETVRWAPAQRYAQLLTFVISRYLHDRRGLAPHTAMREGFYRPAERDAGADNVNTSPEDN

SEQ ID NO: 85843 - DNA, 823 bp, Zea mays
  misc_feature: Ceres CLONE 1572248
  misc_feature: Encodes the peptide sequence at SEQ ID NO. 85844
  misc_feature (731)..(731): n is a, c, t, g, unknown, or other
  misc_feature (737)..(737): n is a, c, t, g, unknown, or other
  misc_feature (765)..(765): n is a, c, t, g, unknown, or other
  misc_feature (766)..(766): n is a, c, t, g, unknown, or other
ccgcggtggcggccgctctagaactagtggatcccccgggctgcaggaattcgtctcacccctagaaaaaaaaacgcaggccgcagtcgcgtgcggaactagagctccttcagagaagtgccgtgccagtgccaccgccggccgcatcatcgttccgcccccctgagtgttcagtaacttcttccgatccatattatggcttcaaagcagcagcagaaacagttcctggatgaagccatgatcaagcagccgacaccggaggaggaccgtgagggcgcatggccctcagtgctgacgatcatcggctttggattcctaaccttcaactcattcatggctgtgtacaggtcaaatggagatgttggatctatctcctttgtggtcttctcttacctggtcctcgttctgctgttctactgcctgcgccgattcgagacaactccaccagagtcgcctagccgggagcacataaaaatggccgtgtgggtactcaccacgttgctcactgctgcgttctcatacaaggtggcagcaattatgccactcccggtgcaggtgctggtgtgggcaatggcaggagcaactgtgttcggtggtttttatgctttcttcatccacaggaaaaaaccgcccagctggaacccccaaaaccataacgagggtgcccgtcctgctagccggtgtgcttgctgtgcgatcgtttggcatgtgcttgttgagggctgtcgtgnaggggntttttgtaaaggggaaaaaaaacaaaannacccccttcccccgaaaaagggcctgtggggcccttccttaaaccttccctggaatc

SEQ ID NO: 85844 - protein, 209 aa, Zea mays
  misc_feature: Ceres CLONE 1572248
  misc_feature (179)..(179): Xaa is any aa, unknown, or other
  misc_feature (181)..(181): Xaa is any aa, unknown, or other
  misc_feature (190)..(190): Xaa is any aa, unknown, or other
  misc_feature (191)..(191): Xaa is any aa, unknown, or other
MASKQQQKQFLDEAMIKQPTPEEDREGAWPSVLTIIGFGFLTFNSFMAVYRSNGDVGSISFVVFSYLVLVLLFYCLRRFETTPPESPSREHIKMAVWVLTTLLTAAFSYKVAAIMPLPVQVLVWAMAGATVFGGFYAFFIHRKKPPSWNPQNHNEGARPASRCACCAIVWHVLVEGCRXGXFCKGEKKQXXPLPPKKGLWGPSLNLPWN

SEQ ID NO: 85845 - DNA, 825 bp, Zea mays
  misc_feature: Ceres CLONE 1572249
  misc_feature: Encodes the peptide sequence at SEQ ID NO. 85846
  misc_feature (739)..(739): n is a, c, t, g, unknown, or other
  misc_feature (740)..(740): n is a, c, t, g, unknown, or other
  misc_feature (764)..(764): n is a, c, t, g, unknown, or other
tccccgcggtggcggccgctctagaactagtggatcccccgggctgcaggaattcgtctcacccctagaaaaagactaggagtccagtagcctgctagctatctatcagtgatccctcgcgaacgatgtgggacgggctggagagcgcggcgaccgtggcgcagctggtcggtctcgacgtcggcggcctcatcaccatgatcgggcaggcggcgcggaaggctcggcagaacaccaaggactgcgagcacctagcccgccgcgtcggcatgctcgcggagctggtcccccacctgcaggacccggaggccaggcgggcggtggccgggctcaaagatgcgctcgtggaggctcaccagctcatcacatcctgccagaggagggggctcacgtcccagctgttctcggcgtccaggcaggccgacaggttcagggacgtcgagcgcaagatcgaaacctgcgtgtccatcatccctgtcatcggctacatcggcataacaagacgcctcgatggttcgcaatcccagtcccagctgtcggcgggaggggctgaggatcgggagttcacgctggcggagatcgccgtggccaccaacaacttcgccgtcgtgctcagcaacgacgccgacactggcaccaaggtatacaagggaaggctcctgcagaacgggcctgaggtggccgtcaagcgcctcaaccgcgcgcggcggggagcggaggacgccttcttcgcgagaannaattttttttttggcccgctccgnccacgaacgcatcgtcccgcctcctgggcacctctcgccgacgaacggcgagcgcatgctg

SEQ ID NO: 85846 - protein, 233 aa, Zea mays
  misc_feature: Ceres CLONE 1572249
  misc_feature (205)..(205): Xaa is any aa, unknown, or other
MWDGLESAATVAQLVGLDVGGLITMIGQAARKARQNTKDCEHLARRVGMLAELVPHLQDPEARRAVAGLKDALVEAHQLITSCQRRGLTSQLFSASRQADRFRDVERKIETCVSIIPVIGYIGITRRLDGSQSQSQLSAGGAEDREFTLAEIAVATNNFAVVLSNDADTGTKVYKGRLLQNGPEVAVKRLNRARRGAEDAFFARXNFFFGPLRPRTHRPASWAPLADERRAHA

SEQ ID NO: 85847 - DNA, 785 bp, Zea mays
  misc_feature: Ceres CLONE 1572250
  misc_feature: Encodes the peptide sequence at SEQ ID NO. 85848
  misc_feature (630)..(630): n is a, c, t, g, unknown, or other
ctccccgcggtggcggccgctctagaactagtggatcccccgggctgcaggaattcgtctcacccctagaaaaaaggcccagccatcctctctcgcacacagacactcgttcgccgtctcagccacagccagagagcaccgacactcaggccaggccgatcaatgggcaagaagagcggccgcagcggcgccgacgcgcccaaggcgacggcgttcgtgctgaaggtggcgatgcactgccgctgcgacggctgcgtccccaagatccgcgccgcggtcaacaaactgacgctccggtgcgagggcatccagtcgctggaccagtcggcgctggacaccaagggcgaactggcgctggtggccacggcggacccggagaggctgcgccgccgcctgcgcgaggccacggggaagagcgtcgacatcgtcttccccaagcccgcagcggccaacggcggcagcagcggcagggaggaagcgaacgccgccgtccaggctcaggctcaggcccaggccccagcccaggcgctgctgctcgccgccggtctgcaacagcagcagcagcacggcccgtccctggtacgcgctccagcagggttgggtacgggccccgcgcccggagccgtacgntggcttcctaccccgccacccggttgggggcgcgtaaccccccaaacgggcctcgatgaacgcctacggcgggcggaatgtgtctcgggtactggaaccaaccggcgggaaagtaaaaccaaccggatggaaccttttgaagggttcggggccct

SEQ ID NO: 85848 - protein, 207 aa, Zea mays
  misc_feature: Ceres CLONE 1572250
MGKKSGRSGADAPKATAFVLKVAMHCRCDGCVPKIRAAVNKLTLRCEGIQSLDQSALDTKGELALVATADPERLRRRLREATGKSVDIVFPKPAAANGGSSGREEANAAVQAQAQAQAPAQALLLAAGLQQQQQHGPSLVRAPAGLGTGPAPGAVRWLPTPPPGWGRVTPQTGLDERLRRAECVSGTGTNRRESKTNRMEPFEGFGA

SEQ ID NO: 85849 - DNA, 789 bp, Zea mays
  misc_feature: Ceres CLONE 1572251
  misc_feature: Encodes the peptide sequence at SEQ ID NO. 85850
ctccccgcggtggcggccgctctagaactagtggatcccccgggctgcaggaattcgtctcacccctagaaaaaaggcccagccatcctctctcgcacacagacactcgttcgccgtctcagccacagccagagagcaccgacactcaggccaggccgatcaatgggcaagaagagcggccgcagcggcgccgacgcgcccaaggcgacggcgttcgtgctgaaggtggcgatgcactgccgctgcgacggctgcgtccccaagatccgcgccgcggtcaacaaactgacgctccggtgcgagggcatccagtcgctggaccagtcggcgctggacaccaagggcgaactggcgctggtggccacggcggacccggagaggctgcgccgccgcctgcgcgaggccacggggaagagcgtcgacatcgtcttccccaagcccgcagcggccaacggcggcagcagcggcagggaggaggcgaacgccgccgtccaggctcaggctcaggcccaggcccaggcccaggcgctgctgctcgccgccggtctgcaacagcagcagcagcacggccgtccctggtacgcgctccagcagggtgggtacggcccgccgccggagccgtacgtggcttcctaccccgccaccgcgtggggcgcgtacccacacaacggcctcgatgacgcctacggcggcggatggttcgggtactgagcgaccggcggagagtagagcagcggatggagcttttgaggttcgggtactgagcgaccggcggagagcagagcagca

SEQ ID NO: 85850 - protein, 182 aa, Zea mays
  misc_feature: Ceres CLONE 1572251
MGKKSGRSGADAPKATAFVLKVAMHCRCDGCVPKIRAAVNKLTLRCEGIQSLDQSALDTKGELALVATADPERLRRRLREATGKSVDIVFPKPAAANGGSSGREEANAAVQAQAQAQAQAQALLLAAGLQQQQQHGRPWYALQQGGYGPPPEPYVASYPATAWGAYPHNGLDDAYGGGWFGY

SEQ ID NO: 85851 - DNA, 938 bp, Zea mays
  misc_feature: Ceres CLONE 1572253
  misc_feature: Encodes the peptide sequence at SEQ ID NO. 85852
  misc_feature (339)..(339): n is a, c, t, g, unknown, or other
ggagctccccgcggtggcggccgctctagaactagtggatcccccgggctgcaggaattcgtctcacccctagaaaaaggaacaattccgcgttgcccatccatcccggaaatatccccaaggaaaccctcgcccccctccttccccgccgccggtcgccagatctccggtcatggacgacgacggcggggcctcccggtcgccctcgccgtccccgtcgcgctctccgtccccgctccccgtggccgaccccgtcacggtcgccgcggcgccgcccggccacgtcgccgtcgctatccccctccgcaagcactcgccttctccggggcgggctgcggnccatagagtttatacaaaaaagttaaacctggttttcttatttgctgcccctgcgtatttgccttcaaccccccacgggcggggttttctcgttcgcctttgggcaggggtcccttaaaaaggcgcgcataagaattcctaccccacaaaagtttttcccccctttgggaaaaaaaaattctcttttatggaaaaaaggttccccggggggtttcctcccccccggggggtgccgaaatttttttccccaaaaaaacctagcccctccgtttttccccccaagtttttatcaccctcggggggctaataaaaaacaccccctcccctcccttttttcgcgagaaaaatttacgctattacggggcgcgcccttgttgtttaatatcaccaatatgttggtggggggaaaaaaattttgttgggaaaaaaagtgttttatgtttgtgacacaaaaaaaccgccgctttttttttggcggggcaaaaaaagtatttttgtgggatcccccccccctctcgatgggggaaaaatccttgaaaaaaaaaaatttggttgcaggaaagagtaactattatttcctccccgaggatgacactatc

SEQ ID NO: 85852 - protein, 94 aa, Zea mays
  misc_feature: Ceres CLONE 1572253
  misc_feature (56)..(56): Xaa is any aa, unknown, or other
MDDDGGASRSPSPSPSRSPSPLPVADPVTVAAAPPGHVAVAIPLRKHSPSPGRAAXHRVYTKKLNLVFLFAAPAYLPSTPHGRGFLVRLWAGVP

SEQ ID NO: 85853 - DNA, 833 bp, Zea mays
  misc_feature: Ceres CLONE 1572254
  misc_feature: Encodes the peptide sequence at SEQ ID NO. 85854
ccccgcggtggcggccgctctagaactagtggatcccccgggctgcaggaattcgtctcacccctagaaaaaagatccattggcaagttcctctgcgccttcagtcgtatcccgtacccgaccctcgctgccggaagctagatagcatccctggggcgtggcctcacgctcctcgccctcactcgtactcggcctcacgtgctccgccgcctccgcgggcgacacgcaccttcgactactcgcaccagaagattgtgcgctctcccgctcccttgccgggtgtccagagcgtcgacgtctccctcaacctctacaaccagcgatccccagactgtctactgatgtgtccgttcactgactactctctggctgatgaaagaggttgaccttgtcactatagagaatgctaacacattgaaaaggcttgatcctggggccactgcttcgcaggcgtctggactggataccaccacacacggcatgttcctcggttcacggcctatgattacataccgtgtcctctccggaacagatcttcgcgaaggatgctcggcatcgcatcttcccatcgtggatattgcatcgctgacataccatccagacctcaagtttgaatgcgctaagaggcttgtcatgaacccggagcacttgattctgtggtcgctgatgcctgactggtgaactgcatcgactggagcgcgacccacgacctgtcacagctagacttcatgaacgctgatctacttatagatcgccactgcatatgctagctgggtgttgttagctgccagggaatcttggtagctttgagctaagcactacccttgtgagat

SEQ ID NO: 85854 - protein, 102 aa, Zea mays
  misc_feature: Ceres CLONE 1572254
MKEVDLVTIENANTLKRLDPGATASQASGLDTTTHGMFLGSRPMITYRVLSGTDLREGCSASHLPIVDIASLTYHPDLKFECAKRLVMNPEHLILWSLMPDW

SEQ ID NO: 85855 - DNA, 850 bp, Zea mays
  misc_feature: Ceres CLONE 1572255
  misc_feature: Encodes the peptide sequence at SEQ ID NO. 85856
  misc_feature (10)..(10): n is a, c, t, g, unknown, or other
  misc_feature (15)..(15): n is a, c, t, g, unknown, or other
  misc_feature (25)..(25): n is a, c, t, g, unknown, or other
  misc_feature (34)..(34): n is a, c, t, g, unknown, or other
  misc_feature (50)..(50): n is a, c, t, g, unknown, or other
  misc_feature (57)..(57): n is a, c, t, g, unknown, or other
  misc_feature (69)..(69): n is a, c, t, g, unknown, or other
  misc_feature (218)..(218): n is a, c, t, g, unknown, or other
  misc_feature (250)..(250): n is a, c, t, g, unknown, or other
  misc_feature (374)..(374): n is a, c, t, g, unknown, or other
  misc_feature (415)..(415): n is a, c, t, g, unknown, or other
  misc_feature (497)..(497): n is a, c, t, g, unknown, or other
  misc_feature (543)..(543): n is a, c, t, g, unknown, or other
  misc_feature (566)..(566): n is a, c, t, g, unknown, or other
  misc_feature (574)..(574): n is a, c, t, g, unknown, or other
  misc_feature (590)..(590): n is a, c, t, g, unknown, or other
  misc_feature (597)..(597): n is a, c, t, g, unknown, or other
ctccccgcgntggcngccgctctanaactagtgnatcccccgggctgcangaattcntctcacccctanaaaaaatactcaaatggtaaggttcttcggcccctctgctgcatctgatcactgtcctttcctcaccaaaaatggatcacttccccatcaacttattacacaacacctctccctacccataattgccatcacgtgctgcaccacctccncaacggaaacgaccatcgactattactaccanatgctgggtatctcaattcattccacacctctccaaatcaacgacgcttacctgaaactccacaaccaacaccacccaaacatctcctgctacaagggccacgactactctctgctcctgaacnaggcgtaccatgttctgatgcagcatgcttccacttccaancacgccgatcgaaggggcacgactacggtggcgtcaggagccggttacaccggggacggatagaggggttgtcaacggcccntgataagccaacctctcttcctggaccaaaacaattgcataggatncccggagtgcgtgcaccatgccnctaggacnttcgccatggaccacntcctcancttccctcacgtgaaggtccagttcagcaacctggagccacagattcagctggctgtggagtcctgcccccgtggactgcatccactgggtccagagccacgaacctgcccctgctgggaattcctgtccccggccccaaccctaaaggaaagccaactgcagtatttctgcctgctggtggggtagcgggccccgggaaactttgttttgccggcggcgcaaagaaccttcggcccgggaggagttgagagg

SEQ ID NO: 85856 - protein, 67 aa, Zea mays
  misc_feature: Ceres CLONE 1572255
  misc_feature (4)..(4): Xaa is any aa, unknown, or other
  misc_feature (6)..(6): Xaa is any aa, unknown, or other
MDHXLXFPHVKVQFSNLEPQIQLAVESCPRGLHPLGPEPRTCPCWEFLSPAPTLKESQLQYFCLLVG

SEQ ID NO: 85857 - DNA, 747 bp, Zea mays
  misc_feature: Ceres CLONE 1572256
  misc_feature: Encodes the peptide sequence at SEQ ID NO. 85858
  misc_feature (42)..(42): n is a, c, t, g, unknown, or other
ctccccgcggtggcggccgctctagaactagtggatcccccngggctgcaggaattcgtctcacccctagaaaaaacctgaagcccctaccacgataagccctaatcccagcgccacctcgatggcgaccacctctttctttcatccgctcgccgccccgatggaccgcggtagcgtttgttttcgtcgctgcccgttcagcctaaccatccccgcccgtacagagccccggcgaccggcgccacttctcgtcgtccgcgctaagcgcgccggcggccagccccctgctgccgccgcctcgcgtcaacccgcgaatcccagcgcggtcccgaaacgggacgtgcaagaataggacgaggaggtcgaggaggagatgccctggatccacgacaaggcgctggacctcgtggagttcactggcatcgtcacacaggccatctcaaggccctgtgttgactctagccctgttacatgacttctcgcggttcacctcgcctacatcggggtctcctatgtgctcccggacgtccgcacgtgggcaagtttacctagccccctactaggtataaaccgacggtggagtaagaattggttcctggatgaggttctagaagatctgttttataacgggcgggaggggaataaattattctggatcttcaggacctaagggaaaaggaatgaatttggccctggattatcaacccagggagggccttcccgttcccccctgtaaaggaaaaccgt

SEQ ID NO: 85858 - protein, 33 aa, Zea mays
  misc_feature: Ceres CLONE 1572256
MPWIHDKALDLVEFTGIVTQAISRPCVDSSPVT

SEQ ID NO: 85859 - DNA, 790 bp, Zea mays
  misc_feature: Ceres CLONE 1572257
  misc_feature: Encodes the peptide sequence at SEQ ID NO. 85860
ctccccgcggtggcggccgctctagaactagtggatcccccgggctgcaggaattcgtctcacccctagaaaaagcctgaagcccataccacgataggacctaatcccagcgccgcctcgatggccaccacctctttctttcatgtgctggccgcgccgatggacccccggagcgtttgttctccttggtgcctgtatatgcctacacatatgggactgttgagagtctcggccaccggcgccgcttctgggctgccgcgcttacggcgctggcagccagccgccaggtggcttcgcctcgcgtcagccggcgaatcccatttcggcccccaagcgggacgttcaacaagaggaggaggaggtctaggaggagatgccctgaattcaggacaaggcgctggacctcgaggagtacgatgacgccggctcacaggccatctcagggccccgtgttggctctagccctggtccatggcttatggcggttcccctcgcctacgtcggggtctgatatgtgctcatggtcctctgcacatgcggaagttcaccttaccagacaatggtaataatcgaacggtgagtgacaatagatgatcgctgaagtctacatcaagatctactagagagcggctggtaggcagtagattatgctgctcgtacggcactaactgcaaagacatgatttgacctgaatgatgcaggtaggaaatacatcccttccggactgcaatgaaaactacttcaacgctagatgcggtcgtcggatctcatttctctaaggaaggaatca

SEQ ID NO: 85860 - protein, 99 aa, Zea mays
  misc_feature: Ceres CLONE 1572257
MATTSFFHVLAAPMDPRSVCSPWCLYMPTHMGLLRVSATGAASGLPRLRRWQPAARWLRLASAGESHFGPQAGRSTRGGGGLGGDALNSGQGAGPRGVR

SEQ ID NO: 85861 - DNA, 1231 bp, Zea mays
  misc_feature: Ceres CLONE 1572261
  misc_feature: Encodes the peptide sequence at SEQ ID NO. 85862
  misc_feature (62)..(62): n is a, c, t, g, unknown, or other
  misc_feature (63)..(63): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (1022)..(1022): n is a, c, t, g, unknown, or other
  misc_feature (1231)..(1231): n is a, c, t, g, unknown, or other
ttttagttgtggctctcgccttacaaataacgagtggctcaacccattcccccccggggganngaaagnnnnnccaagctggagctccccgcggtggcggccgctctagaactagtggatcccccgggctgcaggaattcgtctcacccctagaaaaaaaggttgctaggctcagccgtgtagagcagcaagagcacgccgcgccaagcaacaaagagggaccccgcttccatggaggtggtgggcggcgtgtcgctgaggccgtcgccagcgccggcgcgtatccggactaccctgccacccgtcgacataggcggaggcttccttctccgccgggtcgcggggcgccagccggagaggcgcgcgctggtcgtggaggcccggggcggcatgggctggtcggagcgggagatgcagcagcagcgccgcgcgcccgctgctgccgaaaatcaaggacgacggcgacccgcgatttcttatgcccccccgcgcggccaaagccgacgttcaggtacaccgctcaaaaattatcctcgggcgggaacaacgggcgaagatcattgctgcccccccccagggaacaattttccctccgggtaaggtgcattgtatctaagggaaaacgcgttcgcccagggaaagccttcccccggccggcccctttttgtgaaaagggacccacgcgacgctggtatttcttagagagtacccaggcggaaaaaggaaagccgtcctgccccccgcgggtgccctcctccaaataaccaccacaaaaaaacttctttccatttttctccgcggggaatgtgggggcatataccacaaataaagtatttttgttggtgtgacgagaataaatggggcgaaaaacacatttatggggggcgcgtgttgggtcttcttgtgggagaccacaaacacaggggtaatatttggtgtggtgggattagaaaatatgtttcctcccagtagtacaataagggtgcgagtagagtctcctcacaaatacatctctggagtgntgatttcatacacgagagacgataaaatgagagactatcttttctcctggttgggaatccatatttctatctttccctggaggttggccaaaaataagaaaaatccttctgtatgtggggcgggaggataaacaagcggggcatatccctgctgcttccccgcgcatagtaggcggcgaacgaaaaggaaggtatgtggagcactctan

SEQ ID NO: 85862 - protein, 122 aa, Zea mays
  misc_feature: Ceres CLONE 1572261
MEVVGGVSLRPSPAPARIRTTLPPVDIGGGFLLRRVAGRQPERRALVVEARGGMGWSEREMQQQRRAPAAAENQGRRRPAISYAPPRGQSRRSGTPLKNYPRAGTTGEDHCCPPPGNNFPSG

SEQ ID NO: 85863 - DNA, 1258 bp, Zea mays
  misc_feature: Ceres CLONE 1572263
  misc_feature: Encodes the peptide sequence at SEQ ID NO. 85864
  misc_feature (26)..(26): n is a, c, t, g, unknown, or other
  misc_feature (27)..(27): n is a, c, t, g, unknown, or other
  misc_feature (69)..(69): n is a, c, t, g, unknown, or other
tgtggggggggtgtggggcgggggcnngttggggtgtccggtgttcggtttctctctttttcggaaaanaattggagggctgagctccccgcggtggcggccgctctagaatagtggatcccccgggctgcaggaattcgtctcacccctagaaaaaggaacaattccgcgttgcccatccatcccggaaatatccccaaggaaaccctcgcccccctccttccccgccgccggtcgccagatctccggtcatggacgacgacggcggggcctcccggtcgccctcgccgtccccgtcgcgctctccgtccccgctccccgtggccgaccccgtcacggtcgccgcggcgccgcccggccacgtcgccgtcgctatccccctccgcaagcactcgccttcctccggcggcgagcggccatataggtatacaaaataactaaacttgttgcctgtttgctgccacgctctgtgcctcaacagggagcgccacattctactctgccatcgcgcctgagagccgaaaagcgcgcaacatcttcgagccgaaggatttcagccttggaaaaaaattccgtcgtggagaagccccgggggtccccccaacctccccaattttaataaaaccttaccccctttgctacatgtgtcacccggttaaaaaataccagcgtcccattatcccaataaaatcccgataaagtgggggcgcgctggcacttcctgtcccgatttaggaggaaggaaacagcccttgcctgggggaaaaatattctcgacacgcggccactataatcaaattcgcaggattttgttttgcgggtcactcgtagacacacaaaagccctcggcgggctggagcacacaccaagagagcgctccgccccgcatgtggcgacaccgctcggtagtaacaaaaacacgaatggcgaggccgcggggagaaatagacgaacgaaacgtgtgccccggcggtacgcgtgacccaatttccctgtttctgcacaggctactgcagcggcgcagcgcataatgtcaatctccggcgggctccctcttatgtggagaggaggtaaaactctatcttcttcttttctcgaagcgtcacccctaataaagtaacctcctaacacccgccacggatttgtaaagagtcggcggcacagccttatgtcaagaacacagtgcggcccataattctttaagagaatctataactggtacaaagcggcttaccgcagtacatagagccctttgtgt

SEQ ID NO: 85864 - protein, 61 aa, Zea mays
  misc_feature: Ceres CLONE 1572263
MDDDGGASRSPSPSPSRSPSPLPVADPVTVAAAPPGHVAVAIPLRKHSPSSGGERPYRYTK

SEQ ID NO: 85865 - DNA, 829 bp, Zea mays
  misc_feature: Ceres CLONE 1572264
  misc_feature: Encodes the peptide sequence at SEQ ID NO. 85866
ctggagctccccgcggtggcggccgctctagaactagtggatcccccgggctgcaggaattcgtctcacccctagaaaaacgaaacctatgccacatccagagccaaagcctgaacctcaaccaaagcccaaccctgaacctcaaccaatgcccaagcctcaaccaaaatccaaaccagagccattgcctacaccgaagcctgaacctaagcccgaacctaagccagagcctaagcccgaacctaaaataaaaccaaagccaaaacctgaaccaaaaccagagcctaagccagagcataaacctgagccaaagccagagcctaaacccaaaccgaaaccagagccaaagccagagccacaaccaaaaccagagcctaagccagagcctaaacccgaaccgaaaccggagccaaagccagagccccaacctaagccagagcctaagcctgagccgaaaccagaacaaaagccagagccacaaccaaagcctgagcctaaaccagaaccaaaaccagagccaaagccagagcctaagcccgaaccaaaaccagagccaaagcctgagcctaaacccgaaccaaggccagaacctaagccagagccaaagcctgagccgaaaccgaaaccagatccaaagccagagccacaaccaaagccagagcctaaagcaggacccaaagcagagtcaaagccagaagcttaagccccgaacaaaaactagaaggcaaaagctgaagcttaaaccccgaacaaagaccagaaccaggaaccaaagccagaaggcctaaacctgaaaccaaaaccggaaacccagaacccggaagcctca

SEQ ID NO: 85866 - protein, 184 aa, Zea mays
  misc_feature: Ceres CLONE 1572264
MPKPQPKSKPEPLPTPKPEPKPEPKPEPKPEPKIKPKPKPEPKPEPKPEHKPEPKPEPKPKPKPEPKPEPQPKPEPKPEPKPEPKPEPKPEPQPKPEPKPEPKPEQKPEPQPKPEPKPEPKPEPKPEPKPEPKPEPKPEPKPEPRPEPKPEPKPEPKPKPDPKPEPQPKPEPKAGPKAESKPEA

SEQ ID NO: 85867 - DNA, 788 bp, Zea mays
  misc_feature: Ceres CLONE 1572269
  misc_feature (345)..(345): n is a, c, t, g, unknown, or other
ggagctccccgcggtggcggccgctctagaactagtggatcccccgggctgcaggaattcgtctcacccctagaaaaatgatctctgaccgcgtgcctgttgaagaatgagccggccactcataggcagtggcttggttaacggaatggaacccaccggagccgtagcgaatgcgagtcttcatacggcgattgtcactgcttatggacccgaacctgggtgatctatccatgaccaggatgaagcttggatgaaactaaccagacgtccgaaccgactgatgttgaagaatcagcggatgagttgtggttaggatcgcacgcactcctcatcttatcgccgccntcctccggtgctcacgccgatgttgctcacttctgagtcccgacgcacgagctctcaagagctagccatggcgtccaccactctctcgctcgtgattaccctcctctccagaacctccagctcgccgtgccgcgccggctcgatcccgaggtcctccgaggccggaccccaaattcgccgggggccgccccgccgtcaccgtcccgttgcactgcatcgaagcccccaagaatccggaaccttgggggaaccccttcccccggggttaagggctcaagggaagcccccaaacctttttcaaaacacccttcccggaaaaaggatccggggtttttcggggcggggggcctttccagggcgggggggggcgcgcccttatggggggaccccccccagagaaagggaccaggcccgggggcccccccgcgccccaaaagagaaag

SEQ ID NO: 85868 - DNA, 883 bp, Zea mays
  misc_feature: Ceres CLONE 1572271
  misc_feature: Encodes the peptide sequence at SEQ ID NO. 85869
ggagctccccgcggtggcggccgctctagaactagtggatcccccgggctgcaggaattcgtctcacccctagaaaaaaaggcaccaccaccagctagctctctgtctgctgctcctcttcgaagagtcgcagttcactttgttgtgctagagtgctgagcggatctttccttgtttcttcgttccggtaccaaggggcggggctctatgctgaacggaagggagcggaagagaaggcctgctgctagcgatgggtatcgttgacgtcgtctcctagttctgctcctggccgaggactctccggcctctcaggacgacgaagcagctccagactgtggagatgaaggtgcgcatcaactgcgaaaggagcgatcgccaggtgaacaaggcgatggagggcatgaagggcgtgagctccctggaggtggcggccaagcagaacaaggtgacggtcacggggcacgtggacgccgccaaggtcatgcacggcgtctcctacaaaacgggcaaacgggtggaaccctggccccacgtgccctactagatggtgcaacaaccctacgcgccgggcgccaacgacaaagaaggaggccgccggctacatccgcatcgtggtgaacgaacgccccgccgcgcctttaggtgggggccccctccaccgcaggaccggttcacgggcggccttcagcgacgaggaaccccaaccgactgcctccgatcagggtggttagaccggggccaacctagcgagggggatcggaccccaacttggatttccggggcgaaacttccttccggtttcccttatggataagggtggccctcccgagatatcatggggatgtttttgttcccctattggtggaataacctgatcataggg

SEQ ID NO: 85869 - protein, 67 aa, Zea mays
  misc_feature: Ceres CLONE 1572271
MKVRINCERSDRQVNKAMEGMKGVSSLEVAAKQNKVTVTGHVDAAKVMHGVSYKTGKRVEPWPHVPY

SEQ ID NO: 85870 - DNA, 784 bp, Zea mays
  misc_feature: Ceres CLONE 1572273
ctccccgcggtggcggccgctctagaactagtggatcccccgggctgcaggaattcgtctcacccctagaaaaaaggggagagcgtctctttctccttcccctccctctttccacgacaccaaagagaaaccgaaaaccatcgacgcgctccgtccaccctcccctaccccgcgtcctcctcccctacgcctcccagcccagcggcaaaacctagccctagatgggcgccgtcacgtctacggtcgcggcgcgctttgcctttttcacgcgagtccgccgtcgtacgggttcgagcaggcggcgctgcttgcggcccctgacacagcgcgagctcccgcccgggccacattcctaagccgctcgacttacgggccccgggccacaccccaagcctgcttccatccgggggacaggaaaaagggccggggggcccccgccgggtaagaaacttcccggggggggttccccccccggagaggggttaaacaactgggaaaaggcccccgggggccccgccttttcccaaaaaaaaaaaaaaggggggggggcccacccggaaggggggggggggctccccaaaaaaaaaccccctgtgggccccaaaagggggggggggggggcaaaaaaaaaaccaacgcgggggaggctttaaaaagcccccaaagggggtaaaaagcccccggggggggaaacacttttgggccccggaggaagttattaaaaaaagaacctttttttttttttggggggaagaataaaagacgccccgccccacctccaaaa

SEQ ID NO: 85871 - DNA, 781 bp, Zea mays
  misc_feature: Ceres CLONE 1572275
  misc_feature: Encodes the peptide sequence at SEQ ID NO. 85872
ctccccgcggtggcggccgctctagaactagtggatcccccgggctgcaggaattcgtctcacccctagaaaaaagcactctcctcattcgcgcgcctgaactcaccctgtacttcctcgtccatgccagaggcctgctatgatggagaacgacgctggctgaaacatgcgcgacactggtgaatgcggcccctgaggcgacggctgacaccccacgcggcgcctgctgttgcccccaaccccgcgcagggcacgaggccatcgcgacgaagacgcccgccggcatgacccatcccctctacgccgagatggtctcccacgccatcaccttggtgatggacaagacggggtccaccaactatgctgtcgccctggtcttggacgatccccaccgcgacgacctcgcgcccagatttctcaagactactgaacgttcacggtcaacactttcatcgccgggacgaagccttacccggtgaacaactcctgctggctgtcgtccggctgctagacgacagccgccccgaagaagaccggaccggcctgaagaattcaaggccgcgttcaaactgaacgtgaagtgcccctccaagtccatgcccgcaagcaaagccacaaggctgccgcgaagcccgcttccgagcctaaatcacatgacaacccacggggtcaggcaactccaaggccaagtctgctgcctacgcgaagtccaaggctgccggcgatgcgctgaagccgactgcgaacaaggaggtcgcggcaccaaggtgacaacaactgg

SEQ ID NO: 85872 - protein, 64 aa, Zea mays
  misc_feature: Ceres CLONE 1572275
MTHPLYAEMVSHAITLVMDKTGSTNYAVALVLDDPHRDDLAPRFLKTTERSRSTLSSPGRSLTR

SEQ ID NO: 85873 - DNA, 1198 bp, Zea mays
  misc_feature: Ceres CLONE 1572277
  misc_feature: Encodes the peptide sequence at SEQ ID NO. 85874
  misc_feature (1)..(1): n is a, c, t, g, unknown, or other
  misc_feature (12)..(12): n is a, c, t, g, unknown, or other
  misc_feature (51)..(51): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
nacgggcggaanagagaaccccccacccagtacccatattgaaaacaaaantcttctccccccccnccnnccaacactgggactccccgcggtggcggccgctctagaactagtggatcccccgggctgcaggaattcgtctcacccctagaaaaaagaccggacgcccttccactttccccttcccttcccttgcattcgcgcgttttccacctcccatcacgacctcttcctgacgtttccccaattcctccgcgctaagcagagcaacagcgatggcgacgaagtacgctgccgccgcggctgatctggtcacgggccgtccgcggaagcgggcgaggcttggctgggacgtggcgtcggctgccgagataggaacattttgtgggcaagaagttggtgatgtggccagcctgctattatcagcaaatccttccgaccatacttgttcgtctctgctcccgaagggtgtggctcgaaatgcttcccctccctggagagaagacgataaagatggccattatgtattttgcttgttggaagaagaatttgggcctcctccctaccaagatatactagaaaaaaatgggtggaaagggtacttttttggggcaaaggtaactgggaaatgccttggggaacccggaggaaaaagccaaaagaaagattgggtgggcgctaatttaaaaaaattttggttttccgcctctcttgttctaaaaggacaaatttaccccggctggaaatgagccagagccaaaaatggtaaataatgagaaaaaaacttcggaatatggtgtcccccttgggccaacaaaaaagatcctctgttggtccaaaaaacaaaaaatggaaatgtgccttgcgcacacggggacaaaaaaaccaatattgggtgtgttttacacaaaatatgacgggggaaaactctgtggggtatttggacaccttattcccgtttaagccaccactaaatattttgggaatctttgtgtcctagcgcgaaaaaaaagactcttgagggcccccaagaagaccttttaaatatgggaagtttgttccctgagcgcagaaaaaaaccgcggaggatttccccactccaagtgttccccagattgtgaatgtctaaatattccgcgcgcggatactgggaacattcaacactcttttgtgaaaatattggttgtcgatttcattg

SEQ ID NO: 85874 - protein, 157 aa, Zea mays
  misc_feature: Ceres CLONE 1572277
  misc_feature: SWISSPROT Homolog: EC 2.7.12.1 Dual-specificity kinase
MATKYAAAAADLVTGRPRKRARLGWDVASAAEIGTFCGQEVGDVASLLLSANPSDHTCSSLLPKGVARNASPPWREDDKDGHYVFCLLEEEFGPPPYQDILEKNGWKGYFFGAKVTGKCLGEPGGKSQKKDWVGANLKKFWFSASLVLKGQIYPGWK

SEQ ID NO: 85875 - DNA, 785 bp, Zea mays
  misc_feature: Ceres CLONE 1572281
  misc_feature: Translation starting site: 266
  misc_feature (517)..(517): n is a, c, t, g, unknown, or other
  misc_feature (611)..(611): n is a, c, t, g, unknown, or other
ctccccgcggtggcggccgctctagaactagtggatcccccgggctgcaggaattcgtctcacccctagaaaaactctcttcttcccgcggtctgctcgttcgatctgtgcagtaaatctgacgtcccgggcgacccttaagtagattcaatcgtcggcatggcgctcgtatagcatacctggggctcgaaaccagaatgccttcgaagcacttattgatgacaaatacagtgtgatcaaggttgagttgaccacggattttgagatgggtgtctactacaagacccctgagtttcttaagatgaacccccatgagaaggttcctgatctggatactcctgatagccctgtttttcacagtaatgctatcccccgctatgttgcgtcgcttgaaggatgacaaccctctttttgggtcttcccgtattgaaactagcccaccttgagctgtggatggattttgccgcaacagaacttgtatctctggtgtggcatggcacttgtatccaaggcatgngatcctaccttatgttatcgaactgagcaaacagctatttctgctttgtatacgtcgcttagggctctgaacgcgcccttgcttcaaacacatncattgatgagcatgctgttactctacctgacattgtgatgacgtgcaacctctacacgaaatttttgccgaatcttgacccacagcttcccctctgatttacctcatggcgagcagcagtatctggacaacgttcaactcccatacttcaaaaaggtaattagtgaagccaagc

SEQ ID NO: 85876 - DNA, 865 bp, Zea mays
  misc_feature: Ceres CLONE 1572282
  misc_feature: Encodes the peptide sequence at SEQ ID NO. 85877
ctccccgcggtggcggccgctctagaactagtggatcccccgggctgcaggaattcgtctcacccctagaaaaaaaaaaaccaacgtgcttgatctccctccgccactccatccatctcctcgctcccagtccccgggaagcatggcgtccgtcaccgcccgcgccccggtagcggcccttcgcccgtcgtcggcatcgctcaagtcgtcgtcggccttccttggccactctagccgcctcggccgcaccgcgtctcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaagtgctgaaccaagccgggctgatcaacgcgtcgcagtggtacgacgccggcaagtcggagtacttcgcgtcgtcgtccacgctgttcgtggtcgaagtcatcctgttccactacggggagatccgggcggtggcagggacatcaagacccccggcagcgtcaaacaggaacccagtcttcaagagctacagcctgcccgccgcacgaatgcgggttaccggggcagggtctttcaaccgggttcaaatttggggccccacgcttcgaggcccaagggagaaggaacctccgccaacgggaaaggctggggatagctggcctttccctgggcgttcctggaaaccgaaaccaaccgtcacccggggaagggggtgcccttttgagaaaacctgggta

SEQ ID NO: 85877 - protein, 241 aa, Zea mays
  misc_feature: Ceres CLONE 1572282
  misc_feature (57)..(204): Pfam Name: Chloroa_b-bind Pfam Description: Chlorophyll A-B binding protein
MASVTARAPVAALRPSSASLKSSSAFLGHSSRLGRTASPTRRSLKAEAKGEWLPGLPSPSYLDGSLAGDNGFDPLGLAEDPENLRWFVQAELVNGRWAMLGVAGMLIPEVLNQAGLINASQWYDAGKSEYFASSSTLFVVEVILFHYGEIRAVAGTSRPPAASNRNPVFKSYSLPAARMRVTGAGSFNRVQIWGPTLRGPREKEPPPTGKAGDSWPFPGRSWKPKPTVTRGRGCPFEKTWV

SEQ ID NO: 85878 - DNA, 879 bp, Zea mays
  misc_feature: Ceres CLONE 1572283
  misc_feature: Encodes the peptide sequence at SEQ ID NO. 85879
  misc_feature (879)..(879): n is a, c, t, g, unknown, or other
ctccccgcggtggcggccgctctagaactagtggatcccccgggctgcaggaattcgtctcacccctagaaaaaacggcgcaaccctacgtccctacctaccttaccgttctgccctcgccttgcccatggagccgcccgcctcctcgccggcaccgccaaaccctaacccagttcccgacgaccggccgctgcagcagcagcaggtggaagaggcgccggcgctggcgccggagccggagcgggagacgtcgccgacgtccctgaccacctcaatcgatcccaccccttccggcggcgaggagagcgagagcgatgactcctcgtcagtctcgtcggcgccctcctccgcctccgctcccgcggccgctgcgcccttccccacggacaaggacctcctccacatctccttcaaccaggactacggctgcttcgcggcgggcaccaagtcgggcttccgcatctacaactgcgaccccttccgcgagatcttcagccggggacctcgccgacgatggcggcggctccggggggagggggtatcggcgtcctcgaaatgttgttccagctgcaacatactccgcgctcgtcggcggccggcaataacccccaactacccgccccaacaagggtgaatgatcctgggaccaccaaccagaagcccggtgcatttgggggagctcttccttcgcgttcccccggggccgagggggtccggcctccgggggcgaaccggcttcaatccgtgggggcttcgaaaaacaaaaatccttccgcctaacaacctttggcgggaacctatagacccccggtggcccccaggattttaggagcgggcccccccaaaaccccaaggggcccctttgggggccctgttttn

SEQ ID NO: 85879 - protein, 168 aa, Zea mays
  misc_feature: Ceres CLONE 1572283
MEPPASSPAPPNPNPVPDDRPLQQQQVEEAPALAPEPERETSPTSLTTSIDPTPSGGEESESDDSSSVSSAPSSASAPAAAAPFPTDKDLLHISFNQDYGCFAAGTKSGFRIYNCDPFREIFSRGPRRRWRRLRGEGVSASSKCCSSCNILRARRRPAITPNYPPQQG

SEQ ID NO: 85880 - DNA, 817 bp, Zea mays
  misc_feature: Ceres CLONE 1572286
  misc_feature: Encodes the peptide sequence at SEQ ID NO. 85881
ctccccgcggtggcggccgctctagaactagtggatcccccgggctgcaggaattcgtctcacccctagaaaaaaaaaatccgcaagtcccactactacagtgcccgccgccgctgcgtccaccaccacctcctttcccaactcctccgcgtacccccgccctctccggcggcccgcgtaaccacccgcgcagatggcgacggcggccacggcgtccgcgacggcgcgacccgcttcacgctcctagcgggcgccggcctccgcagccgcatcacccgcctccccaccgccgtgcggttccagcgccagcgggggctcaccaccaccgcgctcctgaagaccgccgacctccagcccaaggagcagggcaagcccgagacgctcgactaccgcgtgttcctcgtcgacggcgggggccggaaggtgtcgccgtggcacgacgtcccgctgcgcgccggggacggggtgttccacttcgtcgtcgagatacccaaggagagcagcgccaagatggaggtcgccaccgacgaggccttcacgcccatcaagcaggacaccaagaagggcaaccttcgatactacccgtacaacattaactggaaactatgggtacttcctcaaacatgggaggacccaacttctgcaaaatctgagggtgaaggagcatttgggggatatgatcctgttgatgttgttgaaataggtgaaagacgtgccaatgtcgggggacgtttcttagggttaggcactggcagctttagcaatgattgatgagggagagcttgactgggaaaattggtgcccatttctttggatg

SEQ ID NO: 85881 - protein, 86 aa, Zea mays
  misc_feature: Ceres CLONE 1572286
  misc_feature: SWISSPROT Homolog: EC 3.6.1.1 Inorganic diphosphatase
MEVATDEAFTPIKQDTKKGNLRYYPYNINWKLWVLPQTWEDPTSAKSEGEGAFGGYDPVDVVEIGERRANVGGRFLGLGTGSFSND

SEQ ID NO: 85882 - DNA, 1125 bp, Zea mays
  misc_feature: Ceres CLONE 1572287
  misc_feature: Encodes the peptide sequence at SEQ ID NO. 85883
  misc_feature (24)..(24): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
ttttgttttgtccccctccggttntgtttttattttttccattccccaccnnanaannnnnggagaannnnnnaaaaactgggctcccgcggtggcggccgctctagactagtggatcccccgggctgcaggaattcgtctcacccctagaaaaaaggctccatcagtacagatccaccgccaccaccaccaccaagcactccagtcccgcagcagcatggccggcagcgcgtcccgcctcgccatcctcttggtgctcctggcggcgtcaccgctgcttggcgcgacccagaaagccgcgccagggccggcgtcgtcatcgggctcgggcgcgggcgcggcggacgccgcgccccccaccgacgtgaacaagggccctaaaggacgaacccgtcggccaagttcccggccagctgctccacgaaaaccccctccccccccccagaagagggggggggggtggcggacactctaccaacccgccgaaccgtttgtggggggctctatagaggggccgccccgcaccaacggaaacggccggcgccctcccggatgccggtattggcgccgagcgggggagtcccactcccgactgggtagcgcaaccccgcgccggctgcccccgcgcttcccccccccactgaggatgttatccccccccttaaccacataggaccaaaggaaaagggatggacgcgatcgcccttgcgggcgtccgtccccccgccaggcggggaccgccatcccatgtcagatacgcagctgaccccatatcaacaggcgtcgcgcgcggcggagaccgcgaccatcatccacgcctctttctacaccgccaggtggtggtgcctgtccgcgccgcatgagggccagtctccggagtcgcgtcttcactcagacggattagaaataggccaggaggtatatggctgttcacatgcagctcgcgcgagtttatggctcggcgacgcctgattcggggctatacccgttgcaaagtgatgatcattagtgaagagtacgtgatgcggtgccacgccgcgtcactgcccagtagagacccttgaggatctcccgcccacccaatggtcacgcgcaatccgctgtcttttctcgcgcccgagccgc

SEQ ID NO: 85883 - protein, 74 aa, Zea mays
  misc_feature: Ceres CLONE 1572287
MSDTQLTPYQQASRAAETATIIHASFYTARWWCLSAPHEGQSPESRLHSDGLEIGQEVYGCSHAARASLWLGDA

SEQ ID NO: 85884 - DNA, 826 bp, Zea mays
  misc_feature: Ceres CLONE 1572288
  misc_feature: Encodes the peptide sequence at SEQ ID NO. 85885
  misc_feature (826)..(826): n is a, c, t, g, unknown, or other
tggagctccccgcggtggcggccgctctagaactagtggatcccccgggctgcaggaattcgtctcacccctagaaaaaaagcaacccaatccataccagacaagcaaggaatcccccgatggctcatcgcgttctcctcctcctctctctcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggcctccgcgagtcccggcgcgctctcctcatagaactcggggagtcggcgcacgaggcgcccgtgctccccaccgatggtctccccgacgatatcgactggggggaccacggcgccgtcggccccgtcaagaaccagcgttcgtgcgggtcgtgctggtcgttcagcacgtctggagcgctggagggtgcgcactacctcgcaactggcgagctggaggtgctttcggagcagcgtttcgtcgactgtgacacgagtgtgattcatcggagcctgattcatgtaattcgggttgcaatgggtgggcctattgcgaacggcattcagtttatccccccaaaggccggtggcccttaaaagtggagaagggattacccttn

SEQ ID NO: 85885 - protein, 227 aa, Zea mays
  misc_feature: Ceres CLONE 1572288
  misc_feature (48)..(104): Pfam Name: Inhibitor_I29 Pfam Description: Cathepsin propeptide inhibitor domain (I29)
  misc_feature (137)..(228): Pfam Name: Peptidase_C1 Pfam Description: Papain family cysteine protease
  misc_feature: SWISSPROT Homolog: EC 3.4.22.41 Cathepsin F
MAHRVLLLLSLASAAAVAAAVDAEDPLIRQVVPGGDDNDLELNAESHFLSFVQRFGKSYKDADEHAYRLSVFKANLRRARRHQLLDPSAEHGVTKFSDLTPAEFRRTYLGLRESRRALLIELGESAHEAPVLPTDGLPDDIDWGDHGAVGPVKNQRSCGSCWSFSTSGALEGAHYLATGELEVLSEQRFVDCDTSVIHRSLIHVIRVAMGGPIANGIQFIPPKAGGP

SEQ ID NO: 85886 - DNA, 802 bp, Zea mays
  misc_feature: Ceres CLONE 1572290
  misc_feature: Translation starting site: 70
  misc_feature: SWISSPROT Homolog: EC 4.1.1.39 Ribulose-bisphosphate carboxylase
tggcggccgctctagaactagtggatcccccgggctgcaggaattcgtctcacccctagaaaaagactgatggacttaccagtcttgatcgttacaaaggacgatgctatcacatcgagcccgttcctggggacccagatcaatatatctgttatgtagcttatccattaaacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagccatttataaagcacaagccgaaactggtgaaatcaaagggcattactttgatgcgactgcaggtacatgcgaagaaatgattaagagagctgtatttgcaaaggaaataggggttccctattgtaatgcatgactacctaacaggaggattcaccgcaaaaactactttggcccattattggcggcgaacaacggcctaatttctttccattccccgcaacaaatggcatgcattttattggattaaccggaaaaaaccatgggaagggattttta

SEQ ID NO: 85887 - DNA, 810 bp, Zea mays
  misc_feature: Ceres CLONE 1572291
  misc_feature: Encodes the peptide sequence at SEQ ID NO. 85888
  misc_feature (514)..(514): n is a, c, t, g, unknown, or other
  misc_feature (535)..(535): n is a, c, t, g, unknown, or other
ctccccgcggtggcggccgctctagaactagtggatcccccgggctgcaggaattcgtctcacccctagaaaaacattcattcacacaccacacctcccgaactacaagtttcgcttctcgtcgcgacgactgggcgagaccgccgccgccgcctgagttctgtagaaatggctgatggtgaggacatccagcctcttgtctgcgacaatggcactggaatggtcaaggctggttttgctggcgacgatgcaccaagggctgttttccctagtattgttggccgtcctcgccacactggtgttatggtagggatgggacagaaggatgcgtatgttggcgacgaggcacagtccaagagaggtattctcacgctcaagtatccgatcgagcatggtattgtgagcaactgggatgacatggagaaaatctggcatcacactttctacaacgagcttcgtgttgccccagaagagcaccctgtgttgctcactgaggctcctttgaaccaaaggnctacagggagaagatgacccngatatgttcgagactttttcatgtcctgccatgtacggtgcaaatcaagcagtgctgtcactctatgccagtggacgtactactgggatttgttctccaatctggtgaatggggtgattcaaactgggccccatttattgaaaggaatggcccttcccccatggccattttttcgtctgggatttgggcggggcggggaccttcaaaaaattccccctttgaaaatttctccccgggaaagggggttttttcctttcaaaaccccttgtgcggga

SEQ ID NO: 85888 - protein, 120 aa, Zea mays
  misc_feature: Ceres CLONE 1572291
  misc_feature (4)..(121): Pfam Name: Actin Pfam Description: Actin
  misc_feature: SWISSPROT Homolog: EC 2.7.10.2 Non-specific protein-tyrosine kinase
  misc_feature (116)..(116): Xaa is any aa, unknown, or other
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNQRXTGRR

SEQ ID NO: 85889 - DNA, 816 bp, Zea mays
  misc_feature: Ceres CLONE 1572292
  misc_feature: Encodes the peptide sequence at SEQ ID NO. 85890
ggagctccccgcggtggcggccgctctagaactagtggatcccccgggctgcaggaattcgtctcacccctagaaaaattcgaccattccatcctttccttatcccctcccacttcgtctcccttcctggcttcctttcttcgccatggcaaccatgtccctccgctccctcgccatggccatggccgacaccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaggaggagaaggccggagagcccgtcaacatggaagctggggagtttgaggaggtgctagcctcaggcggcgagggtgaggggcagtacgctgcggtggagccgccagaggaggccaaggtctacgttgggaaccttccctacgacgtcgacagcgagggactcgcgcagatcttcgaccaggccggcgtcgtcgaggtcgccgaggttatctacaacagagaaactggccagagccgtgggtttggctttgttaccatgagcactgttgaggaagctgacaaagccattgagatgttcaaccgctatgataatagcggggaggctttctgaatgtaaacaggccaatcttctaggggcactcgcaatggaaagacctcagagaacgattggcaccagctttcagaacctaagttgggccacttggccagggaaaagttgatgactccaaggctgttgccatt

SEQ ID NO: 85890 - protein, 169 aa, Zea mays
  misc_feature: Ceres CLONE 1572292
  misc_feature (100)..(170): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAMADTALPPAHKLLPTVSLPLLSSSTRAAPLLLFARRRLPLAPLVTSSDAVEAKSADEEEEKAGEPVNMEAGEFEEVLASGGEGEGQYAAVEPPEEAKVYVGNLPYDVDSEGLAQIFDQAGVVEVAEVIYNRETGQSRGFGFVTMSTVEEADKAIEMFNRYDNSGEAF

SEQ ID NO: 85891 - DNA, 1248 bp, Zea mays
  misc_feature: Ceres CLONE 1572295
  misc_feature: Encodes the peptide sequence at SEQ ID NO. 85892
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (1087)..(1087): n is a, c, t, g, unknown, or other
  misc_feature (1230)..(1230): n is a, c, t, g, unknown, or other
aaaaaaacctaacctatgtcaaaccactcgccccgaccacattcaagcccgccccacacaacnnnccaaaaaaaaaactggaactccccgcggtggcggccgctctagaactagtggatcccccgggctgcaggaattcgtctcacccctagaaaaacgaaacctatgccacatccagagccaaagcctgaacctcaaccaaagcccaaccctgaacctcaaccaatgcccaagcctcaaccaaaatccaaaccagagccattgcctacaccgaagcctgaacctaagcccgaacctaagccagagcctaagcccgaacctaaaataaaaccaaagccaaaacctgaaccaaaaccagagcctaagccagagcataaacctgagccaaagccagagcctaaacccaaaccgaaaccagagccaaagccagagccacaaccaaaaccagagcctaagccagagcctaaacccgaaccgaaaccggagccaaagccagagccccaacctaagccagagcctaaggcctgagccgaaaaccagaacaaaagccaggaaccccaaaccaaacccctgaagccttaaaaccagaaaccaaaaaaccctgaaccccaaaggcccgaaactcttaaaacccccgaaacccaaaaacttcagaaagcccataaagcacttggaggccccttaacacctccgaaaacccaaggggcccacaacaaccctaaaaagaccaaagaaagcctctaaatagatccccttgaaaaaccccccacaataccccttaaaaaacccccccggcaattccccccaataaaggccccacagggaaagatcgcccctcccttaaacccccataaaggacaccccaagtagagaatctctcatacaagcgctcccagggaaaaacctcccaaaaaacccccttcaacaaagagccccaaaaaaagaccccacccgaataagacctctataaagaccccccgcagaaagcaacctacaaagaccactggaaaaaaagcctaaaaaaaggcaacatggagaagaccccctacacaaacccccccgctataaaccccccggcgcccacttnggaaaacaccccagtgaaaaccacaattgatatccccatggggaaaccctcttttacagactccctcgaaactcccaaagaaacaccccgaagcaagtcctcaataagctaaggaggatgaccacactaaactaccacaaggncaaccgaaaaccctaaaa

SEQ ID NO: 85892 - protein, 120 aa, Zea mays
  misc_feature: Ceres CLONE 1572295
MPHPEPKPEPQPKPNPEPQPMPKPQPKSKPEPLPTPKPEPKPEPKPEPKPEPKIKPKPKPEPKPEPKPEHKPEPKPEPKPKPKPEPKPEPQPKPEPKPEPKPEPKPEPKPEPQPKPEPKA

SEQ ID NO: 85893 - DNA, 1068 bp, Zea mays
  misc_feature: Ceres CLONE 1572296
  misc_feature: Encodes the peptide sequence at SEQ ID NO. 85894
  misc_feature (30)..(30): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
gatgtagtgtgaaggagattttctcctccncctcggcgccacaccccactgcaacacaaaagaaannnaacacaaaaaaaaaaatgggactcaccgcggtggcggccgctctagaactagtggatcccccgggctgcaggaattcgtctcacccctagaaaaaggagctctaccaccgtccaccatcaccgcctcgtgtgcagcgtgctcgctcacctcctctgtcgacgcaccaccccgaagcccccccgccgcgctcgcagggtgttcgacccttcgcccgcgcgccctcacgacatggcctcctccgtctccgccgccgccaaggccgccgcggcgttcgcgcacaatgtccagaaggagctggccgcgccggcgcagcgccgcgcgggcttgacccgccggaccaagccgtgcaacgtgcgcgccgtcgcttcgcccgcgcgcgccctgtcgtccaccggcttccgtgaaaacccccatgaccataacggaaaaaaatactggcccccgggcttcgaaaccccgccggggtttggaaccccggggaaaaaactgtgggggtccaaccctcaacactgcttactgaacgccccaaaagttttgggggggcccgggggccccttttcaaaatattttaaaaaaaaaggaaacccccggggagagaaaaaccccccggagctcttggggaacccccccaaaaaaaaactccctccccgtgtttttcccccggaagacaccctttttatttttttgttctccataggggggaaaaacaacacgggggcaaaaaaccttaaaagggggtagaaaaattcttcctggggggagattttcttgtggggcgggggggaaaaaaaaaaatcccgggcctctttttttataaaagacaaacaagggaggccccccccccgcataattttgggggggggtataactcccggcccacccaacaaagggagtggtggggcaccacattttctagtttgtttcttcaaaagaagaaacttctctccacacaaaagaggagagagggttttttatggggcaaagagtaattacacccac

SEQ ID NO: 85894 - protein, 170 aa, Zea mays
  misc_feature: Ceres CLONE 1572296
MASSVSAAAKAAAAFAHNVQKELAAPAQRRAGLTRRTKPCNVRAVASPARALSSTGFRENPHDHNGKKYWPPGFETPPGFGTPGKKLWGSNPQHCLLNAPKVLGGPGGPFSKYFKKKGNPRGEKNPPELLGNPPKKKLPPRVFPPEDTLFIFLFSIGGKNNTGAKNLKRG

SEQ ID NO: 85895 - DNA, 818 bp, Zea mays
  misc_feature: Ceres CLONE 1572299
  misc_feature: Encodes the peptide sequence at SEQ ID NO. 85896
ccccgcggtggcggccgctctagaactagtggatcccccgggctgcaggaattcgtctcacccctagaaaaacttctctcgcctgcctctcccccgccgcgccgccacttcccctctcccgtcaactccggcttccgcgcgaggtcgagctagcgtttggagttctcgagacctgctgtgatggcgacagagcaagcggcggagaactacacggtggaggacctcgtggccctgaacccctacaaccccgacatcctcaacgacctcgagaagttcgtcaatgagcaggtctcatctcagacatataacttggatgcaaatctcagccttcttcgcttgtaccagtttgagccagaaaggatgagcatacagaatttgtgggccccaccatactgatttaaggctcttcatgggcaatgcccagccccctgacttcaggtttggggcttaattccttaaatccccggaaacctgggggccaaatggggagggagccaatttccaggggtatttggaaaggtttttttttccccccttacccctaaaagaaccggccttggggttccaaggcccaattttttggggggttggaaaacccccccaaaaaaaacacccgcccccccttttttctccgaaaaaagagagggggggccccacggtgttttttccgcaaaaaaaaggcgccaatatccgcaaacgtcccctttaaggtggggggagaattcctggggggggggctttttttccccccggggggggagaatgatacaccggaggaaagaaaatgttttttctacacggggggggggccctttttt

SEQ ID NO: 85896 - protein, 71 aa, Zea mays
  misc_feature: Ceres CLONE 1572299
MATEQAAENYTVEDLVALNPYNPDILNDLEKFVNEQVSSQTYNLDANLSLLRLYQFEPERMSIQNLWAPPY

SEQ ID NO: 85897 - DNA, 986 bp, Zea mays
  misc_feature: Ceres CLONE 1572300
  misc_feature: Encodes the peptide sequence at SEQ ID NO. 85898
gcggtggcggccgctctagaactagtggatcccccgggctgcaggaattcgtctcacccctagaaaaaagaccggacgcccttccactttccccttcccttcccttgcattcgcgcgttgtccacctcccatcacgacctcttcctgacgtttccccaattcctccgcgctaagcagagcaacagcgatggcgacgaagtacgctgccgccgcggctgatctggtcacgggccgtccgcggaagcgggcgaggcttggctgggacgtggcgtcggctgccgagataggaacattttgtgggcaagaagttggtgatgtggccagcctgctattatcagcaaatccttccgaccatacttgatcgtctctgctcccgaagggtgtggctcgaaatgctgcccctccctggagagaagacgataaagatgggcattatgtatttgctgcacggagagaatttggccctcgtcgctgcgggagatacaaaaaaaatggggtgaaagggtattttttgggtcatttccttgggaaatgttgggggaaccccagaaaaggcaaagaaaaagcggtgggcctataaaaaaatttgttcccgcctccgggtgaaaagaaaattacaggggaattggccgtccaaagtgtgatgggaaaaatttgcattgttcccttgggcagaaagtgctttgtgcaaaaaaacaatgaatggtgtggcaaggggcaaaaccattttgttgtggtcccaaataaccggggaaccggggggtttgggagcaattccgttaggccaataaatttggctctttgggccgggcaaaaaaaagcctgtgggcctcacaggctctataaaggaattgttttctggctaagaaaaaacgggggggttttccaatctcatttctcccaaaattaatctaaatatttcctcccgggatatggaaacaggcaaaactttttggaaacaccgagtgggaaatcccactgactag

SEQ ID NO: 85898 - protein, 57 aa, Zea mays
  misc_feature: Ceres CLONE 1572300
  misc_feature: SWISSPROT Homolog: EC 2.7.12.1 Dual-specificity kinase
MATKYAAAAADLVTGRPRKRARLGWDVASAAEIGTFCGQEVGDVASLLLSANPSDHT

SEQ ID NO: 85899 - DNA, 831 bp, Zea mays
  misc_feature: Ceres CLONE 1572301
  misc_feature: Encodes the peptide sequence at SEQ ID NO. 85900
caccgcggtggcggccgctctagaactagtggatcccccgggctgcaggaattcgtctcacccctagaaaaaatcccatcctgatctctcctcccttcttcagtgcagcagcaggccagcggcacgccacccgcctcactcccgcctccgatccgctgcttactcgccacccggagatggccaccgccgccgccttctccgtctcctcgccggcggcctccgccgtcgccgcgcgatccaaggtgtttggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatccaggactggttgctacacttcagcctctctcgggcactggatcactgcgtctcgctgcagcattcatacaaagatactttcctgaagctaaagtgctgatatcgtcgcctaactgggggaaccacaaggaatatctccaatgatggctagggtaccttgggtcaaaagaaccgggtattatgacccccaagaccggttggggttggattc

SEQ ID NO: 85900 - protein, 195 aa, Zea mays
  misc_feature: Ceres CLONE 1572301
  misc_feature: SWISSPROT Homolog: EC 2.6.1.1 Aspartate transaminase
MATAAAFSVSSPAASAVAARSKVFGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLLGADNPVINPGLVATLQPLSGTGSLRLAAAFIQRYFPEAKVLISSPNWGNHKEYLQ

SEQ ID NO: 85901 - DNA, 853 bp, Zea mays
  misc_feature: Ceres CLONE 1572302
  misc_feature: Encodes the peptide sequence at SEQ ID NO. 85902
  misc_feature (479)..(479): n is a, c, t, g, unknown, or other
ctccccgcggtggcggccgctctagaactagtggatcccccgggctgcaggaattcgtctcacccctagaaaaaatttccattctcacccgtccatcccttctccgaagctcctcggcagacaagcagcagcgagagaaagcaagcaagggagacgctgttgtgttgctggtcggtgcgtcgcatgggacccaacagaccactgtctgcggcgacggccgcggaacaatccacgctacgcgggctacggaagcggccgtggggaccgtacgcagcggatatccccgacccgatgcggagcgctcgcttgtggctgggcaccttccacaccccgagatcacggagcgcgggagtaccacgccgatacgcgctggctccgcgcgcgcgtgtccgccgacaactacaccgtcccggagacgacggaggaggaggtggtcgacgctccatcggccagcgtgagcgcgagcgccttggtgtacnaggagtcgtccgcgtccgactccgcctagtcgtgctagctcgcgctggtcgccgcgtcgctggacatcttcctggaggtgccggttgacgtacgcgccaaccaaacttgctgctgtttcagagaccccgtcgcgtctggcgctgtgacgccggggctgttgcactttcttgcgggctaccagcgaggacgggcgacagcttcttatggggtcgtcgtacccggttcttcctcggcgggcatctttaaaagttctacggggttgccccaacaaggggtcatgcgcgttggagcaacaatcatggggaatgaaccccgggcaaaaaacgggcaatgccaattttcttcccctcctaggagggcttattcgtattgg

SEQ ID NO: 85902 - protein, 127 aa, Zea mays
  misc_feature: Ceres CLONE 1572302
  misc_feature (99)..(99): Xaa is any aa, unknown, or other
MGPNRPLSAATAAEQSTLRGLRKRPWGPYAADIPDPMRSARLWLGTFHTPRSRSAGVPRRYALAPRARVRRQLHRPGDDGGGGGRRSIGQRERERLGVXGVVRVRLRLVVLARAGRRVAGHLPGGAG

SEQ ID NO: 85903 - DNA, 782 bp, Zea mays
  misc_feature: Ceres CLONE 1572303
  misc_feature: Translation starting site: 444
  misc_feature (1)..(1): n is a, c, t, g, unknown, or other
  misc_feature (25)..(25): n is a, c, t, g, unknown, or other
  misc_feature (121)..(121): n is a, c, t, g, unknown, or other
  misc_feature (209)..(209): n is a, c, t, g, unknown, or other
  misc_feature (250)..(250): n is a, c, t, g, unknown, or other
  misc_feature (263)..(263): n is a, c, t, g, unknown, or other
  misc_feature (325)..(325): n is a, c, t, g, unknown, or other
  misc_feature (340)..(340): n is a, c, t, g, unknown, or other
  misc_feature (348)..(348): n is a, c, t, g, unknown, or other
  misc_feature (374)..(374): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (437)..(437): n is a, c, t, g, unknown, or other
  misc_feature (443)..(443): n is a, c, t, g, unknown, or other
  misc_feature (449)..(449): n is a, c, t, g, unknown, or other
  misc_feature (475)..(475): n is a, c, t, g, unknown, or other
  misc_feature (476)..(476): n is a, c, t, g, unknown, or other
  misc_feature (487)..(487): n is a, c, t, g, unknown, or other
  misc_feature (507)..(507): n is a, c, t, g, unknown, or other
  misc_feature (508)..(508): n is a, c, t, g, unknown, or other
  misc_feature (510)..(510): n is a, c, t, g, unknown, or other
  misc_feature (532)..(532): n is a, c, t, g, unknown, or other
  misc_feature (535)..(535): n is a, c, t, g, unknown, or other
  misc_feature (553)..(553): n is a, c, t, g, unknown, or other
  misc_feature (554)..(554): n is a, c, t, g, unknown, or other
  misc_feature (585)..(585): n is a, c, t, g, unknown, or other
  misc_feature (743)..(743): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
nccctggcccccgctctaaaactantggatcccccgggctgcaggaattcgtctcacccctagaaaaaatcccctcagtcctcagtccctcacacactcactatacactgctctgctgcancaagaaggaagaagctagcgcctccctagctgctcgttctcatcaatggccaccaccgccgcgtccagcctcctcaagtcctccttcncgggctcccggctcccttctgccacgcgcaccaccaccccntcttccgtggccntggccaccccacgcgccagcggcggccccatccgcgcgtccatctcctccccccccaccccnccctacaacctgacntccttccngttcacccccatcaaggagtccatcntgtccctcaagatgacccnncnctacctcacagacatgatcacccacgccgacaccgacttcntgatcnatggcncccggttccccccggcctgtcctgcnncttacaaactntcccaaggaccccacccttnnancttggccccatctttggaaacnaantccccttttttccccccnnctctttcccccccccttttttctttttttcnggcaaactttttttctccccccccccttttttttttttccctaattttccccgggggcccccccctttttttttttttttataaaaaaacacttttaacccctgggggggtttttttaaaaacaaaaaccctctcaaaaaaacaaaacaacacctatnttnnnctatagattttaggtcagaacccccgcccccccg

SEQ ID NO: 85904 - DNA, 823 bp, Zea mays
  misc_feature: Ceres CLONE 1572307
  misc_feature: Translation starting site: 155
  misc_feature: SWISSPROT Homolog: EC 2.7.10.2 Non-specific protein-tyrosine kinase
  misc_feature (682)..(682): n is a, c, t, g, unknown, or other
cgcggtggcggccgctctagaactagtggatcccccgggctgcaggaattcgtctcacccctagaaaaactacaacgagcttcgtgttgccccagaggagcaccctgtgttgctcactgaggctcctttgaacccaaaggccaacagggagaagatgacccaaattatgtttgagactttcaatgttcctgccatgtatgttgcaatccaagcagtgctctcactctatgctagtgggcgtactactggtattgttcttgactctggtgatggtgtgagccacactgtgcccatttacgaaggatatgcccttcctcatgcgattcttcgtttggatcttgctggtcgggacctcacagactccctcatgaaaatcctgactgagaggggttctccttcacaacctctgccgagcgagaaattgtaagggacatcaaggagaagctggcatatatagctcttgactatgagcaagagttggaaactgccaagaacagctcctcagttgaaaagagctatgagctacctgatggccaagtaatcaccattggtgcagagagattcagatgccctgaggtcctcttccagccatccatgattggtatggaggctgccggaatccatgagacaacatacaattcaatcatgaagtgcgacgtggatatcagggaagacatctacngcaacattgtgctcagtggaggttcaactatgtttccctgaaatcgctgatcgtatgagccagggagatcactttcctttgcccaagcagcatgaagaatccaggtccgttgcacgccctgaaaaggaaatataatgttcc

SEQ ID NO: 85905 - DNA, 1002 bp, Zea mays
  misc_feature: Ceres CLONE 1572308
  misc_feature: Encodes the peptide sequence at SEQ ID NO. 85906
  misc_feature (75)..(75): n is a, c, t, g, unknown, or other
taatatataaataaaaaaagacaaaccaaagaccctaccacatatgctagcaacccccccccccacctcttcatngtcctacaaaaaaaaaaatggaactccccgcggtggcggccgctctagaactagtggatcccccgggctgcaggaattcgtctcacccctagaaaaactggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggaagaacgccgttgagggcgcccgcagaggcgaagctgaaagtggcgatcaacggcttcggccgcatcggccgggaactccctcgggtgctggcacgggccccaaggactcgcccgaatcaacgtcctccgttcgggaaacgaaaagcggaaaggcgttcagggaacgcggtcccaaccctccttcaagtaaccaaactccaaatgcctccgggcacccctttcaaaggggcccaaacccttcaaaaaaaatttggggggaaaaaaaaacccgaccccctttttttgggggtttcaaaaccggggaaaaacccccccatttacagggggggggtgttttctccccaagaaagggggaaccccccccctctaaaaagctccccccaagggggggggggagaaaaccctccgcgcgcaattttaaacaacatccgtccacaatccagagaagggggcacccccgcggaaaatctttttttttttttaaaaaaaaagggcccccccgggggggccccctcggcgaaaaaaaaaaacttcttcttgggtggcccgggcgggggacacaaaaaaaaaaaat

SEQ ID NO: 85906 - protein, 75 aa, Zea mays
  misc_feature: Ceres CLONE 1572308
  misc_feature: SWISSPROT Homolog: EC 1.2.1.13 Glyceraldehyde-3-phosphate dehydrogenase (NADP(+)) (phosphorylating)
MATHAALAASRIPAGARLHSRAPASSRHGVQRLDFADFSGLRPGSCSVSAAAREASFSDVLGAQLVAKATGEERR

SEQ ID NO: 85907 - DNA, 835 bp, Zea mays
  misc_feature: Ceres CLONE 1572309
  misc_feature: Encodes the peptide sequence at SEQ ID NO. 85908
  misc_feature (810)..(810): n is a, c, t, g, unknown, or other
ccgcggtggcggccgctctagaactagtggatcccccgggctgcaggaattcgtctcacccctagaaaaaattgccgcaggtcgcatcccagcagggggcggtctacgcctccaggcaggcacgtccttgtttctgtctgaggtaatcgcctccgcaacttcgtggacggtgaggtcgcagcatcatggagtcactcctagcccaggatgcagttcacgcacttctcgcgaggcaaacggcgcacctcgtgccggacgcctccgcgatgcaagggcacctccgtacatacatgaacgcggggattcccaagcggttcaaagaggataaggagaaagaacagcttgcaaaaaatgtaacataagattggaatgctgtgtttgaaaggagcatcaatacattgtttttgactgaaatggtccgtggctagatgctaactatcaagtacttctttgatagagatgtcacaattaactatacgtttgagaagggtcctctgagccactcgctgcttggagagcatgctctcacacgttatgaatctagggaacagcgctgcattgcttgtaaactatgctaagctatatgctcagcgcaggcaattacaattgtacgctgaagaacatgtagatgtcaatctccgaaacaaagatatgatattgacatgaccaaatgcatttactgtgagttcatgtcaagacgcttgcccagaacgatactattgctgatgcgcctaacggttgagtattgcactgaatactcacgagggactactgtacgacaacgtacaactgcttgaacaactgagatcntctgggaagactgacattgctaaaa

SEQ ID NO: 85908 - protein, 58 aa, Zea mays
  misc_feature: Ceres CLONE 1572309
MESLLAQDAVHALLARQTAHLVPDASAMQGHLRTYMNAGIPKRFKEDKEKEQLAKNVT

SEQ ID NO: 85909 - DNA, 920 bp, Zea mays
  misc_feature: Ceres CLONE 1572311
  misc_feature: Encodes the peptide sequence at SEQ ID NO. 85910
  misc_feature (920)..(920): n is a, c, t, g, unknown, or other
ctccccgcggtggcggccgctctagaactagtggatcccccgggctgcaggaattcgtctcacccctagaaaaactctagtctcttttcttctctggtctcgcgttctccctcctctgttcgccgctttataccgcccgcccgcccaccagaacgacatacatcctcctcccccgtcccctccaatggggaacccgccggagctgtaccacaagatcctcaacatccccaaggacacctctccgcaggaactccgcgccgcgtacaagagcctcgtcaagaaatggcaccccgacaagcacccgccgtcgtccaggccggaggccgaggcgcgcttcaaggccatcagcgaggcctacgaggcgctcctggaccagcaagagaacagggccgtgttcgggccgtgcaacggcgaccgggcggggtggaaggctcccgggcccccctttgtaaaggaacccgcccataaccggtttcttgccctaaggaagggcggccccgggcaccccgggccaaggggatgtaaaaaaaaggggggtaaatgggccccaggtcaacccccccgtgcgggggggccctcaaaccctttttcaggggaaattcttcacctcatttcccacgatttaggggggcaaacagggtggcgccacccccactcggagaagccgcaaagggcctctcaaagaggatcaccccacttagaagggaaatatgttctactcgtcggtgaatgcccccccctaagagggggggaccagctttctctaacacgcacgcagattttcgtaccccccccggaaaacagggggcccgcttcccctgtagaagaaggagaagtgcggccgcacccaataccttcgagcatggggacgaggccgccagggctggagacgagaaatgggacaaacaggacgggggggn

SEQ ID NO: 85910 - protein, 245 aa, Zea mays
  misc_feature: Ceres CLONE 1572311
  misc_feature (7)..(72): Pfam Name: DnaJ Pfam Description: DnaJ domain
MGNPPELYHKILNIPKDTSPQELRAAYKSLVKKWHPDKHPPSSRPEAEARFKAISEAYEALLDQQENRAVFGPCNGDRAGWKAPGPPFVKEPAHNRFLALRKGGPGHPGPRGCKKKGGKWAPGQPPRAGGPSNPFSGEILHLISHDLGGQTGWRHPHSEKPQRASQRGSPHLEGKYVLLVGECPPLRGGDQLSLTRTQIFVPPPENRGPASPVEEGEVRPHPIPSSMGTRPPGLETRNGTNRTGG

SEQ ID NO: 85911 - DNA, 1131 bp, Zea mays
  misc_feature: Ceres CLONE 1572312
  misc_feature: Encodes the peptide sequence at SEQ ID NO. 85912
  misc_feature (18)..(18): n is a, c, t, g, unknown, or other
  misc_feature (19)..(19): n is a, c, t, g, unknown, or other
  misc_feature (44)..(44): n is a, c, t, g, unknown, or other
  misc_feature (53)..(53): n is a, c, t, g, unknown, or other
  misc_feature (68)..(68): n is a, c, t, g, unknown, or other
  misc_feature (79)..(79): n is a, c, t, g, unknown, or other
cgggatggtttacccgcnncagggagcaaccaaaaaatttaaancattagggnctcggggagcaatcntacaaagcggnactccccgcggtggcggccgcactacaacagaggatcccccgggctgcaggacaccaacgcggccctagaaaaagcgtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctggcggggtacttgctggtgccacggccatctggctccaattcgaggacatggagtaccatctcctcaccttgggggtgccaccgggcccaaccatcccgcggggccagacctcttcccggggggcccaaaggcccgccaccgtaccatcacacaaagggccccgacccgaaacaattccccgggagggggcaaaaaatcccccgggaagggaaggggggggcgagggtaaaaaggaaaggccaccccggcgcacacgggaagaaaaacaggaggaaaccaaaccacgggggggcagatatgcgcaaacccagaaaaagaggggaagaaaatggggggacaagagggccagaaggagatctttgggaaaggaagaagtccccgagagaaatgggtttaaactgtgcggagggagccctccggggggggtgcacgcagcgcacagaacaacatcccccgacggaaagacccgccccttggccaaaacccatgtcccgcaggagacaggggaggagcggccagaagacctaaacgagcacgagggcggcgaggcccaaccagcacaagaagaaagagagcacaccccccgacatctactggtccaccgagcgaagaaaaagaagatccggc

SEQ ID NO: 85912 - protein, 293 aa, Zea mays
  misc_feature: Ceres CLONE 1572312
MADHKEEPVPESVMDKITEKFHGGDSSSSSSDSDDEKKGSSLASAAEAMKAKIYRLFGRERPVHSVLGGGKPADLILWRNRKISGGVLAGATAIWLQFEDMEYHLLTLGVPPGPTIPRGQTSSRGAQRPATVPSHKGPRPETIPREGAKNPPGREGGGEGKKERPPRRTREEKQEETKPRGGRYAQTQKKRGRKWGDKRARRRSLGKEEVPERNGFKLCGGSPPGGVHAAHRTTSPDGKTRPLAKTHVPQETGEERPEDLNEHEGGEAQPAQEEREHTPRHLLVHRAKKKKIR

SEQ ID NO: 85913 - DNA, 876 bp, Zea mays
  misc_feature: Ceres CLONE 1572313
  misc_feature: Encodes the peptide sequence at SEQ ID NO. 85914
ccccgcggtggcggccgctctagaactagtggatcccccgggctgcaggaattcgtctcacccctagaaaaagcgtatgctggcgtcaccatcgcgtcaagggctgccagcgggtcccgccgtttgtgaccgtgctttgcggccaactcactgacgccatcgagagcgaaagctgacgcaagacgaacgaagagcctgtgccggagtctgtgatggacaatatcaccgagaagttccacggcggggactcgtcgtcgtcgtcttctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctggcggggtacttgctggtgccacggccatctggctcctattcgaggtcatggagtaccatctcctcaccttggtgtgccactgtctcatcctctcgctggccatcctcttcctgtggtccaatgcctccactttcatcaacaagtccccaccgaacattcctgaggtcaaaatccctgaggatgtggctgttaatgttgccctgtcactgagatatgaaatcaacaggggcttttgctacctttaggggaagattggggcatgggccgtgatcctgaaagaaattccctaaattggtaatttgcaggttctcctgggctttccttttcaggttccttcggggaagcctggcttgcaaaacttctccctggaacagcggggttacttaataatttggccccctttgtgtggggcacctttttttacaaccctgggattacccccgagttttt

SEQ ID NO: 85914 - protein, 152 aa, Zea mays
  misc_feature: Ceres CLONE 1572313
  misc_feature (59)..(152): Pfam Name: Reticulon Pfam Description: Reticulon
MDNITEKFHGGDSSSSSSDSDDEKKGSSLASAAEAMKAKIYRLFGRERPVHSVLGGGKPADLILWRNRKISGGVLAGATAIWLLFEVMEYHLLTLVCHCLILSLAILFLWSNASTFINKSPPNIPEVKIPEDVAVNVALSLRYEINRGFCYL

SEQ ID NO: 85915 - DNA, 857 bp, Zea mays
  misc_feature: Ceres CLONE 1572315
  misc_feature: Encodes the peptide sequence at SEQ ID NO. 85916
ggagctccccgcggtggcggccgctctagaactagtggatcccccgggctgcaggaattcgtctcacccctagaaaaagacgcgtctcttccacagccgcaacctctatccctcgtctggtatcgtctcccacacccctctgccccaactcagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcacaagctgcaccgccagtggaccttctggtacgacatccagtccaagcccaaacccggcgctgcatggggcacctccctcaaaaaggcgtacaccttcgacaccgtcgaggagttttggggcttgtatgatcatgttttccgtccaagcaagttgcctgggactgctgattttcacctattcgaggctggagtagagccaaaatgggaagacccagagtgtgcaaatggtggcaaatggactgtcccatgcaacagaaagccaacctttgagaccatgtggcttgaaacgttgatggctcttgttggggagcaggttgatgaaacagatgacatttgtgggattggtgccaatggccgtcccaagaggagaaaaacttgcattggggaactaggactgccagcaaataaagctgtcccaggtaaaactttggccaggaaatgggaagggaggtccatgcacattcaatggaaaaaaatccaatctaacccttttccagaggaacgaacctcccaaaaaggggtttaaacccccaaacccaaaagggtgggaagggggatcaccccggggggta

SEQ ID NO: 85916 - protein, 208 aa, Zea mays
  misc_feature: Ceres CLONE 1572315
  misc_feature (6)..(203): Pfam Name: IF4E Pfam Description: Eukaryotic initiation factor 4E
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFEAGVEPKWEDPECANGGKWTVPCNRKPTFETMWLETLMALVGEQVDETDDICGIGANGRPKRRKTCIGELGLPANKAVPGKTLARKWEGRSMHIQWKKIQSNPFPEERTSQKGV

SEQ ID NO: 85917 - DNA, 866 bp, Zea mays
  misc_feature: Ceres CLONE 1572319
  misc_feature: Encodes the peptide sequence at SEQ ID NO. 85918
ctccccgcggtggcggccgctctagaactagtggatcccccgggctgcaggaattcgtctcacccctagaaaaaacgacgcgccagatccgcgcagcagtggtgtcctccgccgcggatcgagctcccgatccgcgcagtgggagtggcggcgagcgcaggagcgctcggccgggggttccgcaaggctggagacggaggaggaagggagcggtagttccgcggtggtagatccgccggtcctgtcgccggagatggactcatctgtcgagaagcaggggagcgtggcgctggatccggacgagcgcgcgccggcgtccggcgaaaccaaggcctgcaccgagtgccacaccaccaagaccccgctctggcgcgggggaccctgcggacccatgtcgctgtgcaacgcgtgcgggatccggtaccggaagaagagacgggaggccatgggcctcgagtccagcagcaaggccgccaccgccggcggcagcgagcaccagcagcagcagcggaagaagaaggccaccgcggcggcggccgccgcctcctccaagcgggagagggagcgggaactggagcggaacaaggaggcggacgaggtcaccgtggagctccgcgcggtggggttcggcaaagaggtggtgcctgaaaccaccggcggcggatgccggcggaagcgcccccctggggcaaaggaaggaacccgcggccatccctggctcatgggcgcctctccctccgggcgtccgtggtaccacctggacttggggcttagcaaacccggcgcccgggcccccccaaaaaacgcccgccggcccacaaagggggcggccgaaaaaagagaacaaggggggggcccccaaattc

SEQ ID NO: 85918 - protein, 204 aa, Zea mays
  misc_feature: Ceres CLONE 1572319
  misc_feature (28)..(63): Pfam Name: GATA Pfam Description: GATA zinc finger
MDSSVEKQGSVALDPDERAPASGETKACTECHTTKTPLWRGGPCGPMSLCNACGIRYRKKRREAMGLESSSKAATAGGSEHQQQQRKKKATAAAAAASSKRERERELERNKEADEVTVELRAVGFGKEVVPETTGGGCRRKRPPGAKEGTRGHPWLMGASPSGRPWYHLDLGLSKPGARAPPKNARRPTKGAAEKREQGGGPQI

SEQ ID NO: 85919 - DNA, 824 bp, Zea mays
  misc_feature: Ceres CLONE 1572321
  misc_feature: Translation starting site: 297
ccgcggtggcggccgctctagaactagtggatcccccgggctgcaggaattcgtctcacccctagaaaaagagagccgccactcactgagatagagaccggctgcccgaccccggtacggcaatccctatgaacccctttatttgcgctgccagccccaatctctcgcatccctgtcaaccatggcggcgtcaccacgcggaggagcggtgcgcagcgctgtatcagaaggagcaggacatacagatgatgatcgcggtctgaatccaactcggcaccaagaactgctaattccagatggagcggtatgtctgtaagagtcggaccgacagcatctacatcatcaaccggcgcaagacatgggataagctccagctcgcggccagggctattggtggcattgagaagccgcaagacatcatcctccagtctgccagcccctacgggcagagtgctgtccgcaagttcgcggactacactagtgcccatgcgatcgctgggaagcacatccctagtacgttcaccaggcagctccagacctcattcatcgagtctcgccatgatcatccttagtgagaccaggactgaccatcagcccatcaaggactctgctctggcgaacatgcccagcatttgccatctgccacgatgactctgacgtgcgatatgtcgatatcgggatcccagccgaggaacatgtggaggaacagaattggaaagcttgaactaggcattgtgaacaagaaagagtctgcaaaatgaggggcactgattcctcccgggggaccaatgggggaaagcccggtccggaactggtccctaaag

SEQ ID NO: 85920 - DNA, 785 bp, Zea mays
  misc_feature: Ceres CLONE 1572323
  misc_feature: Translation starting site: 605
  misc_feature: Pfam Name: DUF568 Pfam Description: Protein of unknown function (DUF568)
  misc_feature (754)..(754): n is a, c, t, g, unknown, or other
ccccgcggtggcggccgctctagaactagtggatcccccgggctgcaggaattcgtctcacccctagaaaaagcaagaacagagcgaacagaggactgaagcagagcgagcgagctgtccggccaaaccctcacggccgcctccacaatgccgcgccatctcacgctgctcctgcccctgctcctgctggcctcgccagcggccacgcgactggcgtccgccgcctgcgcgggcgagaaattcccggcggggcgtgcgtacacgtcgtgcgaggacctgcccaagctgggcgcgtctctgcactggacgtacgacgcgtccaagaactccctgacggtggcattcatggcggagcccgcagcggcgggcaggtgggtggcgtggggcctgaacccaacaggcgatggcatggccggcgcgcaagcgctggtgagcgctggcgggggccggggccgcggcgcccaccgtgcggacgtacaacatcacagggtacgtcccgctgggcaaagactccacgcctctggacttcccggcgaccgacctcgccgcggacgccgcgggcggcaagatccaggtgtacggcaagctgcatctgctcaaagtgatgaaggccgtgaaccaggagtggcaggtcagcgcgtcctccacgtgcggcgcccccgacaagcacgcgttccaagcggacaacctcggcgcccagagcaagctcgtcctcgcctgcaagccacccgcggcaggcgatatcccctcgccngccctcgcgcccgaggacagcggctcgtccg

SEQ ID NO: 85921 - DNA, 879 bp, Zea mays
  misc_feature: Ceres CLONE 1572324
  misc_feature: Encodes the peptide sequence at SEQ ID NO. 85922
  misc_feature (879)..(879): n is a, c, t, g, unknown, or other
agctccccgcggtggcggccgctctagaactagtggatcccccgggctgcaggaattcgtctcacccctagaaaaagtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaagatcggcttccctgccaagattaaagtgaagaaagaccacgcatcggtggcgtttcgatgaccagtgctctattctagagaaagaggccgtgaacctgtccctggagaaactccaagacctaccccttcgtcaaaggaaaggctgggcccacggggacgctcaagctgggccggcgggccattaccaactttctggttcagggggagtttcctcaccttggggaaaaataaagcaggcccattcgtgggaattcttattattttttacccctaaacatggagaggccatggttttccgatatttccaaggcaatgggcaggcctacctttataaan

SEQ ID NO: 85922 - protein, 150 aa, Zea mays
  misc_feature: Ceres CLONE 1572324
  misc_feature (31)..(151): Pfam Name: Pro_CA Pfam Description: Carbonic anhydrase
  misc_feature: SWISSPROT Homolog: EC 4.2.1.1 Carbonate dehydratase
MDDPVERLKDGFHKFKTEVYDKKPELFEPLKAGQAPKYVVFACSDSRVCPSVTLGLQPGEAFTVRNIAAMVPAYDKTKYTGIGSAIEYAVCALKVEVLVVIGHSCCGGIRALLSLQDGAPDNFHFVENWVKIGFPAKIKVKKDHASVAFR

SEQ ID NO: 85923 - DNA, 968 bp, Zea mays
  misc_feature: Ceres CLONE 1572327
  misc_feature: Encodes the peptide sequence at SEQ ID NO. 85924
tccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggcttgggacaccgcccgggctgtcccgccgaccccctaggaccttcccccaaagaaccccccgagcttgggaaggtgaatcccacctccccccctgggggccaatggcctccggggcccggctttgggacttgccgttctttttccccccgaaaatttggtttttcttctcccgccaaaaacggggcggtttacaaagtatttcggggggcaaaaggggcccccctttcttgggggggtttctcaaaagggggccccggggagtctctctcctcacaaaagaaattcttttttcacaacccacataagaggggcccgcgggcgccctttggggaaaaaataaaaatcccttgacgggtgggaaaaaaccccccccaggagtccctgtgggattactcccccgcgcgcgcgcgcaaaaggaagaaaaatacccttctcggccaaaatattttttggggggcccccgctcccacaaaaggccccctggcgcgtccctacgagggggggggcgccccgccaacaaagaggggggcctaccccccccatttttttctctcacggggggggggcccccctcactttgggagaagagaggcggtcacggaaaaaccccccccttgg

SEQ ID NO: 85924 - protein, 191 aa, Zea mays
  misc_feature: Ceres CLONE 1572327
MAASTMAISSTAMAGTPIKVGSFGEGRITMRKTVGKPKVAASGSPWYGPDRVKYLGPFSGEPPSYLTGEFPGDYGLGHRPGCPADPLGPSPKEPPELGKVNPTSPPGGQWPPGPGFGTCRSFSPRKFGFSSPAKNGAVYKVFRGAKGAPLSWGGFSKGGPGESLSSQKKFFFHNPHKRGPRAPFGEKIKIP

SEQ ID NO: 85925 - DNA, 1149 bp, Zea mays
  misc_feature: Ceres CLONE 1572328
  misc_feature: Encodes the peptide sequence at SEQ ID NO. 85926
  misc_feature (1)..(1): n is a, c, t, g, unknown, or other
  misc_feature (9)..(9): n is a, c, t, g, unknown, or other
  misc_feature (13)..(13): n is a, c, t, g, unknown, or other
  misc_feature (61)..(61): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (99)..(99): n is a, c, t, g, unknown, or other
natgggttnaatncgatgtaaccatctctccccaccccaccgcctaagagaaggaggatcnagtgggttcttgcttttnnncaaagctggagctcaccncggtggcggccgctctagaactagtggatcccccgggctgcaggaattcgtctcacccctagaaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgaacgtgaatgatcgatggggcgccacggtccacggggcctagtccttgctcgttacctagcctgtcccaaagggacccccaacacgtagaagtcgatgggtccattctatggagagcaatttcccgagtgtccccccttgggccgggccaagtacacctatagggctctgggagacaagggaccaaaacaatatttctatcccccactcgcccaaatagatgaagaggggttgaccaggctaaagaaggcaccaggaggggaggacacacacccactgtcataacatcacctcggggttactcacaagaaccttcggggtggcgcgtgtgggggggccctttactcgcgaaacggtaagtgtgccccgcggaactggaacattaaaccgactgggggcttgggggtttcataaagcaacacagctcgcggttctgaccatggatattatagtgatctccccaccctccgagtacattggaatggcaaccagactatccccaaggagtgcaaggatccccccatcgactgagtgaaaccctctgtatttacaatccacacctatatggacccccatgggaagaaaaccccttgcaaaccatctgactcgtgacggagcgacg

SEQ ID NO: 85926 - protein, 91 aa, Zea mays
  misc_feature: Ceres CLONE 1572328
MATTAASSLLKSSFAGSRLPSATRTTTPSSVAVATPRAGGGPIRASISSSPTPPYDLTSFRFSPIKESIVSREMTRRYMTDMITHADTERE

SEQ ID NO: 85927 - DNA, 1233 bp, Zea mays
  misc_feature: Ceres CLONE 1572329
  misc_feature: Encodes the peptide sequence at SEQ ID NO. 85928
  misc_feature (15)..(15): n is a, c, t, g, unknown, or other
  misc_feature (65)..(65): n is a, c, t, g, unknown, or other
  misc_feature (67)..(67): n is a, c, t, g, unknown, or other
  misc_feature (76)..(76): n is a, c, t, g, unknown, or other
  misc_feature (80)..(80): n is a, c, t, g, unknown, or other
  misc_feature (985)..(985): n is a, c, t, g, unknown, or other
  misc_feature (1164)..(1164): n is a, c, t, g, unknown, or other
  misc_feature (1181)..(1181): n is a, c, t, g, unknown, or other
  misc_feature (1216)..(1216): n is a, c, t, g, unknown, or other
tgggcggtggtgggntgtgatgccccttgagtcctatattataaatcagataatacattaccaantnaattttgtntttncaagctggagctcaccgcggtggcggccgctctagaactagtggatcccccgggctgcaggaattcgtctcacccctagaaaaaaccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgacacggggagcgcagcgccggcgacggtggtgcagctggtggtgcaccgcggaggggcaggaccttggcgtcgtacagccgtgaacctggtggaacggggttcaaacgtgccccgcccgttgggtgaagccccgcatggccggttgggccgggccaggtaaagaggcccccggcgccccttgggaggttggtccgcgggcacggaacccattcctatcagctcccaggggattggcctccgggccctccttacggaacaagaccgacccgatatggcctctttggggggcgcggccacacgtagagagggtggggccaccgggcgccaactctatagatatttatgttaaatccattccatctactcacataaagatataccatgccagccgcagcaatcgacgaagtgttgtctacgtgtcccgtatactccagaagacacactggagtaggaagatcacacgtaaacagttgtacaactgcgcgcaacacaagngacgtggccaacatcacgtcagcgacaatgcagttattgaacagagttcatgcctcgactgaaccacacacgcgctgcaagccaagcgggtgactaactgatcggcaagtgcctgtgtgtacgctgtagtggtcacagcgtagaaccagcagactaatgtcccagtgtacatagaacgntgcattgacgcacaggntgtcgacgacaaagacccgagctcgtcacgatgtntgcacagtgaatcgccg

SEQ ID NO: 85928 - protein, 147 aa, Zea mays
  misc_feature: Ceres CLONE 1572329
MAGTAKTPVLGFLLALALVATSTPAAATTLTLHNLCPYPVWPLVSPNTGFPAISENTGRLDGGGRGLVSFRFPDSFWAGRVVARTGCSSGHSRCDTGSAAPATVVQLVVHRGGAGPWRRTAVNLVERGSNVPRPLGEAPHGRLGRAR

SEQ ID NO: 85929 - DNA, 902 bp, Zea mays
  misc_feature: Ceres CLONE 1572330
  misc_feature: Encodes the peptide sequence at SEQ ID NO. 85930
ccgcggtggcggccgctctagaactagtggatcccccgggctgcaggaattcgtctcacccctagaaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggaagtccatcgtgtcccgcgagatgacccggcgctacatgacggacatgatcacccacgccgacaccgacgtggtgatcgtgggcgccgggtccgcgggcctgtcctgcgcgtacgagctgtccaaggactcctccgtgagcgtcgccatcgtggagcattccgtgtccccggggcggcggctcgtggctgggcgggcagctgttctccggcctggggggtgcgcaaggccggcgcacctgtttcttggacaagcttgggcgtgggcctacaaccaggcccgagggacttactgggtgggtcaaagcaccgcgggggctggttcccggtccccccgtggaatgaggccggcgttcctggggggcggcccccaaacgtgaaaagctgtttccaaccccccctggggcggtgggaagggaaccttggattctcttcccggccgggggggccccccttctggggcggagtgtgggatcacccaaaaaggggggggacccccctccgggtgtctctatgggacaacaac

SEQ ID NO: 85930 - protein, 118 aa, Zea mays
  misc_feature: Ceres CLONE 1572330
  misc_feature: SWISSPROT Homolog: EC 1.1.99.1 Choline dehydrogenase
MTRRYMTDMITHADTDVVIVGAGSAGLSCAYELSKDSSVSVAIVEHSVSPGRRLVAGRAAVLRPGGCARPAHLFLGQAWAWAYNQARGTYWVGQSTAGAGSRSPRGMRPAFLGGGPQT

SEQ ID NO: 85931 - DNA, 734 bp, Zea mays
  misc_feature: Ceres CLONE 1572333
  misc_feature: Encodes the peptide sequence at SEQ ID NO. 85932
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
ccccgcggtggcggccgctctagaactagtggatcccccgggctgcaggaattcgtctcacccctagaaaaaactcccgcaggccgcagcccagcaccggccgctctacgcctccacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatgtcgcaaaagattggaatgctgtgtttgaaaggagcatcaatacattgggtttttgactgaaaattggtcccgttggcctttggatgcctaaaatcctcaagacttctttgaaaaaaaagccccaattaactttcccgtttgaaaaagggccccttggaaccccccgctttcccggggggggggcaaggctcttccaaaaaattttttagaaaaatttggggggaaaaaaaaaaccccccccccaattttgtttttttgaaaaaaaaaatttttggggggaaaagaaattttttttttttttcccccccccgcgcggggggggggggggggnnnnataatttcacaaccaaaaatgggggggggggggggggggggggg

SEQ ID NO: 85932 - protein, 74 aa, Zea mays
  misc_feature: Ceres CLONE 1572333
MASLLARQAAQALRARQTAQLGPAASAMQGHLRTYMNAGIPKRFKEDEEKEQLAKDVAKDWNAVFERSINTLGF

SEQ ID NO: 85933 - DNA, 815 bp, Zea mays
  misc_feature: Ceres CLONE 1572337
  misc_feature: Translation starting site: 202
  misc_feature (793)..(793): n is a, c, t, g, unknown, or other
ctccccgcggtggcggccgctctagaactagtggatcccccgggctgcaggaattcgtctcacccctagaaaaaaagtccggagcaacagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgtcctctccgtcgtctcattcccgcacctgtccctccccgcctcgtcccatccgctcccgcaggaagctgctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgtccccgcggagctccgcggacgcggtgagcctcgcgttcggggacgcgtaccgcaacgaggtgtacgcggcgacggtgacgccgcggcgcgggttcgagcgctgcgccacggacacgttccgcgtcgccgggccctgcggctacggcgtctgctacctctacatgcgccggtcgggccgcgccgccgggtgtacgcccgagtgggtcaagttgtacgagccggcgtccggcgcgccctccaccttctactacggcgacccgctccccgacggcgatctggtacggcttcaaccgctgcctcaagggcgggggcccggcgccttctgccaagcattggttgccncgggctcggaacacttgtaact

SEQ ID NO: 85934 - DNA, 921 bp, Zea mays
  misc_feature: Ceres CLONE 1572338
  misc_feature: Encodes the peptide sequence at SEQ ID NO. 85935
  misc_feature (13)..(13): n is a, c, t, g, unknown, or other
  misc_feature (16)..(16): n is a, c, t, g, unknown, or other
  misc_feature (19)..(19): n is a, c, t, g, unknown, or other
  misc_feature (50)..(50): n is a, c, t, g, unknown, or other
  misc_feature (52)..(52): n is a, c, t, g, unknown, or other
  misc_feature (93)..(93): n is a, c, t, g, unknown, or other
  misc_feature (100)..(100): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (123)..(123): n is a, c, t, g, unknown, or other
gtttttttttccnggnccnctgttttctttcggtagtttttttgggttgntntgtgttgtgccgtgttagtgcatcgtgtgtgtctttctttnggggaanannnntcaaactggagctccccncggtggcggccgctctagaatagtggatcccccgggctgcaggaattcgtctcacccctagaaaaaatctagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacggcggcggcttcgatgactactactgggacgacgacttccatttccacgacgacggcttctccgcctcccctacgaccccccggcagcgggtgggtgcgcccccgccagcaagcaggcagatggggtgaatattttccagccctcgggaacttacaaaagaaagggcgaaaagaaccatggcaaggggggaaataaccccctgggggggaaaaaagaaaccttcccaaaactttaccacaccccaaaggggggggaaaccccacaagagttaaaaatttcccggtttccccggggggaaaatattggaaaaaggggggcctttttcccaaaaaaaaagggaaaaagtttttccccaaaaagaagaaaaggcctttatacccccccaaagaaaaaaaaaccccctttcccaacccgaaaaagggggtttcccccccaaacaacaaaagcgcggggggggtctttttcccaaaccccaaaacccggggggaaaaatggggcccaaaaaaaccagggggtgttgtggaaaaaaaggggaaaaaggggaaaccccccttttttttta

SEQ ID NO: 85935 - protein, 57 aa, Zea mays
  misc_feature: Ceres CLONE 1572338
MAHDLCEDLELVADDGGGFDDYYWDDDFHFHDDGFSASPTTPRQRVGAPPPASRQMG

SEQ ID NO: 85936 - DNA, 1145 bp, Zea mays
  misc_feature: Ceres CLONE 1572342
  misc_feature: Encodes the peptide sequence at SEQ ID NO. 85937
  misc_feature (53)..(53): n is a, c, t, g, unknown, or other
aaaaaacacaccccctctccgccgccgcgcaactggcccacagaaaactctcnaaaaaaaattttaattaaaaaaaactggagctccccgcggtggcggccgctctagaacagtggatcccccgggctgcaggaattcgtctcacccctagaaaaaagacgcgccagatccgcgcagcagtggtgtcctccgccgcggatcgagctcccgatccgcgcagtgggagtggcggcgagcgcaggagcgctcggccgggggttccgcaaggctggagacggaggaggaagggagcggtagttccgcggtggtagatccgccggtcctgtcgccggagatggactcatctgtcgagaagcaggggagcgtggcgctggatccggacgagcgcgcgccggcgtccggcgaaaccaaggcctgcaccgagtgccacaccaccaagaccccgctctggcgcgggggaccctgcggacccatgtcgctgtgcaacgcgtgcgggatccggtaccggaagaagagacgggaggccatgggcctcgagtccagcagcaaggccgccaccgccggcggcagcgagcaccagcagcagcagcgggaagaaaaaaggccaccgcgggcgggcgggccggccgcctccctcccaagtcgggaaaaagggaaaccggggagccgggaagcctggaataaaggggagggcgggaaccaagggtccccccgttgggaagccttccttccgtcggatgggggggtctcccggcgcaaagggaagggctggggatggctcttgaaaaagacaaccccggccccggggcgggggaaatgtccgaggcgcggaaaggaccgcaccccccccctgggggtccccaaaaggaaggagaaaccccccccgcggggccccccatacaccgtgcatcaaattgggggacgggttttctctcctttcccgggagggtgtgctcggatgacacccccatgggaaattatggtgggctataacagaaaaccgaaggactcgcgggctcccctccccaaaagaagggccccgcggggctccccaaaagaggcgggggtgcgaaaaagggatataaagggggggggccccccaaaaataaccccttgtggaatagagtatcgcgcgataaataaat

SEQ ID NO: 85937 - protein, 270 aa, Zea mays
  misc_feature: Ceres CLONE 1572342
  misc_feature (28)..(63): Pfam Name: GATA Pfam Description: GATA zinc finger
MDSSVEKQGSVALDPDERAPASGETKACTECHTTKTPLWRGGPCGPMSLCNACGIRYRKKRREAMGLESSSKAATAGGSEHQQQQREEKRPPRAGGPAASLPSREKGKPGSREAWNKGEGGNQGSPRWEAFLPSDGGVSRRKGKGWGWLLKKTTPAPGRGKCPRRGKDRTPPLGVPKRKEKPPPRGPPYTVHQIGGRVFSPFPGGCARMTPPWEIMVGYNRKPKDSRAPLPKRRAPRGSPKEAGVRKRDIKGGGPPKITPCGIEYRAINK

SEQ ID NO: 85938 - DNA, 1269 bp, Zea mays
  misc_feature: Ceres CLONE 1572343
  misc_feature (14)..(14): n is a, c, t, g, unknown, or other
  misc_feature (18)..(18): n is a, c, t, g, unknown, or other
  misc_feature (68)..(68): n is a, c, t, g, unknown, or other
  misc_feature (838)..(838): n is a, c, t, g, unknown, or other
  misc_feature (1269)..(1269): n is a, c, t, g, unknown, or other
aggaggggggaccnaccnaatccacatcacctcggtgccggcccttcacacactctctactctaagancacaaagtggaagtcaccgcggtggcggccgctctagactagtggatcccccgggctgcaggaattcgtctcacccctagaaaaaacgacgcgcccgatccgcgcagcactggtgtcctccgccgcggatcgagctcccgatccgcgcaatgggagtggtggcgaccgcaggagcgctcggccgggggtacctaaaggttggcgactgaggaggaaggcagtcgcatttccgcggtggtcgatttgccggtccacgtccttgacatggacgcctctggccttaaccacaacaacgtggtctttggaaacgggacgaaacagctctggcgctccatagaaaataggtatgagataggtagacacgcgcgcaagagcacaaatatggtgtcgagcgacccttgcaggaccctgttgttccccgccaaccttgtgtcggtatacatcttcccgtcctaaagaccacggaaagtgtaaggtagaattcatcgtcatggcaagtgtaaggatgacattcacatgcgggctttttgtcgccatgtatattagcaaacctaagtagtgccggtagcgagggtaatggcccttccagaaaccagagaggggggccttagtcgccttcccctatccgcgggtggggtatgcaggaagtgagagtgttgtagagcctcttgtgttgacaaggacgagaatacacaagcagtgtatggccgaacctaaagtaaaatacggattcatgtcgatcgtgtcgtaaagattcccatagtaaacgncgcacggcgcgggtagagaggttttacccaccgtgtcttaggggcatacacaggggtgtgggtaaatcctcaagtccgtatactgcttcttatacacgcgctagtcgatactacggctcgcagaacgcgctagagcgcggtgcttgtggtataacataccctctgctcacggcattatgccgaatacatcctcacggtgtggagagagtcgagtgccgacagtagagtacagaatatacttctctgtctcaaccgggacggtctgtgtgtagcagcactaacggggcggtaaggagagaggaatatatgggttcgaagacaggtgcgcgcgcactctatacacaagacgatggtggggcaccgcaccaggggggccaccggcgcacagcatcgcacgaaggcgagcgggtggagtggcgttaccactgtgn

SEQ ID NO: 85939 - DNA, 796 bp, Zea mays
  misc_feature: Ceres CLONE 1572344
  misc_feature: Encodes the peptide sequence at SEQ ID NO. 85940
ctccccgcggtggcggccgctctagaactagtggatcccccgggctgcaggaattcgtctcacccctagaaaaaatcaacccaacacggcgtccccgtcccgagtcaccaccgacccaagcaaaaccgcacgcaccctgccagcggccccccaactcccaacccaacccctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgctgccgcgtcacctggctgctctgggcctacctcctcgccatgttcgtcctcatcctcgtcctcttctgcttcaccgtcttcgccttcgtcgtcaccaacagggcgccggcgaagtcgtctccggccgcggaatcaaggagtactgcctcgggggactactcccacttggctgcaaaagcgcgtcgaagaacaccaggaactggggaccgggatcaggagctgccccccaggactccaaaggcccgcaaaaaaccccgccagaacaaaaacgaaaaccctcccccccagttccatgaagattccaagcctttctcccccaattaaagatttgggctgggtgaaaaagccccccccaccacaggtgggggggttacaaccaaaaaggtgggga

SEQ ID NO: 85940 - protein, 174 aa, Zea mays
  misc_feature: Ceres CLONE 1572344
  misc_feature (5)..(134): Pfam Name: Tetraspannin Pfam Description: Tetraspanin family
MAFRLSNNLIGVLNFVTFLLSVPILGAGIWLGHRADGTECERYLSAPVIALGAFLLAVSLAGLVGACCRVTWLLWAYLLAMFVLILVLFCFTVFAFVVTNRAPAKSSPAAESRSTASGDYSHLAAKARRRTPGTGDRDQELPPRTPKARKKPRQNKNENPPPQFHEDSKPFSPN

SEQ ID NO: 85941 - DNA, 777 bp, Zea mays
  misc_feature: Ceres CLONE 1572346
  misc_feature: Encodes the peptide sequence at SEQ ID NO. 85942
gcggtggcggccgctctagaactagtggatcccccgggctgcaggaattcgtctcacccctagaaaaagctcctctccttcctctctcttctccagcgccatccccctgctccctcttatcgtctccgcgctctaaaatggcctcacactccgccacacagtaaacaaaacgacgggcccactccccgacggctgacgccctcccacggccccttccatgaggcagctgcacctctcgccgcagctctccccctccccggtcctctcctcttacttctcgccgccgccggcggaggcctcgtcctggcggcggcggctgcaccggggacgggccttccaaccgccgctctcctcgctgcgggatcccaacaaggccacgctccgcaaggcctcgtccaaagtccccttccgcctcggcggtggcgggagcggcagccccaaggaccgccgccccgccgacgacgacaaggcggaagatgaggccgagggcgagggcggcgcaggggcactcacggggacactggtcgcaggagcactactggttggattcgtagggcggtttggggcggccggatacgtgtacaaggaccagatcaacaactatctcacgcaactctcagggttcattgacggctatggtccagccggatatgctctgttcgtacttgtatatgcaggaatagcagcgtctcgctattcccgctatacctttaaccatgtcagctggtctattatttaggtaccgtgaccggtaacaattatgtttgacatcagggt

SEQ ID NO: 85942 - protein, 173 aa, Zea mays
  misc_feature: Ceres CLONE 1572346
MRQLHLSPQLSPSPVLSSYFSPPPAEASSWRRRLHRGRAFQPPLSSLRDPNKATLRKASSKVPFRLGGGGSGSPKDRRPADDDKAEDEAEGEGGAGALTGTLVAGALLVGFVGRFGAAGYVYKDQINNYLTQLSGFIDGYGPAGYALFVLVYAGIAASRYSRYTFNHVSWSII

SEQ ID NO: 85943 - DNA, 822 bp, Zea mays
  misc_feature: Ceres CLONE 1572347
  misc_feature: Encodes the peptide sequence at SEQ ID NO. 85944
tccccgcggtggcggccgctctagaactagtggatcccccgggctgcaggaattcgtctcacccctagaaaaagctcctctccttcctctctcttctccagcgccttccccctgctccctcttatcgtctccgcgctctaaaatggcctcacactccgccacacagtaaacaaaacgacgggcccactccccgacggctgacgccctcccacggccccttccatgaggcagctgcacctctcgccgcagctctccccctccccggtcctctcctcttacttctcgccgccgccggcggaggcctcgtcctggcggcggcggctgcaccggggacgggccttccaaccgccgctctcctcgctgcgggatcccaacaaggccacgctccgcaaggcctcgtccaacgtccccttccgcctcggcggtggcgggagcggcagccccaaggaccgccgccccgccgacgacgacaaggcggaggaggaggccgagggcgagggcggcgcaggggcactcacggggacgctggtcgcaggagcgctactggttggtttcgtaggggggtttggggcggccggatacgtgtacaaggaccagatcaacaccttcctcacgcagttctcaggggttcattggacggctattggtccaagccggaataggcctctggtccggaacctgggttttggcgggaaatgggaggggttctcccctatttcccccgccaatacctcttaaaacccaagaaccacccggggggtctatttttattttggggaacacgtgtgagacaccgggaacaaaaatttaatttgggtgtgt

SEQ ID NO: 85944 - protein, 171 aa, Zea mays
  misc_feature: Ceres CLONE 1572347
MRQLHLSPQLSPSPVLSSYFSPPPAEASSWRRRLHRGRAFQPPLSSLRDPNKATLRKASSNVPFRLGGGGSGSPKDRRPADDDKAEEEAEGEGGAGALTGTLVAGALLVGFVGGFGAAGYVYKDQINTFLTQFSGVHWTAIGPSRNRPLVRNLGFGGKWEGFSPISPANTS

SEQ ID NO: 85945 - DNA, 842 bp, Zea mays
  misc_feature: Ceres CLONE 1572348
  misc_feature: Encodes the peptide sequence at SEQ ID NO. 85946
  misc_feature (842)..(842): n is a, c, t, g, unknown, or other
tggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatccctcgccatctgggccctgcaggtcgtgctcatgggtgccgtcgagggctaccgcatttgcccggcgggccgcttcggcgaggtcgtccaacccgctggaaccctggcgggcagcttcaaccccctgggcctgggccaaccaccccccaagcctttcccccaacctccagggtaaaggagcttcaaaaaccggccgccctcccccagggttttcccattgttcggggtttctttctgtcccagggccattcgttcaccggggan

SEQ ID NO: 85946 - protein, 241 aa, Zea mays
  misc_feature: Ceres CLONE 1572348
  misc_feature (61)..(216): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSIPRHLGPAGRAHGCRRGLPHLPGGPLRRGRPTRWNPGGQLQPPGPGPTTPQAFPPTSRVKELQKPAALPQGFPIVRGFFLSQGHSFTG

SEQ ID NO: 85947 - DNA, 931 bp, Zea mays
  misc_feature: Ceres CLONE 1572349
  misc_feature: Encodes the peptide sequence at SEQ ID NO. 85948
ctccccgcggtggcggccgctctagaactagtggatcccccgggctgcaggaattcgtctcacccctagaaaaagtaccactcgtcttcgtctagccgccgaccgccaccaccatggcacccggcctctacagcgacatcggcgagaagaccagagatctgctgtaccaggactacaacacgcgcgagaagttctgcctcaccgcctcctcccccaatggcgtcgcagtcgcagccgcaggaacaaggaaaaatgagtccatctttggtgagcttcacgcccagattaacaacgacaaattgacggttgatgtccaagcaaactcagaatcagatcttttagcaacaatcactgttgatgagttcggtattccagggctaaaatcaattatcaatttgggatgttccagaccagaggatcagggaagctttgaattccgatacctacatgaacatgctgggtgtgaatgaaagcgtcctggcttaattcccaatcctttgggtaaactttgctcggtggcctttggaaagcacaagcgctctcaggtcggggggtggaggtcgctattttgatgggggggccactggccggattttccccaaagtcacaaccgctgccccctgaagcctggacccagggcccaagaatccttgtttggctttgcccctccattctggagaataaccagcggtggaataccgccggggttggccttccctacagacccacccggggttaaaaggaaccccttgggggggcctggctttgttggaaaccttggagttttgcctcaaaacaattggttcagggaaattgaaaaagcaccctcttagattcttcgggggagcccaaaaaaacgggcggggggatccccccagggcggactttttagaaggaccgggtttttttaacaccaccgagaggggtctgg

SEQ ID NO: 85948 - protein, 118 aa, Zea mays
  misc_feature: Ceres CLONE 1572349
MAPGLYSDIGEKTRDLLYQDYNTREKFCLTASSPNGVAVAAAGTRKNESIFGELHAQINNDKLTVDVQANSESDLLATITVDEFGIPGLKSIINLGCSRPEDQGSFEFRYLHEHAGCE

SEQ ID NO: 85949 - DNA, 1064 bp, Zea mays
  misc_feature: Ceres CLONE 1572350
  misc_feature: Encodes the peptide sequence at SEQ ID NO. 85950
  misc_feature (1)..(1): n is a, c, t, g, unknown, or other
  misc_feature (50)..(50): n is a, c, t, g, unknown, or other
  misc_feature (1064)..(1064): n is a, c, t, g, unknown, or other
nttccgtgtttttatgggacactcaagccacccgtttttggatatttatnaaaaaacaaagcaaaatcttttttaaaaaactggaactccccgcggtggcggccgctctagaactagtggatcccccgggctgcaggaattcgtctcacccctagaaaaaaccagcggcgtctatagcaaccggtccaacactttcacgctcagctccagcaatggctgcctccaccatggcaatctcctccacggggatggccggcacccccatcaaggtgggctccttcggtgagggccgcatcaccatgcgcaagaccgtgggcaagcccaagggggaggcatccggcagcccctggtacggccccgaccgcgtcaagtacctcggccccttctccggcgagtccccgagctacctcaccggcaagttccccagcgactacggctgggacaccgccgggctgtccgccgatccctagaccttcgccaaaaaccagccagctggaggtgatccactcacctcttgggccatgactcggcgcagctcagctgcggtcttccccgagcctgcttctcccgcaaactgcggtccagtttgcggcgaaggtcctttcgtggggtcaaagggccaggcctcccccggattctttcacaccaaaggggcgggggcttcgaacattacccattcggggcaaaccaaccctgggcccgtgtattccccaccaacgaccagggaaacgaatctccctccggcgcaattccctgtgggcccattggtccaaaggaatctgttgtcctcccactgagggcctgacccgtatccctaagaggagctaaacccgccgggtttggctcccggccggggtgacctggcttacaccgctggaagagttccgatccagaaccccacccctggattacccccatggcgggtgggcaaggcctttgcataaccccccccttcagggtctctgggtgccaaaaacaaaaaccctcgggaggagaactgtcctcccccgaagccttctaaagggttgaaccggggaggccctcaaaagaaaacacggcccggn

SEQ ID NO: 85950 - protein, 85 aa, Zea mays
  misc_feature: Ceres CLONE 1572350
MAASTMAISSTGMAGTPIKVGSFGEGRITMRKTVGKPKGEASGSPWYGPDRVKYLGPFSGESPSYLTGKFPSDYGWDTAGLSADP

SEQ ID NO: 85951 - DNA, 856 bp, Zea mays
  misc_feature: Ceres CLONE 1572351
  misc_feature: Encodes the peptide sequence at SEQ ID NO. 85952
ccccgcggtggcggccgctctagaactagtggatcccccgggctgcaggaattcgtctcacccctagaaaaaacccatcgctcactacgcgaccgctagctactccgatcggatgctgaccacgcccgcctaccaggccaccaccaccaccaccacccacaaatccccgatggcgaggcgcatcgccgtggcggcagcgttcctggcgctggccgtggtggctcccgccacgctggcgcaggctcccggggccgcggtgacgcctagcgggccgccgaacgtgacggcgatcctggagaagggcgggcagttcaccatgttcatgcggctgatgaaggagacgcagcatgacacgcagctgaacagccagctgaacagctcgtacgccagcagccccccccggtacacggtgttcgcgcccaccgacaacgccttcaacaacctcaagcccggcacgctcaactcgctgacgcagcaacagcaggaggcgctggtgcagggccacgtcctgccccagttctacagcatggactccttccagaccgccagcaaccccgtccgcacgcgggcctccggacgcgacgggccctacaggctcaacatcaccggcaccgccaacaaccaagtcaacgtctcctcgggggtccccgaaggtcaccatcaaaaacgcgctacagcgccgtaaagcccctcggccgtctacttcgtcgaaaaaggggtctccggccccctgggagaattttcgggggccaaggaggtcccgcgggcggaaaaccacgcgctgtttccagtggggaaaacctcaagaaagggcggggttccttcgagaagactcccctttccggggttcggaccg

SEQ ID NO: 85952 - protein, 171 aa, Zea mays
  misc_feature: Ceres CLONE 1572351
  misc_feature (47)..(160): Pfam Name: Fasciclin Pfam Description: Fasciclin domain
MARRIAVAAAFLALAVVAPATLAQAPGAAVTPSGPPNVTAILEKGGQFTMFMRLMKETQHDTQLNSQLNSSYASSPPRYTVFAPTDNAFNNLKPGTLNSLTQQQQEALVQGHVLPQFYSMDSFQTASNPVRTRASGRDGPYRLNITGTANNQVNVSSGVPEGHHQKRATAP

SEQ ID NO: 85953 - DNA, 792 bp, Zea mays
  misc_feature: Ceres CLONE 1572352
  misc_feature: Encodes the peptide sequence at SEQ ID NO. 85954
  misc_feature (718)..(718): n is a, c, t, g, unknown, or other
ctccccgcggtggcggccgctctagaactagtggatcccccgggctgcaggaattcgtctcacccctagaaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatcaagatcgatctggagaccaacaagattgtggacttcatcaagtttgatgttggcaacgtcgtcatggtgactggtggaaggaacactnggccgtgtgggtgttatcaagaacaggggagagcacaagggcagctttgaagacattcacgctggaggactccc

SEQ ID NO: 85954 - protein, 205 aa, Zea mays
  misc_feature: Ceres CLONE 1572352
  misc_feature (94)..(170): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (190)..(190): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTXPCGCYQEQGRAQGQL

SEQ ID NO: 85955 - DNA, 796 bp, Zea mays
  misc_feature: Ceres CLONE 1572353
  misc_feature: Encodes the peptide sequence at SEQ ID NO. 85956
ggagctccccgcggtggcggccgctctagaactagtggatcccccgggctgcaggaattcgtctcacccctagaaaaactctaggctgttgtcgtcgatggtctcgcgttctcgctcctctgtatcacgctttataccgctcgaccggccaccatagcgagtagatcctcctcccccgtccccatcctatggggaacccgccggagctggaccgcacagatccgcaagatctctaggacacctctccgcatgaactccgcgccgcgtacgaaatgctcgtcaagaaatggcaccccgacgagcacgctccgtcgtccacgtcggaggccgaagggcgcttcaaggccgtcagcgaggcctacaaggcgctcctggaccggcaagagaacagggacgtgttctggccgggcaacggataccgggcgggtggaggcgacggggagcacttggagaggacgctcagagactgtgtctgctctaggagtgcgcccagtcacgcatgacgaggattgaatcaagcgtacagcggctgcgactcctgcgggcgccgcgactgcgctgacgtctccagatccatcgtgcggaaggcgccgtccgctggcacgcacgctctagtgaagcctagaagagctctgccatggatgcggcaacgaagtcacgtgcgcactccacctcgtctcatgtaacgggacgatctcatagtaaagaggtgacacagaacagtgcacgttgtagcctgtgatggaggaacagggaagcagcgtggggctggcaagggatgacgggaccaagcggg

SEQ ID NO: 85956 - protein, 76 aa, Zea mays
  misc_feature: Ceres CLONE 1572353
MLVKKWHPDEHAPSSTSEAEGRFKAVSEAYKALLDRQENRDVFWPGNGYRAGGGDGEHLERTLRDCVCSRSAPSHA

SEQ ID NO: 85957 - DNA, 829 bp, Zea mays
  misc_feature: Ceres CLONE 1572355
ctccccgcggtggcggccgctctagaactagtggatcccccgggctgcaggaattcgtctcacccctagaaaaatgttgacaacttttctcaagacaagttatggtaccttgaccagatgatcaatgttttatctctggctggaaataatgtgaacgatgacatatgtaatgcccttattgttctactaccccatacctccacatcttctaggatatctcgccgaggacattgtataatgccttacaagaatatcttaaacaggcaagtttagtaagagtacctgtttgctgcactggtcaatatggtgaaatgctggagaacaatgttggcatgctcgatgcggaggagccaattcatgcaacataatcagatgctgtgaatactgtagatgtcactcttaaccactactcatcagatatgacgactgcagcaatgtgtctggttgctcttctgaaactctcctcacgatttcctatgacatcagagaggatgcagataatacctgcccagaatatagggaatgttcgtccttgcaactacatcaaacatcaagtgaattcacttccgttatgcacagacactcatctatcagagcagcattgcttgaacacatacctgaataaaatgaagctagatatctggagaagctggctgctgctacacactcaactatttcaggccataagaatgactctccagtcactcctggtaagccttaaacttacagactggtgaaataaaaacccagcgtcatcgtcacttagctgaattcgcttaattttcgtatcgggagggaaccccaaccttacactttttggcttcaacga

SEQ ID NO: 85958 - DNA, 865 bp, Zea mays
  misc_feature: Ceres CLONE 1572357
  misc_feature: Translation starting site: 189
  misc_feature: SWISSPROT Homolog: EC 1.6.5.3 NADH dehydrogenase (ubiquinone)
tccccgcggtggcggccgctctagaactagtggatcccccgggctgcaggaattcgtctcacccctagaaaaaactcccgcaggccgcagcccagcaccggccgctctacgcctccacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatgtcgcaaaagattggaatgctgtgtttgaaaggagcatcaacacattgtttttgactgaaatggtccgtggcttgatgctaactctcaagtacttctttgatagaaatgtcacaattaactatccgtttgagaagggtccctctgagcccccgcttccgtggtgagcatgctctcagacgttatgaatctggggaagagcgctgcattgcttgtaaactatgcgaagctatatgcccagcgcaggcaattacaattgaggctgaagaacgtgaagatgggagtcgcccgaacccaagatatgattatgacatgaccaaatggcttttactggggggttctgtcaagaagctttgcccaggtcaatgcttatttgttgaaggggcccaaccttttgagtttttgcccctggaaaacaacccgagggaaccttctggttccgaaaaaggggaaaaaattggttttgaaaaaatggggggattcccttggggaaaaactgtgaaatttggtt

SEQ ID NO: 85959 - DNA, 863 bp, Zea mays
  misc_feature: Ceres CLONE 1572361
  misc_feature: Encodes the peptide sequence at SEQ ID NO. 85960
ccccgcggtggcggccgctctagaactagtggatcccccgggctgcaggaattcgtctcacccctagaaaaagtccccgtccccttcctcgcctcgtgcgctccgcccgtcgcgccgtcctcgcggagcttccaaagcccccagtcccccaatagactcctccccatccgtgctccgtcacggctcaaatactccgcctgcatctccaaagcacactgctccctctggcttcccgcctcctcttcggctccttcgcgtcccgacgccccctcatggccaccgccgccgccaccgtagcagcagcagtctcctccccggctgccccacgcgccggggccgccgccgcctcccgccgggggttcgtcacgtatggtggaggcgccgcccactactctcccacgctgcggtccggccgtgggttctctggtgtgcaaacccatgttgccactgttgaacaagcaattgaaaaagatgctaccaagctggaagctccagttgttgatgtaacaggtgcatctagagggattggtaaggcaacaggctctagcccttggaaaagcaggatgcaaggatcctggtaaactatggcccggtcctcgaaagaagctgaagaggtctccaaagaaatagaagcatctggtggggaaagctatcacccttcggaaggaaaatgtttcaaaagaagccgcatgttggaggctaatgatggaaaggcagtcttttagaataaattggggaaacaataaaaaggggcctgggtaaacaaatgggaaggggattttcacccaaaaaccacattgggttggcatcaatggcatggaaaaaaaaccctctaaccctgggcccaaagaacctaaaatttg

SEQ ID NO: 85960 - protein, 102 aa, Zea mays
  misc_feature: Ceres CLONE 1572361
  misc_feature: SWISSPROT Homolog: EC 1.1.1.100 3-oxoacyl-[acyl-carrier-protein] reductase
MATAAATVAAAVSSPAAPRAGAAAASRRGFVTYGGGAAHYSPTLRSGRGFSGVQTHVATVEQAIEKDATKLEAPVVDVTGASRGIGKATGSSPWKSRMQGSW

SEQ ID NO: 85961 - DNA, 830 bp, Zea mays
  misc_feature: Ceres CLONE 1572363
  misc_feature: Encodes the peptide sequence at SEQ ID NO. 85962
  misc_feature (211)..(211): n is a, c, t, g, unknown, or other
  misc_feature (312)..(312): n is a, c, t, g, unknown, or other
  misc_feature (334)..(334): n is a, c, t, g, unknown, or other
  misc_feature (345)..(345): n is a, c, t, g, unknown, or other
  misc_feature (370)..(370): n is a, c, t, g, unknown, or other
  misc_feature (376)..(376): n is a, c, t, g, unknown, or other
  misc_feature (391)..(391): n is a, c, t, g, unknown, or other
  misc_feature (445)..(445): n is a, c, t, g, unknown, or other
  misc_feature (456)..(456): n is a, c, t, g, unknown, or other
  misc_feature (463)..(463): n is a, c, t, g, unknown, or other
  misc_feature (514)..(514): n is a, c, t, g, unknown, or other
  misc_feature (546)..(546): n is a, c, t, g, unknown, or other
  misc_feature (551)..(551): n is a, c, t, g, unknown, or other
  misc_feature (559)..(559): n is a, c, t, g, unknown, or other
  misc_feature (603)..(603): n is a, c, t, g, unknown, or other
  misc_feature (624)..(624): n is a, c, t, g, unknown, or other
  misc_feature (673)..(673): n is a, c, t, g, unknown, or other
  misc_feature (675)..(675): n is a, c, t, g, unknown, or other
ccccgcggtggcggccgctctagaactagtggatcccccgggctgcaggaattcgtctcacccctagaaaaaaaggcaccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcnagaaggccaggcgcaagctccgcgccctcatcgccgagaagagctgcgcacccctcatgctccgcctcgcgtggcactccgcggggacgttcgacgtgtcntcaaggaccggcggtcccttcngtactatgaantgcccggcggaactggctcacggcnccaacncggggctggacatcncggtgcggctgctcgagcccatcaaggaggagttccccaccctctcctatgccnacttctaccancttgccngaattgtggccgtcaaggtcaccggtgggcctgagatccccttccacccangcagggaggacaagcctcagccgcgacctcgnggccntcttcctnatgccaccaagggttctgaccacctgaggcaagtctttggcaancaaatgggtttgaatgatcangacatctttgccctctctggtggccacaccttgggaaggtgccacaaanancggtctggtttttaagggtgccctggacttacaaaccctttggtctttgacaactcttacttccaggaaccttctaaatggttaacaaggagggccctttcctcacctccccaattgaacaaaccccctgctgaacggacccctgtgctggcgcg

SEQ ID NO: 85962 - protein, 175 aa, Zea mays
  misc_feature: Ceres CLONE 1572363
  misc_feature (19)..(176): Pfam Name: peroxidase Pfam Description: Peroxidase
  misc_feature: SWISSPROT Homolog: EC 1.11.1.11 L-ascorbate peroxidase
  misc_feature (17)..(17): Xaa is any aa, unknown, or other
  misc_feature (58)..(58): Xaa is any aa, unknown, or other
  misc_feature (61)..(61): Xaa is any aa, unknown, or other
  misc_feature (70)..(70): Xaa is any aa, unknown, or other
  misc_feature (72)..(72): Xaa is any aa, unknown, or other
  misc_feature (77)..(77): Xaa is any aa, unknown, or other
  misc_feature (95)..(95): Xaa is any aa, unknown, or other
  misc_feature (98)..(98): Xaa is any aa, unknown, or other
  misc_feature (101)..(101): Xaa is any aa, unknown, or other
  misc_feature (118)..(118): Xaa is any aa, unknown, or other
  misc_feature (130)..(130): Xaa is any aa, unknown, or other
  misc_feature (133)..(133): Xaa is any aa, unknown, or other
  misc_feature (147)..(147): Xaa is any aa, unknown, or other
  misc_feature (154)..(154): Xaa is any aa, unknown, or other
  misc_feature (171)..(171): Xaa is any aa, unknown, or other
MAKNYPTVSAEYSEAVXKARRKLRALIAEKSCAPLMLRLAWHSAGTFDVSSRTGGPFXTMXCPAELAHGXNXGLDIXVRLLEPIKEEFPTLSYAXFYXLAXIVAVKVTGGPEIPFHPXREDKPQPRPRGXLPXATKGSDHLRQVFGXQMGLNDXDIFALSGGHTLGRCHKXRSGF

SEQ ID NO: 85963 - DNA, 812 bp, Zea mays
  misc_feature: Ceres CLONE 1572364
  misc_feature: Encodes the peptide sequence at SEQ ID NO. 85964
  misc_feature (136)..(136): n is a, c, t, g, unknown, or other
  misc_feature (137)..(137): n is a, c, t, g, unknown, or other
  misc_feature (812)..(812): n is a, c, t, g, unknown, or other
ggagctccccgcggtggcggccgctctagaactagtggatcccccgggctgcaggaattcgtctcacccctagaaaaagccgccggagtgaggggctgagcacagaaccgggcaatcccccccccccccaaccccnnttattcttcctcgccgctgccagatgctccgccgcagcctccccgaggccgggtccttcttccgccggctccttggccgcgtctcgaacgagggcgggcttgctgccggctcctccgcgtctgtccgacatttcgtcgaacagcttgtaggcggcacggccccgatctcccgcgtcccctccgccctcgccgtcgcctccgcggagcgtgggaccggaggaagcaacggcgcttccttgacggtccacttccttcgccactcctgcggcctcgaagaagccgacgccgcgaaggcggccgagcgcgtgcacctccgctccaccaagaacgcgcacgccgtggttgcgctcctccgcgatacgctcggcatgccccccgcctttgtcgggcggtttgttttccgcgttcccccggggtccttttctctggtcacacttcggggttatatttgaacttcttactccggcgaggttgggctttttttttcggcggagttgggggtggtttctttcttgggggagcccccccccggttttctttcttcggggggggatcggggatttttcttgggcccccaatccttaggatcttcttttgagggagttttttttggggtctctgataaaaaaaattgggtttttttcacccggtttttaatgattttctatgtgggtn

SEQ ID NO: 85964 - protein, 142 aa, Zea mays
  misc_feature: Ceres CLONE 1572364
MLRRSLPEAGSFFRRLLGRVSNEGGLAAGSSASVRHFVEQLVGGTAPISRVPSALAVASAERGTGGSNGASLTVHFLRHSCGLEEADAAKAAERVHLRSTKNAHAVVALLRDTLGMPPAFVGRFVFRVPPGSFSLVTLRGYI

SEQ ID NO: 85965 - DNA, 846 bp, Zea mays
  misc_feature: Ceres CLONE 1572366
  misc_feature: Encodes the peptide sequence at SEQ ID NO. 85966
  misc_feature (846)..(846): n is a, c, t, g, unknown, or other
ccccgcggtggcggccgctctagaactagtggatcccccgggctgcaggaattcgtctcacccctagaaaaaaaaaagccatcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttgtggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctggggacaagcagttagtgttgcctgtccctgcattcaatgtcatcaacggtggttcccatgctggaaacaagcttgctatgcaggagtttatgattcttcctactggagctgcctcattttagggagctatgaaaatgggggggttgaagtttatccccaccctgaagtccggtttccaaaaaagaagtttggggcaagatgcccaaaaatgttgggtgaaccaaaggggggtttttgctccccaaacctcccgggaaaaaacccagggaagggccttgaagactccttgtaan

SEQ ID NO: 85966 - protein, 184 aa, Zea mays
  misc_feature: Ceres CLONE 1572366
  misc_feature (4)..(140): Pfam Name: Enolase_N Pfam Description: Enolase, N-terminal domain
  misc_feature: SWISSPROT Homolog: EC 4.2.1.11 Phosphopyruvate hydratase
MAATIQSVKARQIFDSRGNPTVEVDVFCSDGTFARAAVPSGASTGVYEALELRDGGSDYLWKGVSKAVNNVNSVIGPALIGKDPTAQTEIDNFMVQQLDGTKNEWGWCKQKLGANAILAVSLAVCKAGASIKRIPLYQHIANLAGDKQLVLPVPAFNVINGGSHAGNKLAMQEFMILPTGAASF

SEQ ID NO: 85967 - DNA, 853 bp, Zea mays
  misc_feature: Ceres CLONE 1572367
  misc_feature: Encodes the peptide sequence at SEQ ID NO. 85968
  misc_feature (853)..(853): n is a, c, t, g, unknown, or other
agctccccgcggtggcggccgctctagaactagtggatcccccgggctgcaggaattcgtctcacccctagaaaaaaaaagccatcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttgtggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcatgagctgtatgcaagctggagctagcatcaagaggattcctttataccagcacattgccaacctagctgggaacaagcagttagtgttgcctgtccctgcattcaatgtcatctacggtgggttcccatgctaggaacaagattgctatgcaaggagtttatgatcctttcctactgcgagctgcctcatgttaaaggaggcttatgaaagatgggtgtttggaggtttactcaccaccctggaagttccctggtcaaaaaataaatatgggggcatgatggccaccgaatgtttggtggaagaacggttgggtttttgccttccggacctttccggggaagaaactagggtaagggaccttgaaan

SEQ ID NO: 85968 - protein, 121 aa, Zea mays
  misc_feature: Ceres CLONE 1572367
  misc_feature (4)..(122): Pfam Name: Enolase_N Pfam Description: Enolase, N-terminal domain
  misc_feature: SWISSPROT Homolog: EC 4.2.1.11 Phosphopyruvate hydratase
MAATIQSVKARQIFDSRGNPTVEVDVFCSDGTFARAAVPSGASTGVYEALELRDGGSDYLWKGVSKAVNNVNSVIGPALIGKDPTAQTEIDNFMVQQLDGTKNEWGWCKQKLGANAILAVS

SEQ ID NO: 85969 - DNA, 775 bp, Zea mays
  misc_feature: Ceres CLONE 1572370
  misc_feature: Encodes the peptide sequence at SEQ ID NO. 85970
ctccccgcggtggcggccgctctagaactagtggatcccccgggctgcaggaattcgtctcacccctagaaaaaaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgactgtgccaaaaaaaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgcccctcacgttaccacccgagtctgattattggctcccattttca

SEQ ID NO: 85970 - protein, 65 aa, Zea mays
  misc_feature: Ceres CLONE 1572370
MILVAIVAELLEEYTALVARVLEQLLNDAPFPRRMRFLMLRSLPFVPPPLPPPPPPHAPHVTTRV

SEQ ID NO: 85971 - DNA, 787 bp, Zea mays
  misc_feature: Ceres CLONE 1572371
  misc_feature: Encodes the peptide sequence at SEQ ID NO. 85972
ctccccgcggtggcggccgctctagaactagtggatcccccgggctgcaggaattcgtctcacccctagaaaaaaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgactgtgccaaaaaaaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgcccctcacgtttacacccgagtctgattattgggctccatttttctcaggggtttct

SEQ ID NO: 85972 - protein, 65 aa, Zea mays
  misc_feature: Ceres CLONE 1572371
MILVAIVAELLEEYTALVARVLEQLLNDAPFPRRMRFLMLRSLPFVPPPLPPPPPPHAPHVYTRV

SEQ ID NO: 85973 - DNA, 856 bp, Zea mays
  misc_feature: Ceres CLONE 1572372
  misc_feature: Encodes the peptide sequence at SEQ ID NO. 85974
ggagctccccgcggtggcggccgctctagaactagtggatcccccgggctgcaggaattcgtctcacccctagaaaaaatccgctagggtttatctgctcgaggaatggcgtcggtgcaggtctccggcgcgggggtcggtaccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgaggtagttgctgttggagaaggaaggataattggggataagaaagttgatgtcagcattcaggttggagctcaggttgtgtattctaagtacgctggaaccgaggtcgcgttgaacgatcacagccatctggttctcaaagaggatgacgttataggtatcttagaaactgatgacgtgaaagacatgaagcctctgaacgaccgtgttcttatcaagggtgctgaaagctgaagacaaactccagggagcctactgcttacggaaactgcccaggagaaagcatctatcgggaccgtccgtaaccggttggcccaggccccctggaacaaggattggcaagaggctccccccttttccgttctcccgggggagcacttgccctgtacctccaagtacccccggcagcaagttccaaggggcgccgaacgggcacgaactacatccgggcctgagg

SEQ ID NO: 85974 - protein, 175 aa, Zea mays
  misc_feature: Ceres CLONE 1572372
  misc_feature (62)..(153): Pfam Name: Cpn10 Pfam Description: Chaperonin 10 Kd subunit
MASVQVSGAGVGTAAFSVKGKASTGALRLRSTLTFGEVCPARRAFRGLVVRAATVVAPKYTTLKPLADRVLVKINSSEEKTTGGILLPTTAQSRPQGGEVVAVGEGRIIGDKKVDVSIQVGAQVVYSKYAGTEVALNDHSHLVLKEDDVIGILETDDVKDMKPLNDRVLIKGAES

SEQ ID NO: 85975 - DNA, 874 bp, Zea mays
  misc_feature: Ceres CLONE 1572373
  misc_feature: Encodes the peptide sequence at SEQ ID NO. 85976
ctccccgcggtggcggccgctctagaactagtggatcccccgggctgcaggaattcgtctcacccctagaaaaaaaccgctagggtttatctgctcaaggaatggcgtcagtgccggtcttccgcactaacgaacgaactgaggtcaacaacgactgatcgaacacctacaatggcggctgtgctaaacactaggaaaaccccccaggtggttcccgtcctggtggcggcggccctgctggcttcttccccttcgggggaaatcacttgcgggcaggtggggtcatcgctggctccgtgcatcccatacccaacggggagggccagcgcgctccccacgacatgctgcagcggcttcaagagcctacacagcgcggcgcgaaccaacgcggaccaccaggcggcgtgccgctgcctcaagagcctcgccaactgcgacaagagcgtcaacatgggcaccgtcaccaccatccccggaaagtgcggggtctcggtcggattccccatcaacatgtccacccgactgcagcaagatcagctaaatttattcaacgaccacgttaaaaatcctcccgaacataaacgttacgtctcgggcacctccacgatttaataaaccgcgggaaaaaaataaaataaaccttgcctgtatggcccaggagcatcctggcaattaccaatccaaaaaataaacctggtaccggaagggcccccaattaataaaacccaaaggcccggccccgccaaaggcgaggtttactttcaaaacccccctaccttggtttcgggccggggaaaaaacttattcttggaacctcccaaaggttatgggaaaaccgggcttcttccccctggtaaccacaaaacaataattg

SEQ ID NO: 85976 - protein, 146 aa, Zea mays
  misc_feature: Ceres CLONE 1572373
  misc_feature (33)..(118): Pfam Name: Tryp_alpha_amyl Pfam Description: Protease inhibitor/seed storage/LTP family
MAAVLNTRKTPQVVPVLVAAALLASSPSGEITCGQVGSSLAPCIPYPTGRASALPTTCCSGFKSLHSAARTNADHQAACRCLKSLANCDKSVNMGTVTTIPGKCGVSVGFPINMSTRLQQDQLNLFNDHVKNPPEHKRYVSGTSTI

SEQ ID NO: 85977 - DNA, 782 bp, Zea mays
  misc_feature: Ceres CLONE 1572377
  misc_feature: Translation starting site: 638
  misc_feature: SWISSPROT Homolog: EC 2.7.10.2 Non-specific protein-tyrosine kinase
ctcaccgcggtggcggccgctctagaactagtggatcccccgggctgcaggaattcgtctcacccctagaaaaaatagtatatcagagtacgcgcttcggataccttactgccggtctgttctcgtcttggcttctttcttctcctccgtggatccgggagcgatccaccgccactttgctatttgcttcccccggaatcgctgctcatctctgtgtgctgtgcatttgtgcggccactgttagtttgggtccgtcccatccgtctgttgaacaatggctgactgtgaggatatccacccacttgtgtatgacgatggcgatgcactggtcaaggttggctttagcgtgagtgatgatgcggccacagcatctgatccctagtatagtctgccgccctcggcactgtggtgtgatggttggaatgggctataaggactcctatgtaagtgaccatgcatagctcgaaataggtatcttgaccttgaagtacctcattgagcagggtatcctgaactactgggatgatatggagaaaatctggcaccacaccttctacaatgaactgcgtgttgctcctgaagagcacccagttctgctgacagaagagcctctgaaccacatgctaacacatagaacatgactcagattatgttcgagacattcgatgcaccactaatgtatgttgctatacaagctgtccgtttcctgtatgctcagcgtcgcacaacaggtattgtgctcgactcaggtgatcgtgtgacccacaccgtgccagtctatc

SEQ ID NO: 85978 - DNA, 882 bp, Zea mays
  misc_feature: Ceres CLONE 1572378
  misc_feature: Encodes the peptide sequence at SEQ ID NO. 85979
gtggcggccgctctagaactagtggatcccccgggctgcaggaattcgtctcacccctagaaaaagtcctatccttatctatcgagtggacgcgacgccaacagcgtcagcgcctcctcccgctctccggctcctgtcctgctcgcgctcgtcgcccccctgccgctcggctccccttggcccctccaatgccgccacccatggcactgctgccgctctcctccgcatccgcgtccgccgcgctgccgcccttccgctcctgcccgcccgctgcgatgctgcttcgcctcccctcccccgccccctcccatttcgcccgcccccgcgcggtctccaccgggtacgcggcgtccttctacggcggctcggcgatgtccgcggccggcggcgcggacgaggaggaggaggaggtcggctacgagtcggggttcggcccggggctagggctgggcggcggcggcctcgggatgtcgggcgcggaagccgcgctggctctggaggagcgcgaaatgccgccttggccacccggcctccgccagtacgagaacatggtcgtgctccgcccccgacatgtccgaggaggagcgcctccgccttcatccaggggctacaaggaagctgctccgtcgcccggcggcggccatgtaacctgggaggtcttccaaaccgcgggggtcatccccgctgggcttacaggcatcagggaaaaaggaaacagccgcccccggggcttgcccgtccaccctaactaagaaggggaatttacccttcccttcataaccctaactttcacccaaaggcccgagagtcccaatgtggaacccccctgtgcagcctttaaaaccttcaaaacgcccgagaaaaaagaaagattttattccc

SEQ ID NO: 85979 - protein, 187 aa, Zea mays
  misc_feature: Ceres CLONE 1572378
MPPPMALLPLSSASASAALPPFRSCPPAAMLLRLPSPAPSHFARPRAVSTGYAASFYGGSAMSAAGGADEEEEEVGYESGFGPGLGLGGGGLGMSGAEAALALEEREMPPWPPGLRQYENMVVLRPRHVRGGAPPPSSRGYKEAAPSPGGGHVTWEVFQTAGVIPAGLTGIREKGNSRPRGLPVHPN

SEQ ID NO: 85980 - DNA, 841 bp, Zea mays
  misc_feature: Ceres CLONE 1572379
  misc_feature: Encodes the peptide sequence at SEQ ID NO. 85981
  misc_feature (547)..(547): n is a, c, t, g, unknown, or other
ctccccgcggtggcggccgctctagaactagtggatcccccgggctgcaggaattcgtctcacccctagaaaaacttctctcgcctgcctctcccccgccgcgccgccacttcccctctcccgtcaactccggcttccgcgcgaggtcgagctagcgtttggagttctcgagacctgctgtgatggcgacagagcaagcggcggagaactacacggtggaggacctcgtggccctgaacccctacaaccccgacatcctcaacgacctcgagaagttcgtcaatgagcaggtctcatctcagacatataacttggatgcaaatctcagccttcttcgcttgtaccagtttgagccagaaaggatgagcatacagattgtggcccacatactgattaaggctctcatggcaatgccagcccctgacttcagattgtgcttattcttaatccctgaacatgtgcaaatggaggagcaattcaaggtattgatagttctttctcactacctagagactgctaggttcagtcaattttgggatgaagcagncaagaaccgccacatatcggaagcagtgccaggtttcgcacaagcgatcccatcctatgcgattcatgtactttccttgacataccagaaaagttgcaacggcctattctttgtagaggcaatcaacaatcgaagggtctcgcgtttggacaagttttctttgagtaccatgccgcccaactcaggttggggtgatttgaaaaagggtggggcaagccttcaaggggatggtttctttcccccggtaattgaggtttcaatcgcccccagagctttcaagaagaaacccaagga

SEQ ID NO: 85981 - protein, 219 aa, Zea mays
  misc_feature: Ceres CLONE 1572379
  misc_feature (19)..(165): Pfam Name: SAC3_GANP Pfam Description: SAC3/GANP/Nin1/mts3/eIF-3 p25 family
  misc_feature (122)..(122): Xaa is any aa, unknown, or other
MATEQAAENYTVEDLVALNPYNPDILNDLEKFVNEQVSSQTYNLDANLSLLRLYQFEPERMSIQIVAHILIKALMAMPAPDFRLCLFLIPEHVQMEEQFKVLIVLSHYLETARFSQFWDEAXKNRHISEAVPGFAQAIPSYAIHVLSLTYQKSCNGLFFVEAINNRRVSRLDKFSLSTMPPNSGWGDLKKGGASLQGDGFFPPVIEVSIAPRAFKKKPK

SEQ ID NO: 85982 - DNA, 782 bp, Zea mays
  misc_feature: Ceres CLONE 1572381
  misc_feature: Encodes the peptide sequence at SEQ ID NO. 85983
  misc_feature (782)..(782): n is a, c, t, g, unknown, or other
ccgcggtggcggccgctctagaactagtggatcccccgggctgcaggaattcgtctcacccctagaaaaactagtaacatttgcttattttggtgaacgtcacatcgtggatcttgatcccacatagacgaagaagacgcaatgggatggatgatgactgctatacttaactccaatggcgatgtttgtgccattcagaaagctggcggagagggtgtcatgtctagtgttatcctgcactgtctaagaattgcttcactaaaggctgctgatatcccgctctaaatatagaaagcagtatactcatacaccaccgacaaagcccataacaaagtaaaacgtttgccaacctcggttcctcagataattaatgtcactaatgtaactatgcactgcaacggtgatcgtgaattcttacaacaatctatgcacatgcatagtgatgtgcagcagataaccaaagatccactaactatcgtcaaggccagcaaccgtgaggatgccccaaccatgactgaatcatctaatgctgaggtgaacacatcaattgctgtggctgctgaaaagtctgaatccccttaaattgggatcgccaaaagagccttaaaaattcctttcgaacccggaccctttacgccctggagaaacaaaaagtgacccggaattttacttttaccttcccaggccccgttaaatttttttaataccccccccgaaaaaaatttaaggggggaccggttttaaaaagagaccctctaaaaatctcccccggattgtggggn

SEQ ID NO: 85983 - protein, 47 aa, Zea mays
  misc_feature: Ceres CLONE 1572381
MGWMMTAILNSNGDVCAIQKAGGEGVMSSVILHCLRIASLKAADIPL

SEQ ID NO: 85984 - DNA, 766 bp, Zea mays
  misc_feature: Ceres CLONE 1572382
  misc_feature: Encodes the peptide sequence at SEQ ID NO. 85985
  misc_feature (661)..(661): n is a, c, t, g, unknown, or other
  misc_feature (691)..(691): n is a, c, t, g, unknown, or other
  misc_feature (693)..(693): n is a, c, t, g, unknown, or other
  misc_feature (694)..(694): n is a, c, t, g, unknown, or other
  misc_feature (707)..(707): n is a, c, t, g, unknown, or other
  misc_feature (738)..(738): n is a, c, t, g, unknown, or other
  misc_feature (755)..(755): n is a, c, t, g, unknown, or other
ctcaccgcggtggcggccgctctagaactagtggatcccccgggctgcaggaattcgtctcacccctagaaaaagcgagcggagcacaagagagcaccacgccaccccttcctgtctctctgctcctccgcatccgcttgtgcgcccgtgccgctcactgcactccattcccaatctctctgcctcccctgcctgtctctccacgccagtgcgcgcagatccggcgggtgtgaagaggagctcatcacatcctctgctgcttcttctgtccaatagaactagctagctagctagctcgccgattcaacagcaagcggcggcagtgatgcgcggacttgtcctcgcatagccaagatccgtccagcagcggcagcttgagcgcagacagattcaagaatggaggagaaagcggcggacgcgacggcgacagtggcggcggcggcggcggcggcagcggatcaggacggcgcggtgtactgcagcgagcacccgtacccgccaggcgcggcagcggcggccggggcgggcgccggcggcatctgcgccttctgtctgcaggagaagctcggcatgctggtctcgtcgtccaagtccagccccttccacccgccgccgcagcagccggtctccgccgcgtcgccgtcctcggcgacgcccgcgnccgtcaaccgcgcctccctcgagggcgcgncnngcgcactctaccntcccgcggcgtcgcgccaagtgatgcccgcncaaaaccgcgggcggcngcggcgggctc

SEQ ID NO: 85985 - protein, 123 aa, Zea mays
  misc_feature: Ceres CLONE 1572382
  misc_feature (89)..(89): Xaa is any aa, unknown, or other
  misc_feature (99)..(99): Xaa is any aa, unknown, or other
  misc_feature (100)..(100): Xaa is any aa, unknown, or other
  misc_feature (104)..(104): Xaa is any aa, unknown, or other
  misc_feature (120)..(120): Xaa is any aa, unknown, or other
MEEKAADATATVAAAAAAAADQDGAVYCSEHPYPPGAAAAAGAGAGGICAFCLQEKLGMLVSSSKSSPFHPPPQQPVSAASPSSATPAXVNRASLEGAXXALYXPAASRQVMPAQNRGRXRRA

SEQ ID NO: 85986 - DNA, 785 bp, Zea mays
  misc_feature: Ceres CLONE 1572383
  misc_feature: Encodes the peptide sequence at SEQ ID NO. 85987
  misc_feature (746)..(746): n is a, c, t, g, unknown, or other
ggagctcaccgcggtggcggccgctctagaactagtggatcccccgggctgcaggaattcgtctcacccctagaaaaagcgagcggagcacaagagagcaccacgccaccccttcctgtctctctgctcctccgcatccgcttgtgcgcccgtgccgctcactgcactccattcccaatctctctgcctcccctgcctgtctctccacgccagtgcgcgcagatccggcgggtgtgaagaggagctcatcacatcctctgctgcttcttctgtccaatagaactagctagctagctagctcgccgattcaacagcaagcggcggcagtgatgcgcggacttgtcctcacatagccaagatccgtccagcagcggcagcttgagcgcagacagattcaagaatggaggagaaagcggcggacgcgacagcgacagtggcggcagccgcagcggcagcagcggatcaggacggcgcggtgtactgcagcgagcacccgtacccgccaggcgcggcagcagaagccggggcgggcgccggcggcatctgcgccttctgtctgcaggagaagctcggcatgctggtctcgtcgtccaagtccagccccttccacccgccgccgcagcagccggtctccgccgcgtcgacgtcctcggagacgtcgccgccggccaaacgcgcctcctgcgaagtgccgccgccgccagtctacccatccgcggcgtcgcgcaaggtgatgcccgccgcanaagcacgggagagcagcggcaggctcaaagaagaagaac

SEQ ID NO: 85987 - protein, 128 aa, Zea mays
  misc_feature: Ceres CLONE 1572383
  misc_feature (116)..(116): Xaa is any aa, unknown, or other
MEEKAADATATVAAAAAAAADQDGAVYCSEHPYPPGAAAEAGAGAGGICAFCLQEKLGMLVSSSKSSPFHPPPQQPVSAASTSSETSPPAKRASCEVPPPPVYPSAASRKVMPAAXARESSGRLKEEE

SEQ ID NO: 85988 - DNA, 820 bp, Zea mays
  misc_feature: Ceres CLONE 1572385
  misc_feature: Translation starting site: 264
  misc_feature (734)..(734): n is a, c, t, g, unknown, or other
  misc_feature (811)..(811): n is a, c, t, g, unknown, or other
agctccccgcggtggcggccgctctagaactagtggatcccccgggctgcaggaattcgtctcacccctagaaaaaccccgtatcctctcctcagttgcttcgacgtatttctctctctatctatacggttccgaagaaggtagagagagaaactcgaaggggagaggacagaagagggagatacaggttaatttttaggtaccagatcatctgatttctcagaagcaaaatgttgtttggagctcattaacaccatcctgtaatgcctgtgattttacgggaaatggaggatcattctgtccatcccatgtctaagtctaaccatggctccttgtcaggaaatggttacgagatgaaacattcaggccataaagtttgcgataggcattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatactgttgatgcttattatagtgggggttggggtcttgacaggatatgctccacatgccattgtccatccccagcaaaatgatacaacgaacactccggggtatgttacctgtggaacctgcagaagacccantatatgttaatgcaaaacaataccatggcatccttaggagggagcaaacacgtggctaatttggaggcccaagaacnagatggtga

SEQ ID NO: 85989 - DNA, 778 bp, Zea mays
  misc_feature: Ceres CLONE 1572388
  misc_feature: Encodes the peptide sequence at SEQ ID NO. 85990
  misc_feature (539)..(539): n is a, c, t, g, unknown, or other
ccccgcggtggcggccgctctagaactagtggatcccccgggctgcaggaattcgtctcacccctagaaaaaatgctctctggcctctgcgtatgcgcctaggcgagcccgtgcgctggttggcctcccggacgcggccgcggcgggcgatggggtcgtcggcgccggtgagggcggcgggcggtacaagggatcccggcgagaacccggcggtggggaggctgcgggagctcttcacaggcgacgcggcagatgggtgggagaagtcctgggagtttggtgtgaccccatgggatttgggaaagccaacacctgtcattgaacatcttgctagatcaggaacactcccaaaagggagagctttggttcctggatgtggaatgggatacgatgtggtcgctcttgcaagccctgaacgttttgttgttggcttggatatttctgatatggctgttaagaaggctaagcagtggtcatcctctttgcccaatgcagattattttacttctctggccgaagatttctttcagtggataccnagtgaacatttcgacctttatattgattacacgttcttttgtgcacttgaacagagcttaaaggttggctggagcagagacaagttattcggcttctaaaacggatgggaaggctcctactttggattatccggaaaatgatccaaagggaaggaccccgtacaataataccttgcctgaatttccaaaggtctgggaacccttgggtttaaaatctggttctttgggaaaaaaaaaac

SEQ ID NO: 85990 - protein, 162 aa, Zea mays
  misc_feature: Ceres CLONE 1572388
  misc_feature (32)..(163): Pfam Name: TPMT Pfam Description: Thiopurine S-methyltransferase (TPMT)
  misc_feature: SWISSPROT Homolog: EC 2.1.1.67 Thiopurine S-methyltransferase
MGSSAPVRAAGGTRDPGENPAVGRLRELFTGDAADGWEKSWEFGVTPWDLGKPTPVIEHLARSGTLPKGRALVPGCGMGYDVVALASPERFVVGLDISDMAVKKAKQWSSSLPNADYFTSLAEDFFQWIPSEHFDLYIDYTFFCALEQSLKVGWSRDKLFGF

SEQ ID NO: 85991 - DNA, 836 bp, Zea mays
  misc_feature: Ceres CLONE 1572390
  misc_feature: Encodes the peptide sequence at SEQ ID NO. 85992
ccccgcggtggcggccgctctagaactagtggatcccccgggctgcaggaattcgtctcacccctagaaaaattgttagtgtcctgatacatctcttacctgggattgttctattcactatccggtggtggaatccacaaacatttgctgccatgcacccagaaggaagagatgctagagtcacatggccatatgtggaggacaaatcatatctgtggacatggcttttttttgttccgctagctgcttacaccctgtggcaacttatgtatttcctcatagttaatgtcctgcgtcgacagaggttgttaagggaccctgaagtcatgacatcctacagggagctctcgaagaaagcacagaaagcgaacaacatctggtggaggctgagcggactgctgggtgaccggaaccggcaggtcatgtacatactgctccaggcgctgttcacagtggcaacaatggcactgaccgtacctatattcctgtcctaccggatgcacgtggtgttcctgatactcaaggtgtgcgcgtcgacatggaacggtggcagcttcatcttggaggtgatgcctcggcaagtagtgcagaagcagctgaagaaactggacatgaagcccatggaacaggggagctcgacacaaggtgcgcccaggtggtgatggtggcacattggggtaacacccaccagcacacatccgaagagcataatccggaagtgaggaaattgaagctgggatgtagaatagattttgatggtcactgacacaacctttgttgtcatcgagtgcgcttttgtgttggagtttttctttaagtcctccccaggttgtggt

SEQ ID NO: 85992 - protein, 169 aa, Zea mays
  misc_feature: Ceres CLONE 1572390
MHPEGRDARVTWPYVEDKSYLWTWLFFVPLAAYTLWQLMYFLIVNVLRRQRLLRDPEVMTSYRELSKKAQKANNIWWRLSGLLGDRNRQVMYILLQALFTVATMALTVPIFLSYRMHVVFLILKVCASTWNGGSFILEVMPRQVVQKQLKKLDMKPMEQGSSTQGAPRW

SEQ ID NO: 85993 - DNA, 826 bp, Zea mays
  misc_feature: Ceres CLONE 1572391
  misc_feature: Encodes the peptide sequence at SEQ ID NO. 85994
  misc_feature (654)..(654): n is a, c, t, g, unknown, or other
ccccgcggtggcggccgctctagaactagtggatcccccgggctgcaggaattcgtctcacccctagaaaaaacctgaagcccctaccacgataagccctaatcccagcgccacctcgatggcgaccacctctttctttcatccgctcgccgccccgatggaccgcggtagcgtttgttttcgtcgctgcccgttcagcctaaccatccccgcccgtacagcgccccggcgaccggcgccgcttctcgtcgtccgcgctaagcgcgccggcagccagccccctgctgccgccgcctcgcgtcagcccgcgaatcccagcgcggtcccgaagcgggacgtggaagaagaggaggaggaggtcgaggaggagatgccctggatccaggacaaggcgctggacctcgtggagttcactggcaccgtcacacaggccatcccagggccccgtgttggctctagccctgttccatggcttctcgcggttcccctcgcctacgtcggggtctcctttgtgctcgcggtcgtccgcacctgcgcaagttcacctcgccgcacactaagaagaagcgaagggtgagtaagaatatattcttgttgaagtcactagatgatctgtttcagaagggcaggaaggcaaataattatcctgctctncaggacctaatgcaaaagacaggatttgacatggatgatgtagtaaggaagtacatcccgttacacactgaaatgaaaacagttcaggtcctgaggtgggttgtggcatctcatacatcctagggaaggcatccatgcctggaaaatgccgaaaattggctgaaaattttta

SEQ ID NO: 85994 - protein, 152 aa, Zea mays
  misc_feature: Ceres CLONE 1572391
MATTSFFHPLAAPMDRGSVCFRRCPFSLTIPARTAPRRPAPLLVVRAKRAGSQPPAAAASRQPANPSAVPKRDVEEEEEEVEEEMPWIQDKALDLVEFTGTVTQAIPGPRVGSSPVPWLLAVPLAYVGVSFVLAVVRTCASSPRRTLRRSEG

SEQ ID NO: 85995 - DNA, 835 bp, Zea mays
  misc_feature: Ceres CLONE 1572392
  misc_feature: Encodes the peptide sequence at SEQ ID NO. 85996
ggcggccgctctagactagtggatcccccgggctgcaggaattcgtctcacccctagaaaaagtgctatccccgcccattcgtcaccagccaggtcccggaaccttatcaccaaatccacacgtcatggggggaggactctgctacaactgggtatggggacgcttcctcggactatcatgccgcaagccagggagcacccacggcctcagccttcctccctcttcacgctgccactgcgctctgtgtcggcgccggcgccagacaggcgggtcttcgagctcgttgacaacgctgtgtacgaagcatgaccgggacaagggtgcggatgcagaaggacggggagttctccgaggaccatcacgctgcttcgtcgggaggctgcgatcagcatcaatcgttgtgtaactggccgggctcatcaagaaagcaggctccgtgagaacgggctaggttgaatactaatagaatgactgggcgtgagacagcgatttggattcgtgcactatgtcttcaactgaaagaaaattggggagcagctggaaaatatcacggcttataatttcaaggaaaacatcaaagggttacatggaggccccccgcacccaaagaataggtccgccacgggggaaccaaagggctgttgaggagggcctgaaggccaaacaaaattggttcccatatagggaagccgggcttcccaggggaaaaaaaagcattagggcggttgataccggaccctcttggaaaaccacccatttttttaaacccaagggaaaagggggccaaaaagtctaacgctcttttttcccaaatggggcaataccgccccagag

SEQ ID NO: 85996 - protein, 43 aa, Zea mays
  misc_feature: Ceres CLONE 1572392
MPQAREHPRPQPSSLFTLPLRSVSAPAPDRRVFELVDNAVYEA

SEQ ID NO: 85997 - DNA, 786 bp, Zea mays
  misc_feature: Ceres CLONE 1572395
  misc_feature: Encodes the peptide sequence at SEQ ID NO. 85998
ggagctccccgcggtggcggccgctctagaactagtggatcccccgggctgcaggaattcgtctcacccctagaaaaccaccagcggcatctatagcaaccggtccaacactttcacgctcaggcgctcagctctagcaatggctgcctccaccatggcgatctcctccacggcgatggccggtacccccccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgagggctaccgtattgccggcgggccgctcggcgaggtcgtcgacccgctgtaccctggcggcagcttcgaccccctcggcctggccgacgaccccgaggccttcgccgagctcaaggtgaaggagctcaagaacggccgcctcgccatgttttca

SEQ ID NO: 85998 - protein, 191 aa, Zea mays
  misc_feature: Ceres CLONE 1572395
  misc_feature (32)..(191): Pfam Name: Chloroa_b-bind Pfam Description: Chlorophyll A-B binding protein
MRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFS

SEQ ID NO: 85999 - DNA, 924 bp, Zea mays
  misc_feature: Ceres CLONE 1572396
  misc_feature: Encodes the peptide sequence at SEQ ID NO. 86000
  misc_feature (924)..(924): n is a, c, t, g, unknown, or other
tccccgcggtggcggccgctctagaactagtggatcccccgggctgcaggaattcgtctcacccctagaaaaaatccgctagggtctataacgacacagaaaatggctcaaaaaccggtcttccacactaacgaacgaactgaggtcaacaacaactgatcgaccaccgacaatggcggctgtgctgaacacctggaaaaccccccaggtggttcccatgctggtggcggcggccctgctggcgtcttccgtttcggcggcaatcacctgcgggcagggggggtcgtcgctggctccgtgcatcccgtacgcaacggggagggccatcgcgctccccgcgtcgtgttgcagcggcgtcaagagcttcaacagcgcgacccgaaccagcgcggaccaccaggcggcttgccgctgcctcaagagccatgccaacagcgtaaagagtgttaacatgggaaccgtcgacacaatccccggaaagtgcggcgtcttccgtggaatttccccatcagcatggtcccacccatttggcagaaagatccgctaatttttacaaacgaccaaccttaataaaccctttccgaacggtacaacttacgtccccgcgcgccttcaatgaattgattgaaaccctgggaaaaaaaataaaataaaaaccacgctggtattggcccaggaagcaaaactgaaggtaaccgaacccaaaaatataaccggggagggggggacacccccaacatataaagggcaaaggggtcgcgccccgccaaaaagaaagattggatttcctaacccccccccatcttgtttcccaaacccggaacaccctacccccatggcattcccccgataaggggaggggcgggggttttcccaatattaaagaaaacccaaatgagggggttccaccacaatgaatataan

SEQ ID NO: 86000 - protein, 124 aa, Zea mays
  misc_feature: Ceres CLONE 1572396
  misc_feature (33)..(121): Pfam Name: Tryp_alpha_amyl Pfam Description: Protease inhibitor/seed storage/LTP family
MAAVLNTWKTPQVVPMLVAAALLASSVSAAITCGQGGSSLAPCIPYATGRAIALPASCCSGVKSFNSATRTSADHQAACRCLKSHANSVKSVNMGTVDTIPGKCGVFRGISPSAWSHPFGRKIR

SEQ ID NO: 86001 - DNA, 825 bp, Zea mays
  misc_feature: Ceres CLONE 1572399
  misc_feature: Encodes the peptide sequence at SEQ ID NO. 86002
  misc_feature (81)..(81): n is a, c, t, g, unknown, or other
  misc_feature (87)..(87): n is a, c, t, g, unknown, or other
  misc_feature (174)..(174): n is a, c, t, g, unknown, or other
  misc_feature (200)..(200): n is a, c, t, g, unknown, or other
  misc_feature (274)..(274): n is a, c, t, g, unknown, or other
  misc_feature (384)..(384): n is a, c, t, g, unknown, or other
  misc_feature (400)..(400): n is a, c, t, g, unknown, or other
  misc_feature (422)..(422): n is a, c, t, g, unknown, or other
  misc_feature (488)..(488): n is a, c, t, g, unknown, or other
  misc_feature (533)..(533): n is a, c, t, g, unknown, or other
  misc_feature (549)..(549): n is a, c, t, g, unknown, or other
  misc_feature (560)..(560): n is a, c, t, g, unknown, or other
  misc_feature (623)..(623): n is a, c, t, g, unknown, or other
  misc_feature (671)..(671): n is a, c, t, g, unknown, or other
  misc_feature (680)..(680): n is a, c, t, g, unknown, or other
  misc_feature (695)..(695): n is a, c, t, g, unknown, or other
  misc_feature (701)..(701): n is a, c, t, g, unknown, or other
tccccgcggtggcggccgctctagaactagtggatcccccgggctgcaggaattcgtctcacccctggaggagttccctcntcctcntcagcagcttctgcttgctttgtgggggaaggagagagacacagagcgagagacatatctagtacagaggctagtaagtggtcctcnaacaaacatgttggcggtgttcaacnggcaggtggtggaggtgccggccgagctggtggcggctggcagccggacgccgtcccccaagacgaaggcctcncacctcgtggggcgcttcctggccgcctccgacccgaccgtgtccgtgcagctcggctaccacggccacctcgcttactcccacaccaaccaggcgctcctccgccccangtcgttcgcggccaangaccaggtgttctgcctgttcnaaggggtgctggacaacctgggtcggctgacccaccagcacgggctgtcaagcaagggctccaacnaggtgctcctcttcatctaggcctacaagacgcttcgcgaccgcncgccctacccggccancttcatgctcncccagctcaccggctcctacgccttcgtcctcttcgacaagtccaccaactccctgctcgtcncatccgacccccagggcaggctgccgctcttctgggggatcaccgccnacagctgcnttcgcttctccgacnacatcnacatgctcaaaggcttctgccgcaagcccctcgcaccgtttccacaaggctgcttctactccaacccccctctgagggctccagtgcctccaggacctcaagcaccagggtcacggctggtccg

SEQ ID NO: 86002 - protein, 108 aa, Zea mays
  misc_feature: Ceres CLONE 1572399
  misc_feature (7)..(7): Xaa is any aa, unknown, or other
  misc_feature (68)..(68): Xaa is any aa, unknown, or other
  misc_feature (73)..(73): Xaa is any aa, unknown, or other
  misc_feature (81)..(81): Xaa is any aa, unknown, or other
  misc_feature (103)..(103): Xaa is any aa, unknown, or other
MLAVFNXQVVEVPAELVAAGSRTPSPKTKASHLVGRFLAASDPTVSVQLGYHGHLAYSHTNQALLRPXSFAAXDQVFCLFXGVLDNLGRLTHQHGLSSKGSNXVLLFI

SEQ ID NO: 86003 - DNA, 803 bp, Zea mays
  misc_feature: Ceres CLONE 1572400
  misc_feature: Encodes the peptide sequence at SEQ ID NO. 86004
ctcaccgcggtggcggccgctctagaactagtggatcccccgggctgcaggaattcgtctcacccctagaaaaaatagcatagcagagcaggcgcaccgcacacctcactgccgctcccttctcgtctcgtctcctctcctctcctcggcggatccggcaccgacccaccgcccctctgctcgttccttccgccggaatcgctgctcctctctgtgtgctgtcgatttgtgcggcgactgttagtttggttcggtcccatccttctgttgatcaatggctgacggtgaggatatccagccacttgtgtgtgacaatggcactggaatggtcaaggctggctttgctggtgatgatgcgcccagagcagtgttccctagtatagtcggccgccctcggcacacgggtgtgatggttggaatgggccagaaggacgcctatgtaggtgacgaggcacagtcaaaaagaggtatcttgaccttgaagtaccccattgagcacggtatcgtgaacaactgggatgatatggagaaaatctggcaccacaccttctacaatgaactgcgtgttgctcctgaagagcacccagttctgctgacagaagcacctctgaacccaaaggcaaacagagagaagatgacccaaattatgttcgagacattcaatgcaccagcaatgtatgttgctatccaagctgtccttttcctgtatgccagcggtcgcccaacaagtattgtgctcggatctggtgatggtgtgacccacaccgtgccaatctacgaaggatacccgctccctcatgccc

SEQ ID NO: 86004 - protein, 176 aa, Zea mays
  misc_feature: Ceres CLONE 1572400
  misc_feature (4)..(176): Pfam Name: Actin Pfam Description: Actin
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVLFLYASGRPTSIVLGSGDGVTHTVPIYEGYPLPHA

SEQ ID NO: 86005 - DNA, 827 bp, Zea mays
  misc_feature: Ceres CLONE 1572403
  misc_feature: Encodes the peptide sequence at SEQ ID NO. 86006
  misc_feature (605)..(605): n is a, c, t, g, unknown, or other
gcggtggcggccgctctagaactagtggatcccccgggctgcaggaattcgtctcacccctagaaaaaggcccctgatcctgatttccccaatcgagagtccgagacccgagaggaggcacaggcacctgcgctagctgcagctgcaaatcgtcttccccagatccggcgccgcctagttcgctcctgctcgcgacagcgcccagagccgtccgcgtgcgcccgcagagatcgtttcggggacagccgagcagagcagagcagagcagagctgactctgccgcttgttgcccgttcttggctgctgttgctggcgagagcgcgcatgaggagcggctgatttttgattctctctgtccctccctccctcgcttcgctcgcgcggggtgcgtgcacgtaccatgagaagatgatgcgcgccaggcccaaaggtacattcgccgacgcgatgagggagagctccccctcctcctcctccccctccggctccggcttcggcagcggtgaaagaggacgagtgggacgtgcggcccggcggggatgcttgtgcagaagcggagcccctacggcgacgcccccgccgggggcgctccgtccccccaaccnaaattttccggggtttcaagggtaaaatttttaaaggggggggtccccaccggggagaatttttttagaaacccccccgggctctttttttggggaaaaaaaaaaaaaaattttttttttacacaaaaaaaagggtgggccccccaaaaaaaaccaaaaaatttgtttttaaaaaaaaaaaaaggggggggggacccccggggggggtttcttgagaaaaag

SEQ ID NO: 86006 - protein, 96 aa, Zea mays
  misc_feature: Ceres CLONE 1572403
MLVQKRSPYGDAPAGGAPSPQPKFSGVSRVKFLKGGVPTGENFFRNPPGLFFWGKKKKNFFFTQKKGWAPQKKPKNLFLKKKKGGGDPRGGFLEKK

SEQ ID NO: 86007 - DNA, 1134 bp, Zea mays
  misc_feature: Ceres CLONE 1572404
  misc_feature: Translation starting site: 28
atttattatatttctccctttcccgacatgaggctgacgtttgtgtttggttgtcgtttgtccggccagcgagggagtacgcggttcctcccgggggtggccgcctctctacactaatggatcccccgggctgcaggaattcgtctcacccctagaaaaactagtaacatttgcatattttggtgaaggtaacatcgtggttcttgatcccacatacaaggaagaagcagtaatgggagggaggatgactgctatagttaactcaaatggggatgtttgtgccattcagaaagctggtggagagggtgtcatgtcaagtgttatcatgcagtgtttaagaattgcttcggtaaaggctgctgatataacaagcaaaataaagaaagcagtagactcatacaccaccgagaaagccctaaagaaagtaaaacgtttgccaacctcggttcctcaaaaaattaatgtcactaatgtaactatgggacggcaaagggtgatggtgaaattggaaaaagcaatctatgccaaaatgcattagtgatggttccagcaaaataagccaaaaaatccccccaaacttttggttcaaagggccaacccaccccgttaaaggaatgcctcaaaacccaattggacccggaaaacccatcctaaaatggccctgaaagggtggaaaaaccccatttcaaaaggtgccctcttggggccccttccccctggaaaaaaaaaatccttttaaaaatcccccccccataggaaaaaaattttggtggagattctcccccccacacaaaaaaagaatttctcttaataaaaaaagataattgtctcttttctcctaaaaaccccccggaaatctccttttttatacgcgcacatgtggtaatgagaaataaataaaaaattttgataccccccggggtgtgttttatgtgtttttaaaatttgtccacacacccccccgcgataaaaaattttttgtaagagcgctccccccccacaaaaaaaaataagagagggagggaggtgtttttaataaaacccctcttctaaaaaacctccttctttaatatttatagaaaagatttttctctccccccggggggggggccaccaactaaggggggttttttt

SEQ ID NO: 86008 - DNA, 820 bp, Zea mays
  misc_feature: Ceres CLONE 1572405
  misc_feature: Encodes the peptide sequence at SEQ ID NO. 86009
ctccccgcggtggcggccgctctagaactagtggatcccccgggctgcaggaattcgtctcacccctagaaaaaatcccttggagccagcaactccactcctgagtcctcacctcgtgctgcccgcgccatttccacctcccactgtcctttcgtccaatccccagccctgcagcccaaccgtggaggttctggaaggcggtgtatcccttctagaaccttctcgagatgcagagcgccgcggctttccggccatgccccactcggctgctggtgagcagcccttgtcgccccctcctctcggcccgcccgcttcgtgcctccgccgctggcgccgtcgctaccagaagcagcgccgtgggccctcgcggtctgcggctcgggctgctgccagcctcacccgatcgggatggcaagtgccgccagctacaggtgtcatgcatcgcggccggggatgctgtggcggcccccaacgctgaagaaggaggcgggctcatgaagacgctgtggctcggctcgctcttcggcctctggtacctgttcaacatctacttcaacatctataacaagcaggtactcaaggttttcccatacccctataacatcacagaagctcaatttgctgtcggaactgtagcagctctgttcatgtggatcactggtattattaagaggtcaaagatttctggagcacagcttgtagcgatcctacctctggctattgatcctactatgggcaagctctttcccaactgacccctgggaaaagttgcagtgttcattacgcacaccatcaaggctagtgagcctttcttttctgg

SEQ ID NO: 86009 - protein, 175 aa, Zea mays
  misc_feature: Ceres CLONE 1572405
MQSAAAFRPCPTRLLVSSPCRPLLSARPLRASAAGAVATRSSAVGPRGLRLGLLPASPDRDGKCRQLQVSCIAAGDAVAAPNAEEGGGLMKTLWLGSLFGLWYLFNIYFNIYNKQVLKVFPYPYNITEAQFAVGTVAALFMWITGIIKRSKISGAQLVAILPLAIDPTMGKLFPN

SEQ ID NO: 86010 - DNA, 845 bp, Zea mays
  misc_feature: Ceres CLONE 1572406
  misc_feature: Encodes the peptide sequence at SEQ ID NO. 86011
ccccgcggtggcggccgctctagaactagtggatcccccgggctgcaggaattcgtctcacccctagaaaaacgaaacctatgccacatccagagccaaagcctgaacctcaaccaaagcccaaccctgaacctcaaccaatgcccaagcctcaaccaaaatccaaaccagagccattgcctacaccgaagcctgaacctaagcccgaacctaagccagagcctaagcccgaacctaaaataaaaccaaagccaaaacctgaaccaaaaccagagcctaagccagagcataaacctgagccaaagccagagcctaaacccaaaccgaaaccagagccaaagccagagccacaaccaaaaccagagcctaagccagagcctaaacccgaaccgaaaccggagccaaagccagagccccaacctaagccagagcctaagcctgagccgaaaccagaacaaaagccagagccacaaccaaagcctgagcctaaaccagaaccaaaaccagagccaaagccagagcctaagcccgaaccaaaaccagagcccaagcctgagcctaaacccgaaccaaggccagaacctaagccagagccaaagcctgagccggaaaccgaaaccagatccaaagccaggagcccacaaccaaagcccagagccctaagccagaaccaaaaaccagaaacccaaaggccggaaccctaaacccccgaaaccaaaaaaccagaagcccaaagccctgggagccctaaaccccgaaacccaagagcgggaaaaccggaaaccctaagggccgggaagccctaaaaccctgaaaccccaaaaaccggaaaaaccggaaaaccg

SEQ ID NO: 86011 - protein, 187 aa, Zea mays
  misc_feature: Ceres CLONE 1572406
MPKPQPKSKPEPLPTPKPEPKPEPKPEPKPEPKIKPKPKPEPKPEPKPEHKPEPKPEPKPKPKPEPKPEPQPKPEPKPEPKPEPKPEPKPEPQPKPEPKPEPKPEQKPEPQPKPEPKPEPKPEPKPEPKPEPKPEPKPEPKPEPRPEPKPEPKPEPETETRSKARSPQPKPRALSQNQKPETQRPEP

SEQ ID NO: 86012 - DNA, 981 bp, Zea mays
  misc_feature: Ceres CLONE 1572408
  misc_feature: Encodes the peptide sequence at SEQ ID NO. 86013
  misc_feature (344)..(344): n is a, c, t, g, unknown, or other
  misc_feature (345)..(345): n is a, c, t, g, unknown, or other
  misc_feature (347)..(347): n is a, c, t, g, unknown, or other
  misc_feature (348)..(348): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (358)..(358): n is a, c, t, g, unknown, or other
  misc_feature (360)..(360): n is a, c, t, g, unknown, or other
  misc_feature (362)..(362): n is a, c, t, g, unknown, or other
  misc_feature (366)..(366): n is a, c, t, g, unknown, or other
  misc_feature (367)..(367): n is a, c, t, g, unknown, or other
  misc_feature (373)..(373): n is a, c, t, g, unknown, or other
  misc_feature (981)..(981): n is a, c, t, g, unknown, or other
aaagctggagctccccgcggtggcggccgctctagaactagtggatcccccgggctgcaggaattcgtctcacccctagaaaaaggaacaattccgcgttgcccatccatcccggaaatatccccaaggaaaccctcgcccccctccttccccgccgccggtcgccagatctccggtcatggacgacgacggcggggcctcccggtcgccctcgccgtccccgtcgcgctctccgtccccgctccccgtggccgaccccgtcacggtcgccgcggcgccgcccggccacgtcgccgtcgctatccccctccgcaagcactcgccttcctccgggcggcggcggnngnngcnnnnnccncnangacnncatgancgacggcgccgcctccacgctcatcgacgcctggggggagcgcttcgtggcgctgggccggggcagcctccaccaccccgcactggcaggaggtctccttatgtcttcttcctcttcgtggacagctactccaaggcggcccaaattctgagagtgctgtgcatacacaccacatttgtatccacatgaaagacggaactacactgggccaataaacggcccaaaccaccgactaacgaacaggccgcctaatttagcaaaaacataacgaacggaccgcggcatgtgccaacatttggttggagcagagctcaaaatatatattcttccattccttctgtgtaagccggatcgatcccgcaggcggtggatggttattccatgataaattgcaatgttagcagatctgcgaccccttcatggattttaaattctattaaaccaattagaatttcagtcgaggaaaccgcggcacgccccgctcgcgtgtgtctcgtttccagagctggggtagagaaagtgctatgactattaacattgaactcctgcgtacaaatatccatattaagagagatagttataatccaggaagtaaaagggtcgcaatn

SEQ ID NO: 86013 - protein, 127 aa, Zea mays
  misc_feature: Ceres CLONE 1572408
  misc_feature (56)..(56): Xaa is any aa, unknown, or other
  misc_feature (57)..(57): Xaa is any aa, unknown, or other
  misc_feature (58)..(58): Xaa is any aa, unknown, or other
  misc_feature (59)..(59): Xaa is any aa, unknown, or other
  misc_feature (61)..(61): Xaa is any aa, unknown, or other
  misc_feature (62)..(62): Xaa is any aa, unknown, or other
  misc_feature (63)..(63): Xaa is any aa, unknown, or other
  misc_feature (65)..(65): Xaa is any aa, unknown, or other
MDDDGGASRSPSPSPSRSPSPLPVADPVTVAAAPPGHVAVAIPLRKHSPSSGRRRXXXXPXXXHXRRRRLHAHRRLGGALRGAGPGQPPPPRTGRRSPYVFFLFVDSYSKAAQILRVLCIHTTFVST

SEQ ID NO: 86014 - DNA, 839 bp, Zea mays
  misc_feature: Ceres CLONE 1572411
  misc_feature: Translation starting site: 460
  misc_feature: Pfam Name: RNA_pol_Rpb7_N Pfam Description: RNA polymerase Rpb7-like, N-terminal domain
ctggagctccccgcggtggcggccgctctagaactagtggatcccccgggctgcaggaattcgtctcacccctagaaaaaacggacgacctagtttccctacgttatgctccttcgtcgccgccctatctttcccgcgagcgggacggcagccgtggtatcctccttcctgcaatgacgagcgggtccaggaaggtagcatcctagcgcccttgtcgcgtcgactgcgcctctgagttgagctcggcggatgcctgcgctcgcaatggaggccctcgggaaagcggaagctgagctcacggggtagatgcaaccctcactacgccaagtgcgtcctgcacaccggctcccgtcagatcagcacactgctcttcacgaatgtggaccggtttgatggagtgttgctgatgcttgaagtttcattccttattggcaaagacgaagatggcaaaccctgtatatgaaaggagtgaccgtgatgatcaaattgctgaacccgtttcttatgagcgaaatcatgaatggcttggtgccatatttcagcgtccaaatgcatgacaccctgctgctcttctctccccagtctgacatgatcctggaacggatggatgaaatgctcgggaaggagtcaattcatgacattgtattaagggtgatctctgtggcaattatgtctgaagatgtatagttcacattcaaatatgaaaactgatggagcgaaaattgctgagcttcaaagatgaagaacacactctgaacattcgacgacgagtgttctctatccaggcaaccctcagagtcgcggtcaccttgacatcagcaccagagactccacaggct

SEQ ID NO: 86015 - DNA, 904 bp, Zea mays
  misc_feature: Ceres CLONE 1572414
  misc_feature: Encodes the peptide sequence at SEQ ID NO. 86016
  misc_feature (904)..(904): n is a, c, t, g, unknown, or other
ggagctccccgcggtggcggccgctctagaactagtggatcccccgggctgcaggaattcgtctcacccctagaaaaactccccgtctgccgtccaccacgcatcgccaagcgccatatctgcaggaagcaccgggccagacacgtcgcttcaccaccccaccccaccccaccccaccttccccttacaccaccaccgcaagccaagaggcacgtccacgcatgggtttcccggcgggctactcggagctggtgctcccgaagcagctgctccacctgctgctgctgctggggtacgtccgccgcttcctcctctgggcgttcgacgccgtgggcctcggcgacctgctggatctcggggacgaccaccaggcaccgccgccgccgcagcagccgcagccgcagcagcaccggcgggcggagttccgggcggccatgccggcgatggtcatcgaggaggccctccccgtggcgcggttcgacgagctggaggcgcgcgtcgaccgcggggactgcgcggtgtgcctcggcggcatccgcggcggcaactaggtgtcgccggctctgcaactgccgccacgcctttcaaccgcgcctgccttcgacggctggaagggagcaagatcagccgcaccctggcccgctcttgccgcgcgccaaatggacccagggggcaattctgggacccgccgaacccccctcccaacctgaaacttccccctactctcggaaccggccccgtgggcatccccccaacccctggcttgcgggcccgaacaaaacctgttttgttagttccaagggggcccctgggcctggaaaacagaagctttcaacccgcccccgaatttggcgggggaaaaaacaccacttccccaccctggcccaacaaggggtctttgccn

SEQ ID NO: 86016 - protein, 109 aa, Zea mays
  misc_feature: Ceres CLONE 1572414
MGFPAGYSELVLPKQLLHLLLLLGYVRRFLLWAFDAVGLGDLLDLGDDHQAPPPPQQPQPQQHRRAEFRAAMPAMVIEEALPVARFDELEARVDRGDCAVCLGGIRGGN

SEQ ID NO: 86017 - DNA, 835 bp, Zea mays
  misc_feature: Ceres CLONE 1572420
  misc_feature: Encodes the peptide sequence at SEQ ID NO. 86018
tccccgcggtggcggccgctctagaactagtggatcccccgggctgcaggaattcgtctcacccctagaaaaaatttcctcgcagtcgcatcgcatccgccctccttgcttccacgcgcgacgcgatttttctattctttttttgggtggtagttggccaggtcggcgtagggatggagacggcggccgcggcgatgctggaggccggggtggggcggttctcgcgggcgccggcgatggccgcggcgctgctggcggagatgtgggcgccgctggccgtggcgctagcggcgctggccacgctgcccagcctgctgcgccgcctgcaggtcatcgtcctgcgcctccgctcccgcgggaaggaggccatccagttgcacatggggacctactactcgtcctgcgacgacgacgacgacgacgaggacggcgacgaagacgagagctccgacgacgaggtcgacgccagctcctcgggcgacgacggcgaggatctgaagcgaatcgggttctacgagggggccgcggacggcgtcttcccctggggcggcgccgtagtccggacctggcagggcctcccgcgccgcttcacggcctgcgcgtcgggcgtgggagctgtccgcggcgccagcggaggagcgttccctgccgctgtcaggctggtgggcgtcggcacggccagcggccagcccgtggtgggcctgcagcgcctaataaaggcggctgccgcgaacgcgcggcccgcggagtgggaccaggtccttcttccgggggggcgggccgagcaccccgtcccaatcagcggcccccgggcgggggtggccctttcccccct

SEQ ID NO: 86018 - protein, 220 aa, Zea mays
  misc_feature: Ceres CLONE 1572420
METAAAAMLEAGVGRFSRAPAMAAALLAEMWAPLAVALAALATLPSLLRRLQVIVLRLRSRGKEAIQLHMGTYYSSCDDDDDDEDGDEDESSDDEVDASSSGDDGEDLKRIGFYEGAADGVFPWGGAVVRTWQGLPRRFTACASGVGAVRGASGGAFPAAVRLVGVGTASGQPVVGLQRLIKAAAANARPAEWDQVLLPGGRAEHPVPISGPRAGVALSP

SEQ ID NO: 86019 - DNA, 1092 bp, Zea mays
  misc_feature: Ceres CLONE 1572421
  misc_feature: Encodes the peptide sequence at SEQ ID NO. 86020
  misc_feature (20)..(20): n is a, c, t, g, unknown, or other
  misc_feature (21)..(21): n is a, c, t, g, unknown, or other
  misc_feature (27)..(27): n is a, c, t, g, unknown, or other
  misc_feature (65)..(65): n is a, c, t, g, unknown, or other
  misc_feature (66)..(66): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (659)..(659): n is a, c, t, g, unknown, or other
gtgggtaagagggcggtggnnccctgncacttacaaataaaattacgccacgaaccccccaaaannaaaaannnnncaaagctggagctccccgcggtggcggccgctctagaactagtggatcccccgggctgcaggaattcgtctcacccctagaaaaatttccgcgcagtcgcatcgcatccgccctccttgcttcgcacgcgcggactcgatttttctattctacttttggttggcagttagccaggtcagggtagggatggacaccgcagccgccgctatgctggagaccggggtggggcgcttctcgccggcccccgcaatgggcgcagcgcagctagaaaacatgtgggcgacgctggccgtggcgatagcggcgctggccacgctgcccaatctgctgcgcagcctgcatggcttcgaccagagcatccgctcccgcgggaaggaggccatccagttgcgcatggggacctactactcgtcgtggaactaccaccactacgactaggcctgcgacaaagacgagagctccgactacgaggtctacgcccgctcctcgggcgaccgacggagagggaactcaagccaatcgggggtactactaagggggtccgcgaaactgcggttcttccccactgggggcgggcaccctntaatcacgggaccctgggcaaggggaccaaaccgatggggggcctttcaaagggccttttgtctccgttcggggccctttgtaggaagacctgtttccgggtccggcatttcccctccggggaaatgaaaccggtttccccataacccgcgctgggttgccaagtcttaatcggggggcctgccccagcctaccgggcaaaggaggggccaccaaagaccaaatgatttgggggcccttggtaaggccgggcccaaaaatttataaggtgggggctattccccgcaataaacaggacacccgaaccccgtgcggaaaagggggaggaactcacggttctgggcccgcttacagggggggcgcacggtgcacagagaagaccacaaggtcctctcaaagtaaacccaaaacgtctccggaaggaggaaattaac

SEQ ID NO: 86020 - protein, 83 aa, Zea mays
  misc_feature: Ceres CLONE 1572421
MDTAAAAMLETGVGRFSPAPAMGAAQLENMWATLAVAIAALATLPNLLRSLHGFDQSIRSRGKEAIQLRMGTYYSSWNYHHYD

SEQ ID NO: 86021 - DNA, 835 bp, Zea mays
  misc_feature: Ceres CLONE 1572423
  misc_feature: Encodes the peptide sequence at SEQ ID NO. 86022
  misc_feature (598)..(598): n is a, c, t, g, unknown, or other
tccccgcggtggcggccgctctagaactagtggatcccccgggctgcaggaattcgtctcacccctagaaaaaaccgctccaccgtctccatccacgcgcccgcgcgcggcccggcaacgggagccaaggaaaccgaagccccgatggcgagcttcttccgggacgcgcgcctcccgcagcagcgcgtcgtcgagggcgtcccgttcccggcggtgctggtcccgagcgcccccgcgggcggcgggctcgacgagttcctggcggccgtgcgctccgagagggcgtcccggctggagccgctggtgcgggacgcgggggccctgctgctgcgcgggttccccgcgacgacggccgccgacttcgaccgcgccgtcgacgccttcgggtacgaggagctgccgtacgtcggcggcgccgcgccgcggaccaacgtcgtgggccgggtgttcaccgccaacgagtcgccgcccgatcagaagatccccttccaccacgagatggcccaggttccaacgtttccgtccagactgttcttcttctgtgaagtggagccaaagagtggcggggagacaccgatcgtactgagccattacatcntacagaggatgaatgaagaatttcctgaattcgtggagaaactggagaaagaagggctggtatatacaacggttctgggagagggcgacgacccgtcttcgccaatcgggcgtggaaggcaatcgacattttctcactaaagaataaagccgttgcctgaagaaaagggccgccaagcctcggggatgaaagctgggaatggacccgcccaacggcggtgaaggaccgtcatggggg

SEQ ID NO: 86022 - protein, 197 aa, Zea mays
  misc_feature: Ceres CLONE 1572423
  misc_feature (152)..(152): Xaa is any aa, unknown, or other
MASFFRDARLPQQRVVEGVPFPAVLVPSAPAGGGLDEFLAAVRSERASRLEPLVRDAGALLLRGFPATTAADFDRAVDAFGYEELPYVGGAAPRTNVVGRVFTANESPPDQKIPFHHEMAQVPTFPSRLFFFCEVEPKSGGETPIVLSHYIXQRMNEEFPEFVEKLEKEGLVYTTVLGEGDDPSSPIGRGRQSTFSH

SEQ ID NO: 86023 - DNA, 1122 bp, Zea mays
  misc_feature: Ceres CLONE 1572428
  misc_feature: Encodes the peptide sequence at SEQ ID NO. 86024
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
tttattttttctccccctggtaggcggtgggcgattccttccaccccttctccgtnnnaaaaaaaaaaaaataactggaactccccgcggggcggccgctctagaatagtggatccccgggctgcaggattcgtctcacccctagaaaaaaaaacagcccagatcagcgaaaacactccgctctcccgagaccggacacatggcggcggcggcggtgacgtccaacggcggcgcagtggccgcaaatgggccggcgcccggccggctggcctccgtgtacagcgaggtgcagacgaaccggctcctgcacgcccttcccctcccctccgtcctccgctccaacttctcggtcgtcgacggccccgccagctccgccgcgggcaacccctgatgagatcgccaagctcttccccaacctgtttcggccaaccccttagagcgtcactgggtgcccctcggccgaaagcccgccgggcaaccaggccggctccaaaaatcgccgctttggctcctcgcgggggggacagggaagcccgcgggccgcccacaaaatggtaagtctgggggggaactctgttggaactagtcttagagggggagccggttccccaaaagggagagggaccatctgagaatggggcaggcttaagggggcaaggccccccctgtttcggcgaatcccatcggaaagcggaccccacgggttctcttgtaagacagcctttacgacataccatgagaactcccggggtggagtggccgacaccaagccccaagaaaaaatccaaggctgtgcgtggaaaaattttgaccattgtgcggaagtccccttccagtcaggcgcaaaatgggcaagcgaaattcgttcgtgtatacacccctccgtcatgccaagagtcccaagacggtaaatatctcacagatgctaccccggatgacttaacagcgacgaggaggaaatatcatcgcgactcggcagcttatgtcaccttcctcatcgaggcgggcgtgtgaaggcgaaaggcatgaaagctgcagctgtgcctactggccctgaatgcggaggggggacaacacagacgctaggaggctcccgtgccgcatctacggcccgaaaatgcg

SEQ ID NO: 86024 - protein, 63 aa, Zea mays
  misc_feature: Ceres CLONE 1572428
  misc_feature: SWISSPROT Homolog: EC 2.7.1.90 Diphosphate--fructose-6-phosphate 1-phosphotransferase
MAAAAVTSNGGAVAANGPAPGRLASVYSEVQTNRLLHALPLPSVLRSNFSVVDGPASSAAGNP

SEQ ID NO: 86025 - DNA, 1199 bp, Zea mays
  misc_feature: Ceres CLONE 1572429
  misc_feature: Encodes the peptide sequence at SEQ ID NO. 86026
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (861)..(861): n is a, c, t, g, unknown, or other
gattttttttgtcatccctcctgcgtcgcgcgggggtttttaacgtggtgggcgcgcgggggnnanaggannnnnaaaagtggggctccccgcggtggcggccgctctagaactagtggatcccccgggctgcaggaattcgtctcacccctagaaaaaaaaaccaggccagatcagcgaaacacactccgctctcccgaagaccggacacatggtcggcggcggcggtgacatccaccgggggcacagtggccgcaaatgggccggcccccggccggctggcctccgggtacagcgaggtgcacacgaaccggggtcctggacggcccttcccctccccgccgtcctccgctccaacttctcggtcggcgacgggcccgccagctcctccacgggcacccccgatgaagatcgcgaaactcttccccaacctgggtcggccagccccccgcgccgctggagccgtctgccgagcccggggcgaccagggccccccaccaccgggcgttgtgctccccccgtggaaaggcgcgcagggggccccgcaatgggtcttcgggggggccgctgttggactctcctacagggactcgttccaaacgggaagccccccccgaccaaaggccctaaaaggggagggcccagggggggggaccccaggacccgggggcagggtcgtgggggagaacgcgtcgcacctcgcccagagactgtttggcggcacggtcccggagccggtgggagcccccgcgggcgcggggaatatttgaaaaagcgcggacctcagccggagtgagggcaagcggcggccaactaagagcggagccgagcaaaaaatgcaacggcgggcaggcccacgtncgcactaggtggacacgccccttagaaaacacgacctggtgcgacgccatcaagcggcctcccgaaggcgctggcggagatcgtgccacctgttcaggcaaccgccccacgcgggagtcgcgcggcgctagagaggctatagagcccaacgcagataggggagcccgggtggcgcatctccacggcggggcgcaaggcagcgtacgaggctgcgacgggcgaggacgttgcggtagacggcgccggggggggtcccacaacgcagcgccgcgcctcagttggaggcgcatacgaggacgcgggcgacctacccggctcgaactatggcggcgacatgg

SEQ ID NO: 86026 - protein, 121 aa, Zea mays
  misc_feature: Ceres CLONE 1572429
MKIAKLFPNLGRPAPRAAGAVCRARGDQGPPPPGVVLPPWKGAQGAPQWVFGGAAVGLSYRDSFQTGSPPRPKALKGEGPGGGTPGPGGRVVGENASHLAQRLFGGTVPEPVGAPAGAGNI

SEQ ID NO: 86027 - DNA, 1146 bp, Zea mays
  misc_feature: Ceres CLONE 1572432
  misc_feature (52)..(52): n is a, c, t, g, unknown, or other
  misc_feature (57)..(57): n is a, c, t, g, unknown, or other
  misc_feature (58)..(58): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (1146)..(1146): n is a, c, t, g, unknown, or other
gcctgtagatttcctctttaagacaaaaaaatacatttactatatctcctcngctgnnggctgggcgggtnnncaaactggagctccccgcggtggcggccgctctagaactagtggatcccccgggctgcaggaattcgtctcacccctagaaaaatctctcctcgatgctcccgacgcggcacagcagagacaccaggaggagaggatggagataaggaaaaaggctaggtcaaaaatcccctccccctccccaaatcctaccccaataatgctctcaatcatgggattcgtacgtctgatgcaaggtcccgaggattccggacggcgcagccttgaacgagaacgctctccgtctccgaggagctcaacgccaagcacaacaagatctggaagaagtgtcttctacagcactcctgagaataggagaatgcgcacactgccagtaagaacggtcctccatggcgcaagtagtgagtctagggcatcttgatatgcatgagatgtgtactaaggttctgaacaagcctgggggcgcacgatctctaaggcgcagagtctcgtcacccctgtgatcatcgtggctggcccagagcaacgttgtccttggattccactccattgcggcaaccctaaaaatcccagatggcctttcggggaaagccagcaacctgcccagaacttaacctagcgattaggggcaatgagaaatacccaggagattttccttcctgtcgccagcaaagatgtgaagggacctaaagaagatcggcggtacccacagggaatgtggaaaagatctcaacaagatcttttccggctccaggggggtctcggtgattggaaggaagcaggccccgaggggatccccccgaggggtatattggcattaatcagggaactttgtaaccattggcgtcccaaaaggaattccttttgattttatgagagtcaaaaaacgggggaaggcttttccacgcaggcgaagtttctccggagggcataaaagaatggccacacatgcccaccggcttgtcaaagggaaatatgtgtgtggcttatagagagcagtacaatcgccttgaatgccccccgtgtgatcgggttggcggaaacaacacacaatatgttgtgccacaagggggn

SEQ ID NO: 86028 - DNA, 837 bp, Zea mays
  misc_feature: Ceres CLONE 1572433
  misc_feature: Encodes the peptide sequence at SEQ ID NO. 86029
  misc_feature (657)..(657): n is a, c, t, g, unknown, or other
ctccccgcggtggcggccgctctagaactagtggatcccccgggctgcaggaattcgtctcacccctagaaaaaactccccactaccagctgctccctccctccttcccttccctcctacctctctctctctcttcctccgttcgtctcttgactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagaccctgatcaggaagctcaccaggggcggcaagcacgcggagctgtggtcgcagcccaagggcggcggcaaccagggccacaagggcaataatggccagcagcagaaacagcagcagccgcagaaccagaaccagaaccaccagcagaagcagaagcaaggtgccaatctcagcaaggatgggcacaacaagaacagcaacggcggccagaaggaccaggggaaatcaaggangaggaggaggggcttgggggcctcatgcaggggctcaagggcgttcaagaaacagcacgggcaacaagccacagcttcccttgagctcagctccggacgaacgatgacctggtttgacgaccgaccacgaaggagggagttttgacgaacgacctacgagggagggagcttccgctttct

SEQ ID NO: 86029 - protein, 186 aa, Zea mays
  misc_feature: Ceres CLONE 1572433
  misc_feature (16)..(76): Pfam Name: HMA Pfam Description: Heavy-metal-associated domain
  misc_feature (139)..(139): Xaa is any aa, unknown, or other
MTKDEEFKLVKIQNHALKVNIHCDGCKHKVKKLLQKIEGVYSVAIDVDNHKVSVTGDVDSETLIRKLTRGGKHAELWSQPKGGGNQGHKGNNGQQQKQQQPQNQNQNHQQKQKQGANLSKDGHNKNSNGGQKDQGKSRXRRRGLGASCRGSRAFKKQHGQQATASLELSSGRTMTWFDDRPRRREF

SEQ ID NO: 86030 - DNA, 1055 bp, Zea mays
  misc_feature: Ceres CLONE 1572436
  misc_feature: Translation starting site: 250
  misc_feature (52)..(52): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
gatggttttttcgaccccgtcatcttatagtgctattacgtagtctccaccntgttgtttattagtagccaannnaaaaaaactggagctccccacggtggcggccgctctagaactagtggatcccccgggctgcaggaattcgtctcacccctagaaaaaacacccgcgtccgccaccgccgccgcctttcgtaccgcggcccctaaacccctttcctcggtcccctccgtctctcacttaggcacaatgatgctagctaataagcttggtggtttgctcaagaatgctacgagttcaaagagttcaaatatgtctgtctaccaagcaatcagatgcatgtcatcatccaagctttttgttggagggctttcttatggaaccgatgatcacagtctcacagacgagtttgccaaatatggacaagttattgaagttatgcctcaatctgtccagctaagattatccttgatcgtgagtctgggcccaccagaggttatggctttataacttacacgtcttctgaggaggcttcggctgccatcactgccatggatggaaagactctggatggacagaacataccgggctaatcatgtctaacgagagggacaggtggccttcccgcacccagcaggggggttaatggatgggtggccggcctatgggtgagtgggttggtgggcggcctaatggagggcgggtggggctattgggcccgccgggcttattgggttgggttgggctcacaccaaagtggggcatattgcgcaaggccgagcccggcccagcggggggggacccaattcgctagggccaggaccaaacacattgcgcatttgttggtttggaccaaaccttacggggcctaaccgaggggccgttgaggttgacttcgcccacaaattgtggggttcacaccagtttaacaccttaattcccctttgtgaaacaaaggtgttaaatctttgaaaaaggcacttgctcggcctcagggagagtatgtggtctccacggcggagttattaccggcacgaattctctggagtcccaca

SEQ ID NO: 86031 - DNA, 845 bp, Zea mays
  misc_feature: Ceres CLONE 1572438
  misc_feature: Translation starting site: 138
  misc_feature (264)..(264): n is a, c, t, g, unknown, or other
  misc_feature (845)..(845): n is a, c, t, g, unknown, or other
acccgcggtggcggccgctctagaactagtggatcccccgggctgcaggaattcgtctcacccctagaaaaaacacacacacacacacacacgcacactcaagagcaacagctaagcctctcccacaagacagcaacatggctgaggaggaggccaagaaggtggaggtggaggtcaccaaggagcccgaggcggcggcgaatgaggacgtacccgatgacaaggccgtcatccccgcgaccgacccgccgccgaccgacgcgnaccggccgtgcacgacgactccaaggccctggccatcgtccagaaagttgcagatgaacctgctcccgagaagcctgcttctgcgaagcaagggtgctccaatgacaggaatctctgctctttgcgaggggtggaacaacatgaaaaacagggacctcttttgattcaaagcttggggagacgatgagaagaccaaagctgaagaaacaaggggctgctaaaagaaaaggaaattccgcctatttccttttatgtgggaaaaaacccagaagaaaggcgacccttttaaccggaactggaggaaaattttggggaaccaccctgaaaaaaaaaaaaaaggggtggaaattttggccgaaaaaaaaaagaagaaacccccggtttgcaagggggtcccccccccggggggccccgaagaaaaaagagggggacgacctttgggggggggaggagaaaaaacaacgcgggggaggaaagatgtcttcctggagggccccccaaaaaaaaaaggggttgctcccaaaaaccggggggggccccccgggccctctcttttctacaaaaaaaacaactctcccgtn

SEQ ID NO: 86032 - DNA, 815 bp, Zea mays
  misc_feature: Ceres CLONE 1572439
  misc_feature: Encodes the peptide sequence at SEQ ID NO. 86033
ctccccgcggtggcggccgctctagaactagtggatcccccgggctgcaggaattcgtctcacccctagaaaaacttccattcacccgcagctcccatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaacaactatgcagctgcctactgcactggcccttctgttggctcgccgtgtgctccaaaacccgggggtttggaatcagggaaacccaaagggccaattttttagggcccctggggaaggaatttttttttaaacccacttaataaaagagggcctttccggggcccccctgggaagggggcctttcccgggaccccaaaggggaaacccggtttttgggggccccccaagggggaatttttgttgggggggcccgtaaaatttccctccccccaaaaaaaagttttttgtgtattctaaaaaaagaaaaacacaactcttgggggttttttaaccccccccccggcggggaactttttttttggggggggccatttttttttaat

SEQ ID NO: 86033 - protein, 127 aa, Zea mays
  misc_feature: Ceres CLONE 1572439
  misc_feature (27)..(119): Pfam Name: Ribosomal_L18p Pfam Description: Ribosomal L18p/L5e family
MGGFVKTHKTNAYFKRFQVKFKRRRAGKTDYRARIRLINQDKNKYNTPKYRFVVRFTNKDITAQIISASIAGDMVLASAYSHELPRYGLEVGLNNYAAAYCTGPSVGSPCAPKPGGLESGKPKGPIF

SEQ ID NO: 86034 - DNA, 821 bp, Zea mays
  misc_feature: Ceres CLONE 1572440
  misc_feature: Encodes the peptide sequence at SEQ ID NO. 86035
  misc_feature (676)..(676): n is a, c, t, g, unknown, or other
ggcggccgctctagaactagtggatcccccgggctgcaggaattcgtctcacccctagaaaaaagtcctcctcctgttctttgtttcccgtcccatcgtgtgtgagcgcgtctgctggtctgccaagaggaggaaaggaaggagagagatggcttgccctgcgcagtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccggcgccggcgcaggaagaccccgactgcaacgaggaggagtgcgccccggagaaggaggtcgggagcctgagcgctgagtggctggccgaggagaggacccaggtcgtcggcactttccctcccaagaagagagggtggaccggcttagtggagaaggacaccgccggccagaccaacatctactccgtcgagccgatggtgtacgtggccgagagcgccatcagctccggcacggcgggtacgtcggcggagggcgccgaagacacggccgccatcgccgcggggctcgtcctcatcaccgtagccgcggcctcgtccatcctcatccaggtgaaacagagcccagtgccgcaggtgccnggaagccgcctacagcggcccgccgctcagctactacgtcaccaagtttcagcccgcggtgggctgcggccgcgcagaccctcgaggcccccggccccggcgaagcacaagaacggcgccgccgccaaccgtcaaagctccggac

SEQ ID NO: 86035 - protein, 224 aa, Zea mays
  misc_feature: Ceres CLONE 1572440
MACPAQSMLSASGCIFLRSKPQAASQVRGGIIGGGRSSRPFLLTCNASSSPSPSSPAPAQEDPDCNEEECAPEKEVGSLSAEWLAEERTQVVGTFPPKKRGWTGLVEKDTAGQTNIYSVEPMVYVAESAISSGTAGTSAEGAEDTAAIAAGLVLITVAAASSILIQVKQSPVPQVPGSRLQRPAAQLLRHQVSARGGLRPRRPSRPPAPAKHKNGAAANRQSSG

SEQ ID NO: 86036 - DNA, 1007 bp, Zea mays
  misc_feature: Ceres CLONE 1572446
  misc_feature: Encodes the peptide sequence at SEQ ID NO. 86037
  misc_feature (20)..(20): n is a, c, t, g, unknown, or other
  misc_feature (69)..(69): n is a, c, t, g, unknown, or other
  misc_feature (70)..(70): n is a, c, t, g, unknown, or other
taaagtattaccccggtttntccggtcatcatctaaaaaatacaaccgacactcctcttaataaaaaannacaaaactggaactccccgcggtggcggccgctctagaatagtggatcccccgggctgcaggaattcgtctcacccctagaaaaaaccgctccaccgtctccatccacgcgcccgcgcgcggcccggcaacgggagccaaggaaaccgaagccccgatggcgagcttcttccgggacgcgcgcctcccgcagcagcgcgtcgtcgagggcgtcccgttcccggcggtgctggtcccgagcgcccccgcgggcggcgggctcgacgagttcctggcggccgtgcgctccgagagggcgtcccggctggagccgctggtgcgggacgcgggggccctgctgctgcgcgggttccccgcgacgacggccgccgacttcgaccgcgccgtcgacgccttcgggtacgaggagccgccgtacgtcggcggcgccgcgccgcggaccaacgtcgtgggccgggtgttcaccgccaacgagtcgccgcccgatcagaagatccccttccaccacgagatggcccaggttccaacgttttccgtccaaactgttcttcttctgtgaagaggagccaaagagtggcgggggagacaaccgatcgtactgagcccattacattctccaagaaggatggaagggaagaattttcctgaaattccgtggaaaaaaacctgggagaaaggaaagggctgggtaataatacaaggggtttctggggaaaaggggcgaacaacccccgtcttccgcccaatctcggcccgtgggaaggggcaaatccgaaattttccttcccctaaaaaaaataaaaagcccgtttggcttgaaggaaaaaaggggcccgccccaaagaccttccggaaattaaaaccttgggaaatgggaacccggggccaaaagggtgtgttggaagataacgggcccaatggggggggcccacattcca

SEQ ID NO: 86037 - protein, 133 aa, Zea mays
  misc_feature: Ceres CLONE 1572446
MASFFRDARLPQQRVVEGVPFPAVLVPSAPAGGGLDEFLAAVRSERASRLEPLVRDAGALLLRGFPATTAADFDRAVDAFGYEEPPYVGGAAPRTNVVGRVFTANESPPDQKIPFHHEMAQVPTFSVQTVLLL

SEQ ID NO: 86038 - DNA, 820 bp, Zea mays
  misc_feature: Ceres CLONE 1572450
  misc_feature: Encodes the peptide sequence at SEQ ID NO. 86039
  misc_feature (717)..(717): n is a, c, t, g, unknown, or other
tggcggccgctctagaactagtggatcccccgggctgcaggaattcgtctcacccctagaaaaaaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgactgtgccaaacaaaagcagtttcatttccttccttgcagctagcagcgatgattcttgtggcgatagtggcggagctgctcgaggagtacaccgcgctgggtggcgcgggtgctggagcagctgctcaacgacgcgccggtcccgcgccggatgcgctttctcatgctgcggagcctccccttgtggcgccggctctgcccccgaccgcgccgccgnaggccgtcaagtttacacccgagtctgattattggctccatttttctcaagggtttcagcccaactgccggccatgggccgcccaccccactagcctgggcat

SEQ ID NO: 86039 - protein, 63 aa, Zea mays; identical to SEQ ID NO: 8705
  misc_feature: Ceres CLONE 1572450

SEQ ID NO: 86040 - DNA, 843 bp, Zea mays
  misc_feature: Ceres CLONE 1572451
  misc_feature: Encodes the peptide sequence at SEQ ID NO. 86041
  misc_feature (667)..(667): n is a, c, t, g, unknown, or other
ggagctccccgcggtggcggccgctctagaactagtggatcccccgggctgcaggaattcgtctcacccctagaaaaaactccccactaccagctgctccctccctccttcccttccctcctacctctctctctctcttcctccgttcgtctcttgactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagaccctgatcaggaagctcaccaggggcggcaagcacgcggagctgtggtcgcagcccaagggcggcggcaaccagggccacaagggcaataatggccagcagcagaaacagcagcagccgcagaatcagaaccagattcaccagcagaagcagaagcaaggtgctaatctcagcaaggatgggcacaacaagaacagcaacggcggccagaaggacagggcaatcaaggggagagatgnaggggctgggggccttcatgcaggcccctcaggcggttcagaaaccagcacgggaaacaggcaccagctcccctgagctcagtctcggacggagaatgacctgtttggacgactacgaccgagggaggaattttgacgaccgactccaagggaggagctcccgctttcttggggga

SEQ ID NO: 86041 - protein, 165 aa, Zea mays
  misc_feature: Ceres CLONE 1572451
  misc_feature (16)..(76): Pfam Name: HMA Pfam Description: Heavy-metal-associated domain
  misc_feature (141)..(141): Xaa is any aa, unknown, or other
MTKDEEFKLVKIQNHALKVNIHCDGCKHKVKKLLQKIEGVYSVAIDVDNHKVSVTGDVDSETLIRKLTRGGKHAELWSQPKGGGNQGHKGNNGQQQKQQQPQNQNQIHQQKQKQGANLSKDGHNKNSNGGQKDRAIKGRDXGAGGLHAGPSGGSETSTGNRHQLP

SEQ ID NO: 86042 - DNA, 836 bp, Zea mays
  misc_feature: Ceres CLONE 1572453
  misc_feature: Encodes the peptide sequence at SEQ ID NO. 86043
ctccccgcggtggcggccgctctagaactagtggatcccccgggctgcaggaattcgtctcacccctagaaaaaatccgctagggtttatctgctcgaggaatggcgtcggtgcaggtctccggcgcgggggtcggtaccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgacgtagttgctgttggagaaggaaggataattggggataagaaagttgatgtcagcattcaggttggagctcaggttgtgtattctaagtacgctggaaccgaggtcgcgttgaacgatcacagccatctggttctcaaagaggatgacgttataggtatcttagaaactgatgacgtgaaagacatgaagcctctgaacgaccgtgttctaatcaaggttgctgaagctgaagacaaaactccaggaggcctactgcttacggaaactgccaagggagagctatctatcggaacggtcgtagcggttgggccagggccccctggacgaggatggcgagaggctccccgctgtccgtcttccgcggggagcactgtcctggtacttccaagtacgccgggcggcgagtttcaaggggcgcggacgggcacgaactacatc

SEQ ID NO: 86043 - protein, 245 aa, Zea mays
  misc_feature: Ceres CLONE 1572453
  misc_feature (62)..(153): Pfam Name: Cpn10 Pfam Description: Chaperonin 10 Kd subunit
  misc_feature (160)..(235): Pfam Name: Cpn10 Pfam Description: Chaperonin 10 Kd subunit
MASVQVSGAGVGTAAFSVKGKASTGALRLRSTLTFGEVCPARRAFRGLVVRAATVVAPKYTTLKPLADRVLVKINSSEEKTTGGILLPTTAQSRPQGGDVVAVGEGRIIGDKKVDVSIQVGAQVVYSKYAGTEVALNDHSHLVLKEDDVIGILETDDVKDMKPLNDRVLIKVAEAEDKTPGGLLLTETAKGELSIGTVVAVGPGPPGRGWREAPRCPSSAGSTVLVLPSTPGGEFQGARTGTNYI

SEQ ID NO: 86044 - DNA, 828 bp, Zea mays
  misc_feature: Ceres CLONE 1572454
  misc_feature: Translation starting site: 132
caccgcggtggcggccgctctagaactagtggatcccccgggctgcaggaattcgtctcacccctagaaaaaaaaggtcgattgttctccctccttctctgcctgaccagataggatcaacggaagcagcaatggtgatggcatcatcaagcgggatgatgagctgcagcgccttgggcgtgcccagcctgctggagccgtcttcccagtccggccgcctggcgcccttctgcgccaacgccaccacctctggccgcgtcaccgtgtccgcggagtggatgcctggccagccacgccctgcctcacctcgacggcacctctcccggggactttggcatcaatccgctgtgcctcgctaccgtgggagagaacttccagctcctcaaggagtcagaggcgtacaactgcggctgggacaagctagctgtacctgggatcctggtgccggaagctctggggctgggcaactgggtaaacgctgacgactgggcggtcgtccccggacgagatgccatgtaactgggcgccccggtgccgtggggaacgctgccgactatccaggtgatcgtagttcgtgggcatcggcttcgccgaacaccaagtcaccactggagaatgaacccccacaacaaaaattaccacggaggccgccttccagccagctcggagtaccctcaggaccccggccgagattacaggactacaagggtcattgccgatcccctaacggcccccctgcgccaggcttgccccttcagaagggcttcctgaaggccaggctctaccggccgtaacccgcgggaaacccgggcccgaaatgggagcaac

SEQ ID NO: 86045 - DNA, 863 bp, Zea mays
  misc_feature: Ceres CLONE 1572456
  misc_feature: Encodes the peptide sequence at SEQ ID NO. 86046
aaagctggagctccccgcggtggcggccgctctagaactagtggatcccccgggctgcaggaattcgtctcacccctagaaaaaatcccatcctgatctctcctcccttcttcagtgcagcagcaggccagcggcacgccacccgcctcactcccgcctccgatccgctgcttactcgccacccggagatggccaccgccgccgccttctccgtctcctcgccggcggcctccgccgtcgccgcgcgatccaaggtgtttggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacggcagagctattgccttggagctgaataaccctgttattaatcaagggacttgttggctacactttcaggtctctactcgggggactgggatcaactgggggtccttcggctgcaggagttccctgacagaagaattaccttttcctggaagagctagaaggtgctgggataatcggttccgcccgtaccttgggggggctaacctcaccaaggaaagtgtccttttcctaatgggattggcttcggcggtgtaacccctcgtgggctcca

SEQ ID NO: 86046 - protein, 142 aa, Zea mays
  misc_feature: Ceres CLONE 1572456
  misc_feature: SWISSPROT Homolog: EC 2.6.1.1 Aspartate transaminase
MATAAAFSVSSPAASAVAARSKVFGGVNQARTRTGCRVGITRKNFGRVMMALAVDVSRFEGVPMAPPDPILGVSEAFKADKSELKLNLGVGAYRTEELQPYVLNVVKKAENLMLEKGENKEYLPIEGLAAFNKATAELLPWS

SEQ ID NO: 86047 - DNA, 798 bp, Zea mays
  misc_feature: Ceres CLONE 1572458
  misc_feature: Encodes the peptide sequence at SEQ ID NO. 86048
ctccccgcggtggcggccgctctagaactagtggatcccccgggctgcaggaattcgtctcacccctagaaaaaaccaacccatccatcctccagtcctcagtccagactccagagtcctcaccggcttctccccgactccccgtcaccgatggagctgttcgcgcgcgcgaaggtggtgcggctcaggagccaccacgacaagttcctgtacgcggacgaggacgaggtgcgcgtgacgcaggaccgggacgggtcctcggcgaacgcgcggtggaccgtcgaggcggcgccgcacagcgcgggcgccgtccgcctgcgcagccgctacgggcgctacctcaccgcctccggggagccgttcctgctggggatgacggggcggaaggtgacgcagacggcgcccgccgcgccgcgcccggccaacgcgtccgtggactgggagcccctgcgggacggcttccaggcgcgcctccgcaccaaggcgggccacttcctccgcgccaacggggggctcccgccctggaggaactccgtcacccacgacgtgccccaccgcaccgccacgcaggactgggtgctctgggacgtcgaggtcgtgcagctcctcacgcccgcgccgccgcccgagcgcaccggctccgcgcccgtcgccaagttgccggactcgccgcccgcggcggaactcggcaagccaccgcaggcgcacggggcgcacccacggccattccaagtctacgcgaagccaccgcccaggctcgagcccgaggggccgccgccggccgccgtccaaggtcaa

SEQ ID NO: 86048 - protein, 216 aa, Zea mays
  misc_feature: Ceres CLONE 1572458
  misc_feature (1)..(145): Pfam Name: DUF569 Pfam Description: Protein of unknown function (DUF569)
MELFARAKVVRLRSHHDKFLYADEDEVRVTQDRDGSSANARWTVEAAPHSAGAVRLRSRYGRYLTASGEPFLLGMTGRKVTQTAPAAPRPANASVDWEPLRDGFQARLRTKAGHFLRANGGLPPWRNSVTHDVPHRTATQDWVLWDVEVVQLLTPAPPPERTGSAPVAKLPDSPPAAELGKPPQAHGAHPRPFQVYAKPPPRLEPEGPPPAAVQGQ

SEQ ID NO: 86049 - DNA, 835 bp, Zea mays
  misc_feature: Ceres CLONE 1572459
  misc_feature: Encodes the peptide sequence at SEQ ID NO. 86050
ccccgcggtggcggccgctctagaactagtggatcccccgggctgcaggaattcgtctcacccctagaaaaattccttcagggaacggcttccatagcgctgaagcgaggcgtgccgcattgggttgttcgagagctcctagtgttgccctactacatgatggagggcgatctccccacgcccgcgaacgctagggttgttgccgtggtcaccggcggcaacaaggggatcgggctggaggtgtgccggcagctggcctgcagcggcgtcaccgtcgtcttgacagccagggacgacgcgaggggcgcggcggccgtggagaacctcagaggcctggggctctccgatgtcctcttccaccgactggacgttaccgacgctccgagcatcgctcaactcgctggtttcctcgagacccgtttcgggaagctagacatcctggtaaataatgccgcgattggcggggttgagtatgttcatgaccaagattgtggctcagtaacgagcgaggaaaaggcaaagttgagcggcatggacatggatcagaggcttggatggctgtgggagaattgccgggagacctacgacgatgcaaagacaggcctacgaacaaactactacggcacaaagcaagtaatcgagactttactgcctctactgcaaagctcctccgatgggaggattcgttaacgtctcctcccactttcggccagctaagggtttttccaaaacgaggaagctgaaagcgggagcttgaaccacatttgaacaaccttcaccccgggaaaggccttggaatggcctggcttggaacgttccttaaaatggaccttgt

SEQ ID NO: 86050 - protein, 176 aa, Zea mays
  misc_feature: Ceres CLONE 1572459
  misc_feature (13)..(134): Pfam Name: adh_short Pfam Description: short chain dehydrogenase
  misc_feature: SWISSPROT Homolog: EC 1.1.1.184 Carbonyl reductase (NADPH)
MEGDLPTPANARVVAVVTGGNKGIGLEVCRQLACSGVTVVLTARDDARGAAAVENLRGLGLSDVLFHRLDVTDAPSIAQLAGFLETRFGKLDILVNNAAIGGVEYVHDQDCGSVTSEEKAKLSGMDMDQRLGWLWENCRETYDDAKTGLRTNYYGTKQVIETLLPLLQSSSDGRIR

SEQ ID NO: 86051 - DNA, 1075 bp, Zea mays
  misc_feature: Ceres CLONE 1572460
  misc_feature: Encodes the peptide sequence at SEQ ID NO. 86052
  misc_feature (14)..(14): n is a, c, t, g, unknown, or other
  misc_feature (17)..(17): n is a, c, t, g, unknown, or other
  misc_feature (50)..(50): n is a, c, t, g, unknown, or other
  misc_feature (52)..(52): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (90)..(90): n is a, c, t, g, unknown, or other
  misc_feature (795)..(795): n is a, c, t, g, unknown, or other
cggtttttgtcccnccntcccgtcttgccggctgatgtactgtaagccanangtttttagatcgcttnnnccccaaactgggactcaccncggtggcggccgctctagaatagtggatcccccgggctgcaggaattcgtctcacccccaaaaaaaatcctgtcgcactccctcgtccctcctcttcgtccagttcactcccattgggcgagaagacgataaggacagggagggagcgagagctagccaggccgtcccgtccagagccgctatgtccggcggcgcgcccctcctggccctgctgctgctggcggcggcggccatgatcgccccgtcgccggccaatgccgccgtgtcataacaccacagggccgtggtcatcaaggagcaacgccccatcctcatctcggagtacatacactacccgcacagcacaccggaatatgcggccgggatctgctgcacaacgtcaaggactgcgggctgagacgtggtccagacgtacgtggttctggaacgggcacgagcctgagatcgtgggcagaaactacttccgcacaccgctaacgagcctcatccacttttcgttaaagctcacccaagtaagtgccggaccttctgacgttcacacactcccgcattcggggcgcattaccgctcctggcctcccgcagttggggaaactttaacggtcgggattttccccccggttgagtggggcctccaaaggttacctttccccaacggagccaagtccaggccactctctcggaaacccggaaacaaaacgggacntccccctttccaaagggaccgggtcctaatgcccaagggcccgttttccgttggggaacaaaagaattcgcgtggtatccaatcggattgaaaagcttcctgggaaagggggcctcggatatccaaaagttgcgccaaggggccccgggcccccaattcaatacccttgggcccccttggggaggtgggcgaatttcaatttcctcggggcccccctggggcaacttcccgcttacttgggggtggccccggccgtctcaaagtcctctatatggccaaa

SEQ ID NO: 86052 - protein, 29 aa, Zea mays
  misc_feature: Ceres CLONE 1572460
MSGGAPLLALLLLAAAAMIAPSPANAAVS

SEQ ID NO: 86053 - DNA, 821 bp, Zea mays
  misc_feature: Ceres CLONE 1572463
ccccgcggtggcggccgctctagaactagtggatcccccgggctgcaggaattcgtctcacccctagaaaaaacgcgccgcgccccctcccgccacccggctgcctctcgccctcttcttcctccctgaaacctgacgctcgccccccatttccgcaactcacggcttgttcttggggatgggcatccagaggaggaaggaagaagaataagcaggaggcctctccccgccagcccaggcaccccgtatcaacaacggagggcggaagaagaagagcgcgtccaggatcatagagggcgtggcgggcggggacggcgccgacgagatagccggaagggtcatttccaactccatcaagaccgtccccagggagtatgttccgacggtggcagacagctacatgggatgcgttgtggatgatgggaacggtgacgacatgaggatcagggacactgctggtcgagaggatgatcactgactgaaagatgagaccgatcgtggagctgatgtgctgcttgtgctgttggagggaacaggacagccagtgatgataatgttgcggagaagtggatccctgatcagaatcattagagacctggagtggcgaacattctcgaaaggacaaagcctgatccttgggaggactagcccttctggggggaccatgatggagcccgtcctatgcctaccgcttcgggagcaggaactaggaggtcccatgagagcgtcataggaccccctagtgcggggaagaaagacccagcatgaccgggaggggtggtcttccatgcgggggaaaaaggtttgtggggaaggcaacc

SEQ ID NO: 86054 - DNA, 839 bp, Zea mays
  misc_feature: Ceres CLONE 1572464
  misc_feature: Encodes the peptide sequence at SEQ ID NO. 86055
ctccccgcggtggcggccgctctagaactagtggatcccccgggctgcaggaattcgtctcacccctagaaaaactccctcccctcgccgtcgctgtcgtcgccgtccgtgctagacatggatctaggcgctcccgcccgacggcgcctaccgatccgcctcttgctggtgtcgctcaccgtcctcgtggtcctcaccgcgcgctccagtgccgaagtcatcaccctcaccgaagagaccttctccgacaagataaaggacaaggacacggtgtggtttgtgcaattctgcgtcccctggtgtaaacactgcaagaaccttggaacactatgggaggacctgggaaaggttatggaacgtgcggatgaaattgagattgagcaagttgactgtggtgtcagcaaaccagtatgctcaaacgtcgatatacactcctacccaacattcaggtgttttatggagggggaagaagtagtaaaatttaaagggacctcagggatgtggaatccgcttaaaaaaccttccgggttgaaataaaggttaaaaaaacccggggcaagggcaaaactcttggaaccctgaattgaaggcccggggggaagttttcaggcccacccctttgtggccccaggtgggccgtttaaaaaaaagggaaaaaaaaggtttttttttcaaaaaaaattggttcctttttttatccccggggggcttttttttaaaaaaagacccccgggttttttctagggggaaaaaaaagaaatacgccctctctttatggaggcccccccgggataaaaaaaaaaaaaaaattatacctctgtgttttccccaacaagaag

SEQ ID NO: 86055 - protein, 139 aa, Zea mays
  misc_feature: Ceres CLONE 1572464
  misc_feature (33)..(135): Pfam Name: Thioredoxin Pfam Description: Thioredoxin
  misc_feature: SWISSPROT Homolog: EC 5.3.4.1 Protein disulfide-isomerase
MDLGAPARRRLPIRLLLVSLTVLVVLTARSSAEVITLTEETFSDKIKDKDTVWFVQFCVPWCKHCKNLGTLWEDLGKVMERADEIEIEQVDCGVSKPVCSNVDIHSYPTFRCFMEGEEVVKFKGTSGMWNPLKKPSGLK

SEQ ID NO: 86056 - DNA, 793 bp, Zea mays
  misc_feature: Ceres CLONE 1572467
  misc_feature: Encodes the peptide sequence at SEQ ID NO. 86057
  misc_feature (769)..(769): n is a, c, t, g, unknown, or other
  misc_feature (793)..(793): n is a, c, t, g, unknown, or other
ctccccgcggtggcggccgctctagaactagtggatcccccgggctgcaggaattcgtctcacccctagaaaaaagagcactcaccattcactcagcttcagtcagcgtatcgcagcaccgcggcgagataatgagcagcctgtcctccggtatctctgcctcaccatctgaagcgcccaataccgttcggcgccgcacttgactgagctccacagcatctgacggtgaaagcggctgcgcggccacagttgatgcatgcccgccgatggcgttccagtgtcccgaggacgccgggaggctgggtggtggtggtgacggccgggcctgggcctctgtgctagatctaccctgaccttgaggaggacgccatcgaggtgtacctgcaccaacggcatcacgccggaagacttcgagtacggcaagtaatacggacaccaacacctatttactaacggcaagacaagaagggcttctgggaggatgtctccgagtggtaccaagaagctgagcctcctcagggctttcaagcactcatctcctgggcatttcctcctgcgatcatcctcggcatggctttcaatgtgccgggggagtacctgtacatcggggcggccgtcttcatcgtggtgttctgcgtcatcgagatgggcaagcccgacaagccgcacaacttcgagccggagatctacatgatggagaggtcggcccgcgacgagctcatcgccgactacaactccatggacatctgggacttcaacgagaagtacngcgagctctgggacttcaccgtcn

SEQ ID NO: 86057 - protein, 74 aa, Zea mays
  misc_feature: Ceres CLONE 1572467
  misc_feature (67)..(67): Xaa is any aa, unknown, or other
MAFNVPGEYLYIGAAVFIVVFCVIEMGKPDKPHNFEPEIYMMERSARDELIADYNSMDIWDFNEKYXELWDFTV

SEQ ID NO: 86058 - DNA, 1273 bp, Zea mays
  misc_feature: Ceres CLONE 1572468
  misc_feature: Encodes the peptide sequence at SEQ ID NO. 86059
  misc_feature (1)..(1): n is a, c, t, g, unknown, or other
  misc_feature (57)..(57): n is a, c, t, g, unknown, or other
  misc_feature (1041)..(1041): n is a, c, t, g, unknown, or other
ntttccctccccccgaaaagctacctctacacccacacctctcgcctgttgtgtatnaagagacaccccccgtaaaagaataaaaaaactggaactccccgagggtggcggccgctctagaactagtggatcccccgggctgcaggaattcgtctcacccctagaaaaatccccgaaaccccacttctcggatcgagactagggttagggttttgtcactcccgccccgattcgaaccaatccgcctaggcccccgccgcgccatggccgccggttccattgtggtggacttcccctccatgggcgccgacctctgcttccccaacctcgaatcactcctccgagactccgcctcgggtttcctctccgccgtctccgccgccccggcccccggcgccaccgacctcaccaacttccaccgcgtcttctcgcgcgtccacagcacctactcagacccaccactcgaggtcgtctggatcctctccgagctcctccctccacgaacagcccttgacgacctccgcctcaactgctagcaggctccaactcccgccctacctccgcattcctccaccatgagggccagcccaaaacctgatttcgacctcttctctcggacatcaccaattcggtacttccccagagcctttttttccccaccctcccacaaaaaaagtacctgtccagccaaagggcaaaccaaacgctgcaagcacagtctccaatccccattcccggagaaggacctttatagatgctctatcagaaggggattttaatcaaatatccccgagggactaaaatacatatgggcccaggggaaactaaggagtgaatgaaaattgctcacatgagattcgcgactacgccccttcccttttattcactgaaaaataatgagaaaaaacggggtctaacctcacatcgtctgtaatagcgcgagaaacactcccacttgtgtgagcgaaatggccgcttatgataattgacccacgagagagccatttattagtcggcgacgcggaaattcactgtattgantacataaaagcgtactaaagagtagaaacatgaagcttgacaccgacccgacctcgccgtacgcggctaaaaccacacgctcccccccccctattttctcagacatcgagatcttccgagtaccccccgcacctcactataagggatccgacctctaggagctcacgacttcttgttcatatcccctctatataaagagaaaggtgttagacagggcgtgatgaactcacag

SEQ ID NO: 86059 - protein, 90 aa, Zea mays
  misc_feature: Ceres CLONE 1572468
MAAGSIVVDFPSMGADLCFPNLESLLRDSASGFLSAVSAAPAPGATDLTNFHRVFSRVHSTYSDPPLEVVWILSELLPPRTALDDLRLNC

SEQ ID NO: 86060 - DNA, 1333 bp, Zea mays
  misc_feature: Ceres CLONE 1572469
  misc_feature (44)..(44): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (965)..(965): n is a, c, t, g, unknown, or other
  misc_feature (981)..(981): n is a, c, t, g, unknown, or other
  misc_feature (1272)..(1272): n is a, c, t, g, unknown, or other
aaaaaaaagatgccaaatatttattacaagtaaaacaaaatacnaaaataatttgtttnnnnnnnttnnnnnnnccaaactgggactccccgcggtggcggccgctctagaactagtggatcccccgggctgcaggaattcgtctcacccctagaaaaattgatttatctcatacgacttatcaagaaggcaggtcggctaggagggctcgaagaccgaataccgacccgtgcgggggctcgggacggcaacgggacaggaccccaaaatcgtgagatccttcctgcccgctcgcccgtgcccgacgacgcctcgttattgccggccgcgcccatactccgccctctcctcctacagggggatcggatacaccccaggctgcgcgatagtgctaccggacttctgctacggatacctcgtctggaatcccggcttcgacttcgacgacccaaagcctcggcttcatcgagggctacaagcgcaccttttaatctagcttgcatagaccacagaggtcacaccctgacatatccctgcgaaggactttgcacgccttgcacacccaacgacacaggcagatatggctttggggcaatctgcaataattgttgttcaaagggcgtggctccccttagaaaaagaaatcttaaaacgcgcaattaccaggtatacttctgggcaagaaagaaaacataaaaggtgggtggaggtatcccgtaacacttggataaacaatcatatgtcccgaatcttgggcatgtttccccttatacgagaagggggaatatgggggagcaacaaacctcccccttttttgtgtaaaaaaaatgtacatccacgcggtctctttgtctgtgaaaaaaacaccgggggggggactcggcaaaataccccgtgtcttatataaaaatgggagctcatctcgccccctattgatattttccgacaattctgagttgcccccngattaaaaaatttccntgccaaacaaaatattttggtggagttttaacatacacaaaaaaaggctaaacctctctaatatccccaaaggtgggaggggctcacttctgtgggacatatctccctctgttattgggcccacaagggatatattagtatgtggacgcccacaaaggtggtcgcacacaaaatttgtgggccctattcgataaatccctcaaaaaaatgtggggcacccccgtatgacctgtgggcgacattaattataaaattaagggggcggaatatacacacccctgtgtttacccnccgcacaatatggggaaagaaaaaagcgcttctttttaactcttcaccactctattatata

SEQ ID NO: 86061 - DNA, 863 bp, Zea mays
  misc_feature: Ceres CLONE 1572470
  misc_feature: Encodes the peptide sequence at SEQ ID NO. 86062
ctcaccgcggtggcggccgctctagaactagtggatcccccgggctgcaggaattcgtctcacccctagaaaaaatcctactgtcacacacacacagagagagacaagtggtttccaaagccaagtgtgtactaacagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccccctcttcggctgaccgtagtaccggccgggcgcgcgaacgaaagctagctagctccggcgcacacaaccacacaccctgtttaattctggaactgcatgcgtgtgtaaatttgaggggtccccaattatgaaatcccctctcccgggaccttggggaacctggcctgtcttggtgggtaaaattaaaaaatgttcaaaaatctagaggggaaaaaaaagatggtggtttttgaggcccctgtgggggcttctctcctccctaaaaaacaagagcggcgtgttttctcgcccaggacacaaag

SEQ ID NO: 86062 - protein, 131 aa, Zea mays
  misc_feature: Ceres CLONE 1572470
  misc_feature (41)..(120): Pfam Name: ABA_WDS Pfam Description: ABA/WDS induced protein
MSEEKHHHFFNHHKKDEEQPAGEYGYSETEVVTATGEGEYERYKKEEKEHKHKQHLGEAGAIAAGAFALYEKHEAKKDPEHAHRHKITEEVAAAAAVGAGGYVFHEHHEKKKDHKDAEEASGEKKHHPLFG

SEQ ID NO: 86063 - DNA, 810 bp, Zea mays
  misc_feature: Ceres CLONE 1572471
  misc_feature: Translation starting site: 116
acccgcggtggcggccgctctagaactagtggatcccccgggctgcaggaattcgtctcacccctagaaaaaatcctcctgcaggcctcctgccgcccggcccgcgccgttgtccatggaagagtctgcgccggggagctgcaaggccgctgcgtcgcgcgcgccccgggtggtgtgcttgctgacgggactgctggagcttgcttcggagcgcggcgacacagcaacaccaacccccgcgggatcagcgttcctgggacacgcactggctgggatccccgtgcggcggtacagcgcaacggatataccggtgcgccgggtgcaccccggcctgcttcgtcgtcgcctaagtctagctccatcgcctcgcgcggggtcgccgtcacgccggcgccggcgacgacgaggaccacgacgacgcgcacgttgtcggcatcaactcggacgtcgttgaccggctcgtcatcagctgcgtgcttggtcgccttccagttcctggacgacaggcaccacgaccacgcctacttcgagcaggttagcggcgagaagatggccgacatgacttcgcttgagctgcgcctcctcttgcccgtgagcttcagcttcatagttgcggcgcacaccttcgcgcggctgtgtaattctgctctagtgccacgtgtaattccctgattcagatgactcgtgcctctcatgacctcgtcctctacttgctatcgggaggatgcagtgtcagactcaagacaaggattgctccgcccgtggcggttccttctagatcagcgtcctgacctcactggattatcttgg

SEQ ID NO: 86064 - DNA, 813 bp, Zea mays
  misc_feature: Ceres CLONE 1572472
  misc_feature: Translation starting site: 169
  misc_feature (334)..(334): n is a, c, t, g, unknown, or other
  misc_feature (336)..(336): n is a, c, t, g, unknown, or other
  misc_feature (338)..(338): n is a, c, t, g, unknown, or other
  misc_feature (339)..(339): n is a, c, t, g, unknown, or other
  misc_feature (342)..(342): n is a, c, t, g, unknown, or other
  misc_feature (344)..(344): n is a, c, t, g, unknown, or other
  misc_feature (345)..(345): n is a, c, t, g, unknown, or other
  misc_feature (349)..(349): n is a, c, t, g, unknown, or other
  misc_feature (351)..(351): n is a, c, t, g, unknown, or other
  misc_feature (360)..(360): n is a, c, t, g, unknown, or other
ctccccgcggtggcggccgctctagaactagtggatcccccgggctgcaggaattcgtctcacccctagaaaaaggaacaattccgcgttgcccatccatcccggaaatatccccaaggaaaccctcgcccccctccttccccgccgccggtcgccagatctccggtcatggacgacgacggcggggcctcccggtcgccctcgccgtccccgtcgcgctctccgtccccgctccccgtggccgaccccgtcacggtcgccgcggcgccgcccggccacgtcgccgtcgctatccccctccgcaagcactcgccttcctccgggcggcggcggnangnngcngnngccncnaggacccanggagcgacggcgccacctccacgctcatcgacgcctggggggagcgcttcatggcgctgggccggggcatcctccgccacccgcaatgacaggaggtctccgagggggtctcctctcgcaacagctactctcaggcgcccaaatccgacgatccagtgcaagaaccgcatcgacacgctcattaggaagtacaaggtcaataaggccgatgacgactccgactggagctacttcgatccgcgtctacaacctgctgaggtcccatgctgatctagcccagttgggcttcctcctcagctgctgatgaaggcggcagaggatgacccgaagccaccggggaccatggtcctctcagggcaaataatttttcggaagtgctactcgaacgcccactggggtgtatttcaagggggggtgactcgcagtattccgtgcccttggtttgactgcaag

SEQ ID NO: 86065 - DNA, 840 bp, Zea mays
  misc_feature: Ceres CLONE 1572473
  misc_feature: Encodes the peptide sequence at SEQ ID NO. 86066
  misc_feature (338)..(338): n is a, c, t, g, unknown, or other
  misc_feature (340)..(340): n is a, c, t, g, unknown, or other
ggagctccccgcggtggcggccgctctagaactagtggatcccccgggctgcaggaattcgtctcacccctagaaaaaggaacaattccgcgttgcccatccatcccggaaatatccccaaggaaaccctcgcccccctccttccccgccgccggtcgccagatctccggtcatggacgacgacggcggggcctcccggtcgccctcgccgtccccgtcgcgctctccgtccccgctccccgtggccgaccccgtcacggtcgccgcggcgccgcccggccacgtcgccgtcgctatccccctccgcaagcactcgccttcctccgagcggcggcggnangtgttccccgcctcaagggccaccgaattgaacggggccctctacaacttctggtagcatgagccgatctatgccggcggctgggagaccgccgactacgtcgtgggcagggtgtacagcccttagagatgctctccagatcagacgatctccttcacgcgcgacatggcccagggttgcagtgtttacagtccaaaccgaggcttcataggtgaagtgggaccctaacaggtggagggaagaacccctttcgggaacttaattcccttaaagtcctttaaaaagtttgagaggggaaaaattttcctgggaatccccccggggtaaaacgggaaaaaaaaaaaaaggggtcttggaaaaattctcccccccatttttttttgaagccaaaaaggggccgaataaagaacccccccgaggtgtcctgtctgcttaaaaaagggcgcgagcgggtagtttattttttctcccataacgcagaactttttgtatgttggacg

SEQ ID NO: 86066 - protein, 74 aa, Zea mays
  misc_feature: Ceres CLONE 1572473
  misc_feature (56)..(56): Xaa is any aa, unknown, or other
MDDDGGASRSPSPSPSRSPSPLPVADPVTVAAAPPGHVAVAIPLRKHSPSSERRRXVFPASRATELNGALYNFW

SEQ ID NO: 86067 - DNA, 813 bp, Zea mays
  misc_feature: Ceres CLONE 1572475
ccccgcggtggcggccgctctagaactagtggatcccccgggctgcaggaattcgtctcacccctagaaaaaagccgatgaacaccgctagctcctatgctagccatggtgccagcgctctctctgagctcacccagcccagccacccctcctctcttcttccttgcggtacttctctgctggccggcgttttcccagcggtggatctccttgtgtgccgcgttcgtgcgtgttccagttttttctatttccaggcgctcgcgccctgctacaactcggctccagctcgatccctagccttcctctctgttcatctccctgccgcgcgcacagggccacgcgaaagatcctctgctcggttccctgctcgctcggtgcccggctctagatcaccggcgctcctccctgtgcccggccggagttccgctgctcggccatggccgccgtcgagcttcctgctcgcacctatctccctcgctgcctgcgtcgtcgaagctccccgtgccgtgcactcgccgtggctccttgttgcggctcgccccaactcggatccgctgcgagctcatcggaaccgcgtccctggatcgccccagcttccatggctgctcgcgaagtccctgtgttggccgcgcagggccttcatcggccatggcgtctcatcttcgctgccccagtttccctgctcccatggggattcccccttggaatccttcccctgtcatgccttagcgaaagtccctgtgcgcgcgccctgaatgtccattcgttgctgccccccgcgtgctccctgggcattccggcttcccttggggg

SEQ ID NO: 86068 - DNA, 843 bp, Zea mays
  misc_feature: Ceres CLONE 1572476
  misc_feature: SWISSPROT Homolog: EC 3.1.3.11 Fructose-bisphosphatase
  misc_feature (257)..(257): n is a, c, t, g, unknown, or other
  misc_feature (264)..(264): n is a, c, t, g, unknown, or other
  misc_feature (265)..(265): n is a, c, t, g, unknown, or other
  misc_feature (714)..(714): n is a, c, t, g, unknown, or other
  misc_feature (730)..(730): n is a, c, t, g, unknown, or other
  misc_feature (736)..(736): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (817)..(817): n is a, c, t, g, unknown, or other
  misc_feature (818)..(818): n is a, c, t, g, unknown, or other
ccccgcggtggcggccgctctagaactagtggatcccccgggctgcaggaattcgtctcacccctagaaaaagtgcccgcgcgctctttgcactccgtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccnggaaccnnccgagtcccgcgggcgaactttcacccatcccctgggcttccttccccaccaatatggggcccctttgggggggggggaaaaaaattttttttttcccccccccccccccccggccgaaaaaaaaaaaaggggggggggggggggtgttttcccccaccaacaaataataaagaggggcggccctcccccgcggggggaaaaaacacaaaaaaaattttttggggggggggggggggggggcgcccccccaaaaaaaaaaaaaagaggaggggggggggggggggggggggcatttttttttttttttcattataaaaaaaaaaaagaagagggggagggggtgtgttttttttttgatataaaagaaggagagaggaagccgcctcctcctctcttttttttgtagtaatataaaaggcgcggggggggggggggggtgtaatcatancaccccacacccccgnagcggngatgggtaaagagtagataatatttattttttgttttttgtttggctgcgggcgggtaagannncctccgccccgcccgcnntgaagaggagaaaagaagaagagaa

SEQ ID NO: 86069 - DNA, 865 bp, Zea mays
  misc_feature: Ceres CLONE 1572478
  misc_feature: Encodes the peptide sequence at SEQ ID NO. 86070
caccgcggtggcggccgctctagaactagtggatcccccgggctgcaggaattcgtctcacccctagaaaaaagcagtcagccagccagccagccatggagacggcctccttcctctcagtggcgctggccctggcggccctcgtccccgtctcgctgctccttgtgaaccggctcctctacggcaaactgcccccggggccgcggcggcgtcccgtggtgggtaacctgttcgacgtgcagcccgtgcggtgccggtgctaccaggagtgggcgcgccggtacgggcccatcatgacggtgtggctgggcacgtcgcccacggtggtggtgtccacgtcggagctggccaaggaggtgctcaagacccacgaccagcagctcgccgaccgctgccgggaccgctccaccgagagcttcagccgaggcggccaggacctcatctgggccgactacggcccccactacatcaaggtgcgcaagctctgcaacctcgagctcttcacgcagcgccgcctcgaggcgctcaggcccatccgcgaggacgaggtcaccgcccatggtcgagtccgtctacaaagccgtcaccgcgcctggcaatgcaggggaagccctttggttggtaaaagaaccaccctctcgaggggtgggccttttaacaaacatcacgcgggctgggccttccgggaaacggtttcctgggacgccggcccgggcaaagcttggaccaaaccaaaggggccgccaaggttccaagggggaattcgttcccaaccaaacggcaattccaagaaatccggggtgggcgttcccctttctttcaatatcgggggagaaggaaaaaatttcccccgggtggggcctta

SEQ ID NO: 86070 - protein, 256 aa, Zea mays
  misc_feature: Ceres CLONE 1572478
  misc_feature: SWISSPROT Homolog: EC 1.14.13.68 4-hydroxyphenylacetaldehyde oxime monooxygenase
METASFLSVALALAALVPVSLLLVNRLLYGKLPPGPRRRPVVGNLFDVQPVRCRCYQEWARRYGPIMTVWLGTSPTVVVSTSELAKEVLKTHDQQLADRCRDRSTESFSRGGQDLIWADYGPHYIKVRKLCNLELFTQRRLEALRPIREDEVTAHGRVRLQSRHRAWQCRGSPLVGKRTTLSRGGPFNKHHAGWAFRETVSWDAGPGKAWTKPKGPPRFQGGIRSQPNGNSKKSGVGVPLSFNIGGEGKNFPRVGP

SEQ ID NO: 86071 - DNA, 1161 bp, Zea mays
  misc_feature: Ceres CLONE 1572479
  misc_feature: Encodes the peptide sequence at SEQ ID NO. 86072
  misc_feature (1161)..(1161): n is a, c, t, g, unknown, or other
gttgggtgtgttgggtgggcgctgagcttcctaacaagattggattaggagggcgacaaaaagcacgcagaacaaccgaaaatggggctcacgacggtggcggccgctctagaatagtggatcccccgggctgcaggaattcgtctcacccctagaaaaaagcagtcagccagccagccagccatggagacggcctccttcctctcagtggcgctggccctggcggccctcgtccccgtctcgctgctccttgtgaaccggctcctctacggcaaactgcccccggggccgcggcggcgtcccgtggtgggtaacctgttcgacgtgcagcccgtgcggtgccggtgctaccaggagtgggcgcgccggtacaggcccatcatgacggtgtggctgggcaactcgcccacgggtggtggtgtccacgtcggaatctggccaaggaggtgctcaagacccacgaaccagcagcttggcggagcgttgtctcccaccgcccccccccaaaacctttcatccctagggcgggccaggaaaccttatctaggggcccgaattacggggccccccacataacattcaaaggttaccacaaaagtttcggggaaaccctccaagggtcccttcacccgcaaggcggcccccccctcctggtagggcggccttgcaggagccccattcccgatgcgaaggagacccaaagatgtcccacccgtccaagatgggggtgccgaaagctgcacccggaacggataacacaaaaaaataccggcttgtgataacccccccccttgacctctatgggggatgaaagggtgctatggggggcaaagcaaccccccgcgtacgttgaatgtgtcttatacaagcgagaaaggcccgggtcgggtctgtttgtatgggggagggggggagctacacctgggaaagagaaaatggatttaccccccggtgtgggggcggggccacttcttggcagggaagaaaaacaatggagtccgatacatgagagaaacccgagcaggccgggcgcggataattggcgtggacaagccaacgaatagggatgtggccacgtctgtttcttggaagggcggggaagcggtcaatgtgcgactgggaggactatcaacaagacacgggtggggggccctcgctctn

SEQ ID NO: 86072 - protein, 130 aa, Zea mays
  misc_feature: Ceres CLONE 1572479
METASFLSVALALAALVPVSLLLVNRLLYGKLPPGPRRRPVVGNLFDVQPVRCRCYQEWARRYRPIMTVWLGNSPTGGGVHVGIWPRRCSRPTNQQLGGALSPTAPPQNLSSLGRARKPYLGARITGPPT

SEQ ID NO: 86073 - DNA, 808 bp, Zea mays
  misc_feature: Ceres CLONE 1572480
  misc_feature (22)..(22): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (62)..(62): n is a, c, t, g, unknown, or other
caaaagctgggagctccaccgnctggtggnnncggccgctctagaactagtgggatcccccngggctgcaggaattcgtctcacccctagaaaaagcgctcgcgtctctcgtccccctcagatccaccgactcgctctgagtctctgaccgccccttccgtcgtccccgttcgaaggcgcggaaagcgagcgattcagccagattccattcgacgtgaatcccgagtacgactacctgttcacacttctgcatattggtgattctggcgatgggagatcatgctttgctctcagattagcagatgattcgtatttggaacagctgccttaagcccaaatgggggggtttactttggaaattttgggactgtaataacccaaggagggggaaagaacccttaaaaccgtttaaaatttttggggaatgccttctttaggggggaaaaaaaaagggttttttaggggaaaccctttccccttgggggcccccttatctttccccccgggggaccccccccttttttggcaaaattcttttttttcttgtggggaaaaattttattgggggggtgggggggggggggcccccccgggggggaggcgcccctcctcaccaaaaaaatgttttaaaaagaccacggggggtgtttaataccagggggggggagggtggggggggcgcctctttttttttccccaggggggggaggacccaccacccttttttttaaaaaaaaaaaatcttttcctttgtatatttttttgtgggggggaaaaaaaaaaaaagaagtgccgcgcgcccctttta

SEQ ID NO: 86074 - DNA, 824 bp, Zea mays
  misc_feature: Ceres CLONE 1572481
  misc_feature: Translation starting site: 209
  misc_feature: SWISSPROT Homolog: EC 4.2.1.33 3-isopropylmalate dehydratase
  misc_feature (696)..(696): n is a, c, t, g, unknown, or other
  misc_feature (769)..(769): n is a, c, t, g, unknown, or other
ctccccgcggtggcggccgctctagaactagtggatcccccgggctgcaggaattcgtctcacccctagaaaaaggagctctaccaccgtccaccatcaccgcctcgtgtgcagcgtgctcgctcacctcctctgtcgacgcaccaccccgaagcccccccgccgcgctcgcagggtgttcgacccttcgcccgcgcgccctcacgacatggcctcctccgtctccgccgccgccaaggccgccgcggcgttcgcgcacaaggtccagaaggagctggccgcgccggcgcagcgccgcgcgggcttgacccgccggaccaagccgtgcagcgtgcgcgccgtcgcttcgcccgcgcgcgccctgtcgtccaccggctcggtgaagagcgcgatgacgatgacggagaagatactggcgcgggcgtcggagcgcgcggcgttggagcccggggagaacgtgtgggtcgacgtcgacgtgctcatgacgcacgacgtctgcgggcccggcgccttcgacatcttcaagaaggagttcggggaggacgcccagggtctgggaccgcgagaagctcgtcgtcatcccggaccactacatcttcaccagcgacgaccgcgccaaccgcaacgtcgacatcctcagggacttctgtgcggagcagaacatcaagtacttctatgacatcaaggacctcagcngattcagggctaatccggactacaaaggcgtctgccacatcgcacttgctcagggaggccactgcccgacagncgaggttctcttgggcactgattctcacacatgcaatgctggagcttttgggtca

SEQ ID NO: 86075 - DNA, 955 bp, Zea mays
  misc_feature: Ceres CLONE 1572482
  misc_feature: Encodes the peptide sequence at SEQ ID NO. 86076
  misc_feature (67)..(67): n is a, c, t, g, unknown, or other
  misc_feature (68)..(68): n is a, c, t, g, unknown, or other
cccctttttttccccgctttctcattgtttggttttttattcaatttcattttgtgatttgagatannccaaactgggactccccgcggtggcggccgctctagaatagtggatcccccgggctgcaggaattcgtctcacccctagaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacacgcagagcatcctcgccatctgggcctgccaggtcgggctcatgggcgccatcgagggggtacggcgtcgccaggcggccccgctcggagaaggtccgtcgacccgcttctaccccggtcgggagctttcaaaaccgcttcgggcttcgcccgaagaaccctgaaggcccttccgcgggaacctcaagggggaaaaggaacctccaagaaaaagggccggccttggcccaggggtttcccccctatgttttccggggttttctttccgaaccccagaggccaaaa

SEQ ID NO: 86076 - protein, 207 aa, Zea mays
  misc_feature: Ceres CLONE 1572482
  misc_feature (64)..(206): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHTQSILAIWACQVGLMGAIEGVRRRQAAPLGEGPSTRFYPGRELSKPLRASPEEP

SEQ ID NO: 86077 - DNA, 717 bp, Zea mays
  misc_feature: Ceres CLONE 1572484
  misc_feature: SWISSPROT Homolog: EC 3.6.3.14 H(+)-transporting two-sector ATPase
ggagctccccgcggtggcggccgctctagaactagtggatcccccgggctgcaggaattcgtctcacccctagaaaaagtctctttcgcttcccctagacgctgcgcgacgtgtacaagatatcatgtcttgctcctatctcttcagctcctgatcttcctcggagctctggagaagatcctcatccaactgacgggtctcccaccgatgctcaggtttcctggtgcggtgttccttccgagagatgatgaccagcttctactccgtcacgaacacttcataaatacgaatgccttaaatacttgtggccgtagcacaggttcggcgggcacaggaagcccacctatcttctcgtccttgattccaagagcttgcgcatgtgctataaaacatgaaccatcatatgcatacggaagacatcagaacatcccctgaggcggaggctggccgctcaagtaaggtggggcattctagtcctgacttgacagaccggactatgctggagcttctctaaaaaggtcttcaaaaaagggaaaatcccccttgctgaagctaagaagcccgggccgttcagtacaccgggcgcaaggaggggggaaaaaaaaaggcaaaaagcttaaattttggggttcccaccgcctaaatttcccccttagaaaaacggcgatttttttaaaaccgtttaagaacaaaaaggggggcccccctcccggagac

SEQ ID NO: 86078 - DNA, 788 bp, Zea mays
  misc_feature: Ceres CLONE 1572485
  misc_feature: Encodes the peptide sequence at SEQ ID NO. 86079
aagctggagctccccgcggtggcggccgctctagaactagtggatcccccgggctgcaggaattcgtctcacccctagaaaaaacagcggcatctatagcaaccggtccagcactttcacgctcagctccagcaatggctgcctccaccatggcgatctcctccacggcgatggccggcacccccatcaaggtgggctccttctgcgagggccgcatcaccatgcgcaagaccgtgggcaagcccaaggtggcggcgtccggcagcccctggtacagccccgaccgcgtcaagtacctcggccccttctccggcgagcccccgagctacctcaccggcgagttccccggcgactacggctgggacaccgacgggctgtccgccgaccccgagaccttcgccaagaaccgcgagctggaggtgatccactcccgctgggccatgctcggcgcgctcagatgcgtcttccccgagctgctctcccgcaacggcgtcaagttcggcaaggccgtctggttcaaggccggctcccagatcttcagcgagggcaggctggactacctcggcaaccccagcctgatccacgcgcagagcatcctcgccatctgggcctgccaggtcgtgctcatgggtgccgtcaagggctaccgcattgccggcgggccgctcggcgaggtcgtcgacccgctgtaccctgggggcagcttcgaccccctcggcctggccgacgacccacgagccttcgcccagctccaagtgaaagagctcaagaacggccgcctcgccatt

SEQ ID NO: 86079 - protein, 218 aa, Zea mays
  misc_feature: Ceres CLONE 1572485
  misc_feature (61)..(218): Pfam Name: Chloroa_b-bind Pfam Description: Chlorophyll A-B binding protein
MAASTMAISSTAMAGTPIKVGSFCEGRITMRKTVGKPKVAASGSPWYSPDRVKYLGPFSGEPPSYLTGEFPGDYGWDTDGLSADPETFAKNRELEVIHSRWAMLGALRCVFPELLSRNGVKFGKAVWFKAGSQIFSEGRLDYLGNPSLIHAQSILAIWACQVVLMGAVKGYRIAGGPLGEVVDPLYPGGSFDPLGLADDPRAFAQLQVKELKNGRLAI

SEQ ID NO: 86080 - DNA, 839 bp, Zea mays
  misc_feature: Ceres CLONE 1572487
  misc_feature: Encodes the peptide sequence at SEQ ID NO. 86081
  misc_feature (715)..(715): n is a, c, t, g, unknown, or other
agctccccgcggtggcggccgctctagaactagtggatcccccgggctgcaggaattcgtctcacccctagaaaaatagacgcaccccttcctcgtttcgccgcctccgccgacaccgactgcctacctcagctgccgtcgccatgggcagaaggcctgctagatgctatcgccagatcaagaacaagccataccctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtctgcaggaaaggatgccttccaccttagggtccgggttcacccgttccatgtcctccgtatcaacaagatgctttcgtgtgctggggctgataggctccagactggaatgaggggtgcctttggcaagcctcagggcacctgtgctagggtggacattggtcaggtcctcctttccgtgcgatgcaaggacaacaatgctgcacatgccagcgaagctctgcgtcgcgctaagttcaagttccctggccgccaaaagatcattgagagcagaaagtggggcttcaccaagttcagccgcgctgactacctgaaagtacagagcgagggtagaattgntccttgatggtgtcaacgacaagctgctcggcaaccacggcagacttgaaaaacgtgctcctgggaagggctttcttcgatgccgttggcttaagtgcggatgccaaatcgggacgtttttgct

SEQ ID NO: 86081 - protein, 192 aa, Zea mays
  misc_feature: Ceres CLONE 1572487
  misc_feature (5)..(167): Pfam Name: Ribosomal_L16 Pfam Description: Ribosomal protein L16
  misc_feature (191)..(191): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKVQSEGRIXP

SEQ ID NO: 86082 - DNA, 824 bp, Zea mays
  misc_feature: Ceres CLONE 1572489
  misc_feature: Encodes the peptide sequence at SEQ ID NO. 86083
tccccgcggtggcggccgctctagaactagtggatcccccgggctgcaggaattcgtctcacccctagaaaaaaggcatccaagcttaaagcaagcagatctaagctccaggcagcgtcacgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgactgtgccaaaaaaaagcagtttcatttccttccttgcagctagcagcgatgattcttgtggcgatagtggcggagctgctcgaggagtacaccgcactggtgggcgcgggtgctggaacagctgctcaacgacgcggcgtttccgcgccggatgcgcttcctcatgctgcggagcctcgccctcggtgccacgcctttgcccccgaccgcgaccgcgaaggccctccaggttaaccaccgaagtctgattattggctccatttttctcaaggggtttcaccctactgccccgccagggccggcccacccactaac

SEQ ID NO: 86083 - protein, 63 aa, Zea mays; identical to SEQ ID NO: 8705
  misc_feature: Ceres CLONE 1572489

SEQ ID NO: 86084 - DNA, 736 bp, Zea mays
  misc_feature: Ceres CLONE 1572490
  misc_feature: Translation starting site: 193
  misc_feature: SWISSPROT Homolog: EC 1.6.5.3 NADH dehydrogenase (ubiquinone)
  misc_feature (42)..(42): n is a, c, t, g, unknown, or other
ctccccgcggtggcggccgctctagaactagtggatcccccngggctgcaggggaattcgtctcacccctagaaaaaactcccgcaggccgcagcccagcaccggccgctctacgcctccacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatgtcgcacaagattggaatgctgtgtttgaaaggagcatcaatacattgtttttgactgaaatgggtcgtggcttgatgctaactctcaagtacttctttgatagaaatgtcacaattaactatccgtttgagaaagggtctctgagccccccgctccgtggtgagcatgctctcagacgttatgaatctgggggaggaacgctgcattggctgtaaactatgcgaagctatatgcccagcgcaggcaatacaaatgaagcctaaaaaactggaaaatggcaatcccccaaacccagaatatggatttgccttgcccaatggcctttcccgggggggttctgtaaaaaagggtttccccatccaaagcccttttgtt

SEQ ID NO: 86085 - DNA, 1268 bp, Zea mays
  misc_feature: Ceres CLONE 1572492
  misc_feature (69)..(69): n is a, c, t, g, unknown, or other
  misc_feature (1268)..(1268): n is a, c, t, g, unknown, or other
aatttttttatccgtgggattcctgaacgagcgaaaacgaacaaccaccttttggggttattattactngcgcccctcaaaactgggactccccgcggtggcggccgctctagactagtggatcccccgggctgcaggaattcgtctcacccctagaaaaattgtatttatctcatccgaattcccatggaggcaggtcggcgaggagggctcgaagaccgaacaccgacccgtgcgcgggatcgggacgggaactggacaggaccccaaattctgagatccttcctgcccgctcgcccgtgccagacgacgcttcgtccttggaggtaggggacaatatccgccctctcctcctccaaggggatcggatacgccataggctgcgcgatggtcctgtgggtcttctgcaacggctcccttatccggaaccccagctttcccgttggatgatacgtaactcgggcttcttccaggctctaataggggcaccccttaatctttgctagcaatagaatcaacaagggtgaacgttaactcaattccgacccaggccacttgtgaagcatttgaaacccccaccgagtctaagggacgatgattgatgtgtggggcacaatcgccccgctgtgtgttcaaagtgtctaggcccccccacgtccacaaagggagtctctcaacagtcacgctcagtcttaataaagcgctgggtaaataacgtattccaacactctttgtttgttcaggttatcctcaacaccgcgaacatcacaatgtcattcgcgtcgtttttgcgtatatccgtcacagtatatcaccgagccgcctcaatggagaccgaaatccccactccatattcgaacataccccccaagcgcgtggtatccaaatactagggatcgggtatacttcatacattagatatacccttatacatttcgcattccggcacatggtaaaatgtctcatattatggaggcgagcatacacgggtatctcctcttcaccttcttggctacccaccttgtcactcctccttcatagtgacgcgtatatggttttagatgatattgcctctatcctttgttctccgccaagtcacgctatgtggaccacccggttcagatgcggatgcattagagagcggagcgagtgtaaacgccacaaactcttacagctgtgacgtacaaggcgatactcaacccgctgcgctcgtcttacatcgccgctacaagcactgagtttctcccaatcaatcctcagagtcggtn

SEQ ID NO: 86086 - DNA, 877 bp, Zea mays
  misc_feature: Ceres CLONE 1572493
  misc_feature: Encodes the peptide sequence at SEQ ID NO. 86087
  misc_feature (877)..(877): n is a, c, t, g, unknown, or other
gcggtggcggccgctctagaactagtggatcccccgggctgcaggaattcgtctcacccctagaaaaagttgactgcttcaaacgtaccattaaggatgaaggtttctcttccttgtggaggggtaacactgctaatgttattcgttacttccctactcaggctttgaactttgcatttaaggactacttcaagaggttgttcaacttcaagaaggatagggatggctattggaagtggtttgctggcaacctggcctctggtggtgctgctggtgcttcctctttgttttttgtgtactccctggactacgcgagaacaaggttggctaatgacgcgaaggctgccaagggaggaggtgaaaggcagttcaatgggcttgtcgatgtctaccgcaagacactcaagtctgatggtattgctgggctttaccgtggatttaacatctcctgtgttggaatcattgtttatcgtggtctgtactttgggctctatgattccatcaagccagttgtccttactggcaacctccaggacaatttctttgccagttttcctctgggttggctgatcactaatggtgctggtctttgcatcttacccccacgaatacgtcccgcaaaaggatgatgaatacatctgggtgaggctgtcaagtacaaaaagctcccttggaacccgtttccacccaaaattcttaaaaaaggaaagggccccagttcccttgtttcaaggggggcctgggggctaaacatttcttctcgggccattggcctgggtggcttgggggtggctttttctgggcttattgaccagaccttccaaaataccctttttctcttccggaaaaaaaaaaaaacgggcttcccgggggggtn

SEQ ID NO: 86087 - protein, 208 aa, Zea mays
  misc_feature: Ceres CLONE 1572493
  misc_feature (79)..(175): Pfam Name: Mito_carr Pfam Description: Mitochondrial carrier protein
  misc_feature (11)..(71): Pfam Name: Mito_carr Pfam Description: Mitochondrial carrier protein
GGGRSRTSGSPGLQEFVSPLEKVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFPLGWLITNGAGLCILPPRIRPAKG

SEQ ID NO: 86088 - DNA, 786 bp, Zea mays
  misc_feature: Ceres CLONE 1572497
  misc_feature: Encodes the peptide sequence at SEQ ID NO. 86089
ctccccgcggtggcggccgctctagaactagtggatcccccgggctgcaggaattcgtctcacccctagaaaaaacactgaccgacacagcagctccgctcgtcgatcagctctcggctgaccactcatcgccagtgggtgcctgccgaccaggtctcgccgccgccaccgccgcggtagagaggggagggagagggggaaaaaactggcccagatcgagaggtacagcacgaaaaagagaggcaagagagataggggaccggagggcggcgggccggggaccaagaccgaggggctcgtgcgcaagaagctgaagacgctcctgtcgctcgtccccttcggctgccgtgctggacccatcgacgacgcgccgccgcccgtggaccacgccgccgccgcaaggaggcgccggaggacgagggacaacagggccgcccagctgctgggggctgctgcgggtgcaccacaccagtggcgcccctcgctcggcgacatctgcgatgagtacagcagcagcacctacaccgtcaaggtcaagaatgccgcgtcctgggacctcggctggacgctgccgcgcgcgcacggcaggaagcagaaccggcaccttgagggcgcgtcgtcactgccagcgttcgcgtcgacggcgttcctgttctgatcatggagtccgggacggccgggactcgctggtcttcagccacgacgactaacggcggggaggacaataagtaccaaccacaacctgtacccgaaggatttttaccggattactgtccaggttttgga

SEQ ID NO: 86089 - protein, 42 aa, Zea mays
  misc_feature: Ceres CLONE 1572497
MESGTAGTRWSSATTTNGGEDNKYQPQPVPEGFLPDYCPGFG

SEQ ID NO: 86090 - DNA, 836 bp, Zea mays
  misc_feature: Ceres CLONE 1572499
  misc_feature: Encodes the peptide sequence at SEQ ID NO. 86091
  misc_feature (631)..(631): n is a, c, t, g, unknown, or other
ccgcggtggcggccgctctagaactagtggatcccccgggctgcaggaattcgtctcacccctagaaaaaaagtccggagcaacagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgtcctctccgtcgtctcattcccgcacctgtccctccccgcctcgtcccatccgctcccgcaggaagctgctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgtccccgcggagctccgcggacgcggtgagcctcgcgttcggggacgcgtaccgcaacgaggtgtacgcggcgacggtgacgccgcggcgcgggttcgagcgctgcgccacggacacgttccgcgtcgccgggccctgcggctacggcgtctgctacctctacatgcgccggtcgggccgcgccgncgggtggacgcccgagtgggtcaggttgtacgaagccggcgtccggcggcgcctccaactttctactacggcggacccgctccccgacggcggtctggtacgggcttcgaacggctgcgtcagggccgggggccgggcgcctcttgcccagcatgggtgcccccggccgccgaacccttgtgaaccgaacggaccccggacccct

SEQ ID NO: 86091 - protein, 213 aa, Zea mays
  misc_feature: Ceres CLONE 1572499
  misc_feature (53)..(184): Pfam Name: ATS3 Pfam Description: Embryo-specific protein 3, (ATS3)
  misc_feature (145)..(145): Xaa is any aa, unknown, or other
MASGAVPPQRVALLALAVLSVVSFPHLSLPASSHPLPQEAAAAAAAGAAAGGEASEPHGTAADGAAVARRACTYTVQIKTSCASPRSSADAVSLAFGDAYRNEVYAATVTPRRGFERCATDTFRVAGPCGYGVCYLYMRRSGRAXGWTPEWVRLYEAGVRRRLQLSTTADPLPDGGLVRASNGCVRAGGRAPLAQHGCPRPPNPCEPNGPRTP

SEQ ID NO: 86092 - DNA, 870 bp, Zea mays
  misc_feature: Ceres CLONE 1572504
  misc_feature: Encodes the peptide sequence at SEQ ID NO. 86093
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
aaagctggagctccccgcggtggcggccgctctagaactagtggatcccccgggctgcaggaattcgtctcacccctagaaaaagcccactcccagaggctcttctcctcctcgcctcctctccctagcctccacgacgcaagggagagtgacggaaagcgacgcggcgcgagcgaggagggccaaggggaagaggggaagcaccgcaccaggacccttgttcgccgccgtcgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctctgccatggctgtctacaaggtgaagcttgtcgggcctgaaggtgaagagcacgagtttgatgctccagacgacgcctacatccttgacgcagccgagactgccggtgtggagttgccatactcgtgccgtgctggggcttgctccacctgtgctggcaaaatcgagtctggttcggttgaccagtcggatgggtccttccttgatgacgggcagcaggagggaaggttatgtggctgacatgccgtctcctacccaaaagtccgactgccgtcatcccccccccacaaaggaaggcgaccctggaactagggctagcttcattgcaggaaagtcaggggtgacagtctccctacgtggacgtgacatgtggcctagatgcggnnnnnnnnnnnnnnnnnnnnnnnnnnngnnnnnnnnnnnnnnnnnnnnnnnnnnnnnnnnnngt

SEQ ID NO: 86093 - protein, 131 aa, Zea mays
  misc_feature: Ceres CLONE 1572504
  misc_feature (63)..(131): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MSTSTFATSCTLLGNVRTTQASQTAVKSPSSLSFFSQVTKVPSLKTSKKLDVSAMAVYKVKLVGPEGEEHEFDAPDDAYILDAAETAGVELPYSCRAGACSTCAGKIESGSVDQSDGSFLDDGQQEGRLCG

SEQ ID NO: 86094 - DNA, 835 bp, Zea mays
  misc_feature: Ceres CLONE 1572510
  misc_feature: Encodes the peptide sequence at SEQ ID NO. 86095
ggagctccccgcggtggcggccgctctagaactagtggatcccccgggctgcaggaattcgtctcacccctagaaaaaaccacccaccaacccaccatccccgatcgcccttggatatggagatggtcggcggcagcgccgacgccatccccggcctcttgtcatacggctgggccgggctctggtccacgctggcgagcctcctgttcctgtggtccatggtgcaggaccacctccctttccagctcgaggagcagctgtccgcactggcgcgccgcgccctcgccgccgtcaccccctacgtcaccatcaccatcgacgagcacgacgccgactccttcggccgcagcgaggcctacctcgccgcggaggcctacctgggcgccaccttcgccggccgcgccagcaggctccgcgccgagctcccgggcggcagcgaccgcgtcagcctcgccgtcgacgaccacgtcgaggtcaccgacgccttccgcggcgcccggatgcggtggcgcaagacgcggacgctccgccgcggcaacgtgatcgcctggaacccgcgtgaggaggagcgccgcgcctactgcctcaccttccaccgccgccaccgcgcgctcgtcgaggccgcctacctgccgcacgtcctcgtcgagggccgcgccggccaccgtccggaactccagcggcgcctctacaccaacaacgccagcgggggactggggcggggggcgaccacgggccccgcgcctgggaccacctcaaggtggaaccacccgtccacgttcccccagcttcgcatggaacccgaacagtaaaccgggaggccctccaacaaccc

SEQ ID NO: 86095 - protein, 231 aa, Zea mays
  misc_feature: Ceres CLONE 1572510
MEMVGGSADAIPGLLSYGWAGLWSTLASLLFLWSMVQDHLPFQLEEQLSALARRALAAVTPYVTITIDEHDADSFGRSEAYLAAEAYLGATFAGRASRLRAELPGGSDRVSLAVDDHVEVTDAFRGARMRWRKTRTLRRGNVIAWNPREEERRAYCLTFHRRHRALVEAAYLPHVLVEGRAGHRPELQRRLYTNNASGGLGRGATTGPAPGTTSRWNHPSTFPQLRMEPEQ

SEQ ID NO: 86096 - DNA, 958 bp, Zea mays
  misc_feature: Ceres CLONE 1572514
  misc_feature: Encodes the peptide sequence at SEQ ID NO. 86097
tcaccgcggtgggcggccgctctagaactagtggatttcttgggctgcaggaattcgtctcacccctagaaaaaaccagaccagagccacagcaccagcggcagccacccaaagcccaggaccgcctcaccgccaatggccgaccgcgtctaccccgccgcgaagccgaacccgcctccaggcgcggcgggcaacagcaacggcgcgcaggcgtcgtcgttccctgcgcccaagtcgcagatgtaccagcggcccatctaccgtccgcaggcccccgcgaagcggcagcgcgggcggtcgtgccggtgcagcttgtgctgctgcttctgctgggcgctggtggtggtgatcctgctggcgtttgtgggggccgtgtgcagcggcgtcttctacctgctgtaccgggcgcagcggccgtcgattaaggggtcctccagcggcggctggcgtacccttaaccctgacggtttacagggaacaggccccccatgcctaaaggcgaaagactctccacccctgaaccggtggacccggctccgggaaatccccttagccaagaaagactgggggttatcccctgtgtgccgacgcgaaccctgcaaccccccccgccggtgggtggggccccctcggaacacataagaaaggagcactagcggtccccgcttggcagggagacccgtcgcccccgcgtgcaccccgagggggtttttcaacctcatggaaggaagggagcaacaatgccaaacagcggggagatgacacatgcaccatccggctatctcacagaccggccccccggagcagagcgcgagataacgcctcttgaaggcgtaactctttctctcgatactatacacaaagagtgtgcatgcgatcgtgcgttccggtttccctctctaggggtcagggcaagttcttacatccccgccgcgcggggtgcttcagcgcgtgggta

SEQ ID NO: 86097 - protein, 168 aa, Zea mays
  misc_feature: Ceres CLONE 1572514
MADRVYPAAKPNPPPGAAGNSNGAQASSFPAPKSQMYQRPIYRPQAPAKRQRGRSCRCSLCCCFCWALVVVILLAFVGAVCSGVFYLLYRAQRPSIKGSSSGGWRTLNPDGLQGTGPPCLKAKDSPPLNRWTRLREIPLAKKDWGLSPVCRREPCNPPRRWVGPPRNT

SEQ ID NO: 86098 - DNA, 1226 bp, Zea mays
  misc_feature: Ceres CLONE 1572515
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (79)..(79): n is a, c, t, g, unknown, or other
  misc_feature (1111)..(1111): n is a, c, t, g, unknown, or other
tttggagggggcggccgcaatcccccccaaaaaaaagcaggtcccggcggctcgccgccccgggggtnnnccaccaaanaaaaaaaatggagctcaccgcggtggcggccgctctaaactagtggatcccccgggctgcaggaattcgtctcacccctagaaaaaacagaccagagccacagcaccagcggcagccacccaaagcccaggaccgcctcaccgccaatggccgaccgcgtctaccccgccgcgaagccgaacccgcctccaggcgcggcgggcaacagcaacggcgcgcaggcgtcgtcgttccctgcgcccaagtcgcagatgtaccagggggccatgtaccgtccgcaggcccccgcgaaacggcagcgcgggcggtcgtgccggtgcaccttgtgctgctgcttctgctgggcgctggtggaggtgatcctgctggcgtacgagggcggccccgggcgggggcgtcctcccccccgggggaaccagccgaaaatggccggtccttccaccgtgtccgtcggccgcggctgggcccactcctgaaaccccgacatgcagaccggcaaacaagccccacccagactccaagagccgaacccccattttagcacctcgaaccccaccgcaaaccctggcccaggtacacccccggacacatttcaacagacgggaaacgggggggcgtcaaaccactggtaccacctagcacgacacagcctcatacgggcactccgcacaccaccatactgaactaggaggccaacacacaccacaccgcgaacccgcctcacaccctatataaaaccacactcctatatcgagcgcgcaccgcacgagggtgcacaggacgcgacctagacgcctcctattgtgtgatgtgacctcacagtctagcgcgcgaaatacaatgacacgccccccgagacaactgagaccaccctagtcgctgagtcacaacgtagattcagcctctacatctacccacataactaccgggtgcccccactatctcatgaccacaaccacaccatagcaagtagcgatgtaggggccgcggcgtataaatcgccccccactaactcgagtatgacccaaccanattcgagaagagtaatgcaacgatcacgcaccgccacacgtaaagagcgggagcactcgtagggccctaaacagcgaccaaggggaggagcaacacaagagagaaccagagacgg

SEQ ID NO: 86099 - DNA, 797 bp, Zea mays
  misc_feature: Ceres CLONE 1572517
  misc_feature: Encodes the peptide sequence at SEQ ID NO. 86100
  misc_feature (318)..(318): n is a, c, t, g, unknown, or other
  misc_feature (321)..(321): n is a, c, t, g, unknown, or other
  misc_feature (328)..(328): n is a, c, t, g, unknown, or other
ctcccgcggtggcggccgctctgaactagtggatcccccgggctgcaggaattcgtctcacccctagaaaaaaaccacagcccaggctcgagactacaacgttacagcacaacacactgctgcacgtacatacgcagatagagaccagcagcaagctcgatcgagactcgagaggcatggggagtgtaccggaggagaaggccaagctgggcttcggcggcctggtgggcgacctgagggaggtgtacgagagcggcaggacgcagggcctggagtggcggcagtcgcagctcaggggcctcgtcagggctcctgganggnagaagangaggagatctttcgacgtgctcccacgaggacctgggggaagcacccgcggcgagggcccttcaaaagacaaaggtttgggggtttctgaaaaaaagtccggtccttcagacaagcttggaaaaaccctccaaaaaactgggggccgggctccccggaagaaagggtctcccaccccccgctctcggtttggccctttcccgggggaaacccgcccttggggggggggccccaaaaccccccctcggggggggcgggggccctccccctttcccagggggggggaaaaccctcccacaaaaaagggccctaatccctttgggaaaaccccctctcctctggaaagaaccccggggggggggcggggaaaaaaaaccccgggtgggggggggaaaaaacaccctctagagagaatttggggcgcgggggccaacccccggggggggttttccctcggtggggggaaaaat

SEQ ID NO: 86100 - protein, 207 aa, Zea mays
  misc_feature: Ceres CLONE 1572517
  misc_feature (48)..(48): Xaa is any aa, unknown, or other
  misc_feature (49)..(49): Xaa is any aa, unknown, or other
  misc_feature (51)..(51): Xaa is any aa, unknown, or other
MGSVPEEKAKLGFGGLVGDLREVYESGRTQGLEWRQSQLRGLVRAPGXXKXRRSFDVLPRGPGGSTRGEGPSKDKGLGVSEKKSGPSDKLGKTLQKTGGRAPRKKGSPTPRSRFGPFPGETRPWGGGPKTPPRGGRGPSPFPRGGENPPTKKGPNPFGKTPSPLERTPGGGRGKKTPGGGGKKHPLERIWGAGANPRGGFSLGGGKN

SEQ ID NO: 86101 - DNA, 770 bp, Zea mays
  misc_feature: Ceres CLONE 1572521
  misc_feature: Encodes the peptide sequence at SEQ ID NO. 86102
ctggagctccccgcggtggcggccgctctagaactagtggatcccccgggctgcaggaattcgtctcacccctagaaaaaggacgacccgagccagccagcccgctgcgagtacatacatactaggcagccaggatggcttggcgcccaccgtgatgatggtctcttcggccagcggcgtcgcttccttccaggggtctcaagtgcacgaccagcttatccgtcacgcggctctcctccaaaatcataagcaacttcagcaaaagccgaaggatcacgtgcatgaatgtgtggacgggctacggcaacaataagttgaagacgatgacctacctgacgccgttgtcgactgacaagctgatgaagcacgtggactacctgctgcgctactggtggataccgtgcatcaagttgagcatggtctgcttcatgtaacgcgagaacacctcctccccatgctactacgactgccgctactggagcatgttgaagctgcacatgttcggcagcaacgacaccacgcacgtgtactagcaactgcaggaggccatcacatactacactgaaggcttccaccgcgtcatcggcttcgacaacatcaaggatacgcggtgcgtcagcttcatcgtctacaagtccccagggatcgactataccgagtacgtcggacgtgccaagctggatagctatctagatagctcctgcgtcgactagtaccaagaggcatagttcctcactgtgattcatgttagcttcgtgtcactgtgtacc

SEQ ID NO: 86102 - protein, 50 aa, Zea mays
  misc_feature: Ceres CLONE 1572521
  misc_feature: SWISSPROT Homolog: EC 4.1.1.39 Ribulose-bisphosphate carboxylase
MNVWTGYGNNKLKTMTYLTPLSTDKLMKHVDYLLRYWWIPCIKLSMVCFM

SEQ ID NO: 86103 - DNA, 846 bp, Zea mays
  misc_feature: Ceres CLONE 1572522
  misc_feature: Encodes the peptide sequence at SEQ ID NO. 86104
ctccccgcggtggcggccgctctagaactagtggatcccccgggctgcaggaattcgtctcacccctagaaaaactgcccagacactggtcaagcgacgcaagggaaggatgtggttagctagcagcctgaaattctccgcccatcaactcagtcagcaggaagcaacccgcctagcgccctcgatccaaggacctcagagattcggccgtcgccactccggggccaagaaatgctcctcctgctcttcttctctgtcctcgccgccgttgccgccttcctcctcttcaagttcgccaccgtcgtcgatggggacttgacgctcgtatcccgcggtccgccgctgcgggagagggtcgacggcaaggtcgtgtggattactggagctagccgcgggattggggaggttcttgcaatgcacttcgcaaatttaggagcaaagctgatactatctgcacgtaacaaggacgcgcttgcgagagtgaaaaaaaacatcctcagcaagaatccagatagcagagttgaaatgttacccatggatttatcagctggtgaagaatctctgaaagaagtcgtacatgtggcagaatcatttttttctaatgcaggcgttgactatatggtccataatgcagcctttcgaacgtcctaaacggagggctctagaagaaagtgaggaagggccttaaggctaccttgaaatggcaatgtccttccggaacctattactttaactcgcctttctagccaccttacatggcttggataaaagggaaggggcccatttttgtttgggaaaaagaaaagggctgcctggaaaagggttcctggctccctgtgtcagggt

SEQ ID NO: 86104 - protein, 139 aa, Zea mays
  misc_feature: Ceres CLONE 1572522
  misc_feature: SWISSPROT Homolog: EC 1.1.1.146 11-beta-hydroxysteroid dehydrogenase
MLLLLFFSVLAAVAAFLLFKFATVVDGDLTLVSRGPPLRERVDGKVVWITGASRGIGEVLAMHFANLGAKLILSARNKDALARVKKNILSKNPDSRVEMLPMDLSAGEESLKEVVHVAESFFSNAGVDYMVHNAAFRTS

SEQ ID NO: 86105 - DNA, 1069 bp, Zea mays
  misc_feature: Ceres CLONE 1572523
  misc_feature: Encodes the peptide sequence at SEQ ID NO. 86106
  misc_feature (8)..(8): n is a, c, t, g, unknown, or other
  misc_feature (9)..(9): n is a, c, t, g, unknown, or other
aataaaanngaaaaaccacatccgaacaaagttataaaataagcgtaccccgggacgagcgcatcgcccctattaaaaagatggaactccccgcggtggcggccgctctagaacagtggatcccccgggctgcaggaattcgtctcacccctagaaaaactacgtgcgagcgcaatgctggcggcgtccctcaggccggggccttcgctcgcggccttccccggtaccgcccagaggagcccagttcctttcctccccttccctgcccgcctccatcaccggcccgtcctcctctccgcgaccgccgagggaaccggcgcccccgccggccaaggagacgcctcggctgccccgctcgacgaggtgcgcctgccgcagttcgctgcggactgggaatccgcgcgcgcgtgcaaggaccaggggaggatcttcacactgccggagctgaaggccaacagtggcgggctcatcgtcaggttcaactccctgcaggggttcgtgcccaaccctctcctcagccccgcgcactggtgtaaagaccccaaaaggcccatccaagatgttactaaaagacctaagtaggaacttcccatttctgtacaaggtgagcttgaagtggaatgagcgagggaaaaagaaaactttgtgcttcctcatgtacgaagggatggcatagttctgggcccaaacagtacctcctatcccccgaaattaaaaaaaatttggcccggaccattcttaattgaaatgggaaaatttcgttgggggcctctcaggtcgctttcccaacactagtgggctggccatttttgggtggcaccccttggcgaaaatattcccttggaaggggaaatgataatatcaaaggcccttaccctggggcactatggtaacaaatagatccttcggggaagagcgggtctttcgggggaaaacctttgggccccaacaaacggtccccagggaaattttttctctaaaaaccaaaaggggggaaatggcctccctcttaaagggtcccaatagatttgggtgaaaaacacttttggcatatgggaaccagaaattt

SEQ ID NO: 86106 - protein, 135 aa, Zea mays
  misc_feature: Ceres CLONE 1572523
MLAASLRPGPSLAAFPGTAQRSPVPFLPFPARLHHRPVLLSATAEGTGAPAGQGDASAAPLDEVRLPQFAADWESARACKDQGRIFTLPELKANSGGLIVRFNSLQGFVPNPLLSPAHWCKDPKRPIQDVTKRPK

SEQ ID NO: 86107 - DNA, 817 bp, Zea mays
  misc_feature: Ceres CLONE 1572525
  misc_feature: Encodes the peptide sequence at SEQ ID NO. 86108
ctccccgcggtggcggccgctctagaactagtggatcccccgggctgcaggaattcgtctcacccctagaaaaaacggccgccctagcttccccacattcagctccttcgccgccgccctagctttcccgcgagcgggacggcagccgccgtatcctccttcctccaataacgagcgggtccaggcaagtagcatcctcgcgcccctgtcgtgtcgcctccgcctctgagttcagctcgccggcagccgccgctcgcaatggaggccctccggaaagcggaggcggagctcacggtgtacgtgcacccctccaacgccaagcgcgtccggcacgccgtctcccgccagctcagcgcgcttctcttcacgtatgtggaccgttttgatggcatgttgctgatgcatgaaatttcattccttattggcaaagacaaagagggcaaacccatatatgaaaggagtgaccgtaatgatcaaattgctgaacccgtttcttatggcaaaatcatgaatggcttggtgccatatttcagcgtccaagtgcatgccaccctgctgctcttctctccccagccggacatgatcctggaaaggatggttgaaatgctcaggaaggagtcaattcatgccattgtattaggggttttctcagtggcgattatgtcatgagatatgaagtcaaattcaaatggcaaagtgatggagggaaaatttgtgagcgtctcagataaaaaacacgcatgactcaacgacacctactgtgctcaatccagcaggccctcgagtctcgtccccggacatgagcagagagacgcca

SEQ ID NO: 86108 - protein, 136 aa, Zea mays
  misc_feature: Ceres CLONE 1572525
  misc_feature (10)..(102): Pfam Name: RNA_pol_Rpb7_N Pfam Description: RNA polymerase Rpb7-like, N-terminal domain
MEALRKAEAELTVYVHPSNAKRVRHAVSRQLSALLFTYVDRFDGMLLMHEISFLIGKDKEGKPIYERSDRNDQIAEPVSYGKIMNGLVPYFSVQVHATLLLFSPQPDMILERMVEMLRKESIHAIVLGVFSVAIMS

SEQ ID NO: 86109 - DNA, 866 bp, Zea mays
  misc_feature: Ceres CLONE 1572526
  misc_feature: Encodes the peptide sequence at SEQ ID NO. 86110
  misc_feature (380)..(380): n is a, c, t, g, unknown, or other
  misc_feature (866)..(866): n is a, c, t, g, unknown, or other
tcccgcggtggcggccgctctccaactagtggatcccccgggctgcaggaattcgtctcacccctagaaaaaatccgctagggtttatctgctcgaggaatggcgtcggtgcaggtctccggcgcgggggtcggtaccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggcggaatcttgctccctgcgactgctcagtccanacctcaaggtggcgaggtagttgctgttggagaaggaaggataattggggataagaaagttgatgtcagcattcaggttggagctcaagttgtgtattctaagtaccctggaaaccgaaggtcccgttgaacgatcacagccatcctggttcctcaaaaaggaatgacgtttatagggttatctttaaaaacctgatgacctttaaaagaaattgaaggcccctctgaaacaaaccgtggttcttaattcaagggtttgcttgaaaactgaaccaacaaaaccccctgcgagggcccttctggctttactggaaacctgcccaaggaggaaagccctttttttccgggaaaatggtccgataagggggtgggttccacaaggccccccctgagaaccaaagtattggtgcgataagccttttcacgctctgtccccgtattcccgccgcggggagcacccttccccctctgtatctcccaacgatn

SEQ ID NO: 86110 - protein, 136 aa, Zea mays
  misc_feature: Ceres CLONE 1572526
  misc_feature (62)..(136): Pfam Name: Cpn10 Pfam Description: Chaperonin 10 Kd subunit
  misc_feature (94)..(94): Xaa is any aa, unknown, or other
MASVQVSGAGVGTAAFSVKGKASTGALRLRSTLTFGEVCPARRAFRGLVVRAATVVAPKYTTLKPLADRVLVKINSSEEKTTGGILLPATAQSXPQGGEVVAVGEGRIIGDKKVDVSIQVGAQVVYSKYPGNRRSR

SEQ ID NO: 86111 - DNA, 795 bp, Zea mays
  misc_feature: Ceres CLONE 1572527
  misc_feature: Encodes the peptide sequence at SEQ ID NO. 86112
  misc_feature (522)..(522): n is a, c, t, g, unknown, or other
ctccccgcggtggcggccgctctagaactagtggatcccccgggctgcaggaattcgtctcacccctagaaaaagacgccaccgctccctggactcgaagaccggctgcccgaccccggtccggcgatccctctgcacccctttctttgcgctgccagccccaatctctcacatccctgtcaaccatggcggcgtcatcaagctgaggcgaggtgcgcgcgctgtcccagaaggagcacgacatacagatgatgctcgcggccgacgtccacctcagcaccaagaactgcgatttccagatggagcgatatgtctttaagcgtcgcaccgacggcatcaacatcatcgacgtaagcaagacatgtgataagctccagctcacagctagagttattgatgccattgcagatccgacagacatgatcatcgagtcagaccaactctacgtccagcgtgctggtctcaagttcgcgcagtacactggcgcccctgccattcgaggggagtacacccctggtaccnttcacgatcagcatcaagacttcttttacggagccttgccagcttattcttttggaacaaaggacgacccttagcccaattaggaattcgggctgggggaaatttcaaaacaattgccttttgggggaaatgggctttccaaaagggaaaagggaaaaacccctttcccggacccaacacaaggggggggaacccaccccccagcccctgttgggggttttggccccaagtgtcccctaaaaagggggaaaactctccccctgggacaaaagc

SEQ ID NO: 86112 - protein, 115 aa, Zea mays
  misc_feature: Ceres CLONE 1572527
  misc_feature (2)..(112): Pfam Name: Ribosomal_S2 Pfam Description: Ribosomal protein S2
  misc_feature (92)..(92): Xaa is any aa, unknown, or other
MMLAADVHLSTKNCDFQMERYVFKRRTDGINIIDVSKTCDKLQLTARVIDAIADPTDMIIESDQLYVQRAGLKFAQYTGAPAIRGEYTPGTXHDQHQDFFYGALPAYSFGTKDDP

SEQ ID NO: 86113 - DNA, 871 bp, Zea mays
  misc_feature: Ceres CLONE 1572534
  misc_feature: Encodes the peptide sequence at SEQ ID NO. 86114
aaagctggagctccccgcggtggcggccgctctagaactagtggatcccccgggctgcaggaattcgtctcacccctagaaaaagattcccgaacaagagcgaggccgcactcccccacgagtccactctccgaccgcacgctccgcgacgcgatggccgcgctccgcctcgcctccttcaccctccgccccgccgccgccgccgccgcctcttccggcgcgactccatcggctccccggtccgcctctttctccagcgtggcgcgggggctcccctccctccgcctggccccgccccgccgccgccgcggggacctcgccaggccccgcgccgcggccgaggccgcggcggagagctacgcgtccgcgctgtcggaggtggccgtcgagaacggcaccctcgagcagacggtctccgacctcgagaagctggagaagatcttctccgacgaggccgtcgccgagttcttcgacaaccccaccgtcccgcgcgaggagaaggccgagctcatcggcgagatcgccaagtcgtccgagcttcagccgcacgtcgtcaacttcctcaacgtcgtcgtcgacaacttccgcgcgtccatcgtgccccagatcgtcgtcgaagtcgagaacgtctacaactcgctcacggggcacggagggtcgccaccggcaccctccgtcgtgcagcttcgagtcgcaaggacttcccgccagattgcgccagcacgtccagaaaaatgaaccggccccaaaaaaacgtcccccttaaaaacgcagcttcgaccccgggggcttcatcggccgggctttcaccggggaaataaggggccgtcaaccggttcccaacttgaatcgaacagagagccccccggga

SEQ ID NO: 86114 - protein, 194 aa, Zea mays
  misc_feature: Ceres CLONE 1572534
  misc_feature (65)..(187): Pfam Name: OSCP Pfam Description: ATP synthase delta (OSCP) subunit
  misc_feature: SWISSPROT Homolog: EC 3.6.3.14 H(+)-transporting two-sector ATPase
MAALRLASFTLRPAAAAAASSGATPSAPRSASFSSVARGLPSLRLAPPRRRRGDLARPRAAAEAAAESYASALSEVAVENGTLEQTVSDLEKLEKIFSDEAVAEFFDNPTVPREEKAELIGEIAKSSELQPHVVNFLNVVVDNFRASIVPQIVVEVENVYNSLTGHGGSPPAPSVVQLRVARTSRQIAPARPEK

SEQ ID NO: 86115 - DNA, 901 bp, Zea mays
  misc_feature: Ceres CLONE 1572536
  misc_feature: Encodes the peptide sequence at SEQ ID NO. 86116
ccccgcggtggcggccgctctagaactagtggatcccccgggctgcaggaattcgtctcacccctagaaaaaacgatcacacaccactccacagcagtagcaagagggatagagcaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtctaccaagatgatggtggcggcagctctgctggccttggccctggccgtgtcgaccgccgaggcgaggaacatcaagaccacgacgacggagaagaaggacgacgcggtggtgcagccgcagaacttcccgcctttcgaacgcctcggcggcggcgcgttccccggcgttcgggggcccttcccggggggcagcattccctggcagcaacatttcccggggttcaacaaggccccggaagcgggcagcagcctaacccggggtttcaacttgtgccggggaacggggaagcatgccccctctttgggggggggggttcccccggggttttaaacgggtttttgggggaaatgcccgggggtggccccaacctctagggtttccggtcccccgaagaaaggcccaaaaagggcccgggaaagcccaaaaaaaaagggggggaaaaaaaaaggggggggccacccggtttccgggaaagaaacacctgggcccctcttttagagaaaaagccggggggtttcggggggttttctccccccaagagcccccaaaataaaaaaaaatatattgggggggcttttggaaatataaccgcaaagactttttgggaaaggaacaaattaaaaaaagcacgggggtggggtccaccacg

SEQ ID NO: 86116 - protein, 113 aa, Zea mays
  misc_feature: Ceres CLONE 1572536
MARSTKMMVAAALLALALAVSTAEARNIKTTTTEKKDDAVVQPQNFPPFERLGGGAFPGVRGPFPGGSIPWQQHFPGFNKAPEAGSSLTRGFNLCRGTGKHAPSLGGGVPPGF

SEQ ID NO: 86117 - DNA, 818 bp, Zea mays
  misc_feature: Ceres CLONE 1572542
  misc_feature: Translation starting site: 454
ctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcaaacgccgtcgtacctgaccggcgagttccccggcgactacgggtgggacaccgcgggcctctcggccgacccggagacattcgcgcgcaaccgggagctggaggtgatccacctcccggtgggcgatgctgggcgcgctgggctgcgtgttcccggagatcctggccaagaacggcgtcaagttcagcgaggcggtgtggttcaaggccggcgcgcatatcttctcggacggcgggctggactacctggggaaccccaacctggtgcacgcacagagcatcctggccatctgggcgtgccaggtggtgctcatgggcttcttcgagggctaccgcgtcggctgccggacctctcgggggagggctcgacaaagtgtaccccgggcggcgccctacaacccgcttggggctccgccgacgacccggacaccgcccgccgagctcaaagtgaaagagcttcaaaaacggccgccttgccatggtcctccatt

SEQ ID NO: 86118 - DNA, 957 bp, Zea mays
  misc_feature: Ceres CLONE 1572548
  misc_feature: Encodes the peptide sequence at SEQ ID NO. 86119
  misc_feature (9)..(9): n is a, c, t, g, unknown, or other
  misc_feature (19)..(19): n is a, c, t, g, unknown, or other
  misc_feature (71)..(71): n is a, c, t, g, unknown, or other
aattgtaanggaaaacccntacaagacaggggaggggggggtgagagggaggggtgtatcggttgagacantattcttaggatgggactccccgcggtggcggccgctctagaactagtggatcccccgggctgcaggaattcgtctcacccctagaaaaaacggccgccctagcttccccacattcagctccttcgccgccgccctagctttcccgcgagcgggacggcagccgccgtatcctccttcctccaataacgagcgggtccaggcaggtagcatcctcgcgcccctgtcgtgtcgcctccgcctctgagttcagctcgccggcagccgccgctcgcaatggaggccctccggaaagcggaggcggagctcacggtgtacgtgcacccctccaacgccaagcgcgtccggcacgccgtctcccgccagctcagcgcgcttctcttcacgtatgtggaccgttttgatggcgtgttgctgatgcatgaagtttcattccttattggcaaagacaaagagggcaaacccatatatgaaaggagtgaccgtaatgatcaaattgctgaacccgtttcttatggcaaaatcatgaatggcttggtgcccatatttcagcgtccaagtgcatgccaccctgctgctcttctctccccagaccggacatgatccctggaaagggagggttgaaaatgctccgggaaaggagtccaattcatgccattggtatttaggggtttttctcagggggcaaattatgtcctgaagaaatttaaggttcaaaatttcaaaagggaaaaagttgatgggaagaaaaaaatttggggagccctcaaccgaataaaaaaaaaccccccggggacccccaccggaccccccaacctgtgccccccaaatccaagacaagcccctcgaagattttcggtccccccgggaattttaaaccagaaagaa

SEQ ID NO: 86119 - protein, 108 aa, Zea mays
  misc_feature: Ceres CLONE 1572548
MEALRKAEAELTVYVHPSNAKRVRHAVSRQLSALLFTYVDRFDGVLLMHEVSFLIGKDKEGKPIYERSDRNDQIAEPVSYGKIMNGLVPIFQRPSACHPAALLSPDRT

SEQ ID NO: 86120 - DNA, 810 bp, Zea mays
  misc_feature: Ceres CLONE 1572550
cccgcggtggcggccgctctagaactagtggatcccccgggctgcaggaattcgtctcacccctagaaaaagaccgctccctctccttggcgtggagactggctgcactacccctgtccggcgatccgttcgcagagcttttgttttgcttgccagcgtcaatcccctgcctctctgctccccttggcctctacaatgacctcacgcgaggtacgcccgctgctccagacggaacacgacatcgacatgatgctcgcttctcgacttctgccccagcacagacaattgtgattcccagacggaccgacatctctttaagattcgctcggccgagatcaatatcatccgcgtaagcaagatctgtcataaggtgcatctcacagctacgggttattgatgcacttactaacacgaaagacatgatcgttaagagataacagatccgacggccactatgctgtcgtagagtacgctcagtatatctcggcccatgaaatcgatgtggaggtagaacgatggtaccttctcaatcaccaccagacctctttcagcgagacatcacagctgatcattgctgacacatggactaacagtaacgccatgtatgtaatctgcgctgctgaagatcactacaattcccgttgtaggactactgactgtacgcatgacgacaagggaatatccatcatctcgggatcagtcactaggggaaggaaccagacttcccatgcacggatcatggcttataggccccgaaggggttcttgcctcactcagggggaacacttgcctccagatgcggcaaaaaag

SEQ ID NO: 86121 - DNA, 927 bp, Zea mays
  misc_feature: Ceres CLONE 1572552
  misc_feature: Encodes the peptide sequence at SEQ ID NO. 86122
  misc_feature (688)..(688): n is a, c, t, g, unknown, or other
  misc_feature (849)..(849): n is a, c, t, g, unknown, or other
  misc_feature (927)..(927): n is a, c, t, g, unknown, or other
ggagctccccgcggtggcggccgctctagaactagtggatcccccgggctgcaggaattcgtctcacccctagaaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaagaagcctcctccaccttgctngccatcaacttcgatggactcgccaaggctttgacaccaggtgcaacgatatttgtgggccaatacttgttcactggtagcgagactacttcagtttgggttggaggttctgaagtaaaggagatgatgtggtttgtatcatcaagacacagctacctggnctgggtcgctcttcacgctgcattggtcccagattcatattgacttgcccacgctgtctgaatgaggataaagatgtn

SEQ ID NO: 86122 - protein, 198 aa, Zea mays
  misc_feature: Ceres CLONE 1572552
  misc_feature (30)..(197): Pfam Name: PK Pfam Description: Pyruvate kinase, barrel domain
  misc_feature: SWISSPROT Homolog: EC 2.7.1.40 Pyruvate kinase
  misc_feature (185)..(185): Xaa is any aa, unknown, or other
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLAINFDGLAKALTPGATIFVGQYLFTGSETTSVWVGGSEVKEMMWFVSSRHSYLXWVALHAALVPDSY

SEQ ID NO: 86123 - DNA, 949 bp, Zea mays
  misc_feature: Ceres CLONE 1572553
  misc_feature: Encodes the peptide sequence at SEQ ID NO. 86124
ctggagctccccgcggtggcggccgctctagaactagtggatcccccgggctgcaggaattcgtctcacccctagaaaaaaccgcaccgcagcgtatcgccctcccattccactccagtccagccaccgctcccattccccagccgccgtacagcccgtcaccatggacgccgccgcaaactcccgcctgcacacaccggaggccaacaggaccgccacccgcgcgctcttctctcctcccgcgcctcactgccttcctccatctaccgcgtcaccacctcaccactcaccctccgcctcgaattccgcgaccacatcagagctcacaggagtccccccggatcccaacggtactcgcgccgtccgacaggaccatcgacgcggacaccaccacggacgccgacctgctcgagaacgggttgcggagcacgcaccccaccaagctcatctgcacgccgggccccgccacctagcgccacgaccaccccgagggagacgccgtcggcgggatgaacattgcccagcatctcatgctccacatctacaggaactgagacatggccaccttccgcgcgatcaggaggctcaacgaggagaatgtgcttcgcatcaccgtcatgatggacaccgacggcagcaagatccacatggtggacctctgcgacgcgtcctctgaacatgctgacgatggagtactatcgacgtgcattgactcatcatttcacttgcctctcccagaacgaactttcagggcgactatgagtgatctgctgacgatatacacctggtgatgagctccctgctggatgtggaacagacgctgcctctatgtgactcagaaaacacgacccagatggtaagtgccgttgcaaagatcctggatgattggtgacacctgtacatcttcacaatctgcgtggaaaccagtaccatccttcatagaatgcca

SEQ ID NO: 86124 - protein, 77 aa, Zea mays
  misc_feature: Ceres CLONE 1572553
  misc_feature: SWISSPROT Homolog: EC 2.7.1.40 Pyruvate kinase
MATFRAIRRLNEENVLRITVMMDTDGSKIHMVDLCDASSEHADDGVLSTCIDSSFHLPLPERTFRATMSDLLTIYTW

SEQ ID NO: 86125 - DNA, 937 bp, Zea mays
  misc_feature: Ceres CLONE 1572557
  misc_feature: Encodes the peptide sequence at SEQ ID NO. 86126
  misc_feature (911)..(911): n is a, c, t, g, unknown, or other
  misc_feature (937)..(937): n is a, c, t, g, unknown, or other
aaagctggagctccccgcggtggcggccgctctagaactagtggatcccccgggctgcaggaattcgtctcacccctagaaaaagaacgcatctcttctttctactttcttgtaacccaagacgaactcggtgaactctttctcctcgcgcagcaccggagcacaatcaaggattccagtccagtcctgccaatggagtgcgttttgggcttggttggccgcgacttcgcggtggtggcggccgacacctccgccgtgcagagtatcctcgtccacaagactgacgaggacaaagtaatggtcctcgactcgcacaagctgttgggcgcttcaagggagcctggtgaccgggtgcagtttacggagttcatacagaagaacctccacctgtaccagttccgcaacaccatcccgctgtcaaccgccgctgccgccaacttcacacgcggcgagctcgccacagcccttcgtaagaatccatacatggtcaatgttattctcggtggttacaataaggatgttggcgcctcactgtactacatcgactacattgcgaccttgcacaagatcgacaagggcgcttttgggtacagatcgtatttctgcctgtctctgatggacaagctgtaccgcccggacatgaccgttgaggaagcggtagacctcgttgataagtgcattaaagagatccggctgcggctggttgtggcgccccagaacttcgtgatcaagatcgtcgacaacgacggggccagggagtacgcgaggcgatgactcgtcggcgacagtgcacctgctgaagctgcagctacggttgccagctgaggcatgaaacttgtttgtggttagtagtttgattctcagcgaggctactatgtaatcaagtggatactggctgagggatccactanttagtttacatgcattcggaatctgn

SEQ ID NO: 86126 - protein, 193 aa, Zea mays
  misc_feature: Ceres CLONE 1572557
  misc_feature (1)..(182): Pfam Name: Proteasome Pfam Description: Proteasome A-type and B-type
  misc_feature: SWISSPROT Homolog: EC 3.4.25.1 Proteasome endopeptidase complex
MECVLGLVGRDFAVVAADTSAVQSILVHKTDEDKVMVLDSHKLLGASREPGDRVQFTEFIQKNLHLYQFRNTIPLSTAAAANFTRGELATALRKNPYMVNVILGGYNKDVGASLYYIDYIATLHKIDKGAFGYRSYFCLSLMDKLYRPDMTVEEAVDLVDKCIKEIRLRLVVAPQNFVIKIVDNDGAREYARR

SEQ ID NO: 86127 - DNA, 911 bp, Zea mays
  misc_feature: Ceres CLONE 1572558
  misc_feature: Encodes the peptide sequence at SEQ ID NO. 86128
  misc_feature (730)..(730): n is a, c, t, g, unknown, or other
acccgcggtggcggccgctctagaactagtggatcccccgggctgcaggaattcgtctcacccctagaaaaagagccgtgtccgcccgcgcgccatcctccccgcgccatgcccatgcgcacgcgcacgcgctccaccccttgagcacgcacgcacgtcgccgccgccacacgcatccgtctccgcctcccgtacgtgtccatggccgccgccacggcggccgggcggctgctcctggccgcggcggcgctcatcctcgcggcggcgtccagcggcgtccccctggcggcggctcaggccaagtcggaggccgatgtcctgagcgagttccgggcgacgctgcgggggccggacccggacggcggcccgccggcggagctgaaccagtgggcgacggggggcgcgccctgcgacggcaacgcgaccagctggcctcgagtgaggaggtgcgtcgatggccgagtggtggtcctgcagctggagggcctccggctgcagggcgccgcgccggacctggccctgctcgcgccgctccggagcctgcgctcgctcagcctgagcaacaacagcctcgcgggcgcgttcccggacgtgtcgccgctccccgcgctcaagttcctcttcctctggcagaacaagctcgccggggagatccccgacggcgcgttcgcggccctcagggggctccagagggtcgacctctccaggaacgagttctccggcccgatanccagctccatcgcgtcctccgccaagctgctgtccgtcaaactcgccaacaacaacttctccaggccccgtcccgaaaggctccggaagttaggcgccaatgtccagctccagggaaaaaattctctgcggggacatggcggcaccccgtggcctccggtcctcggtgggcttcctgggta

SEQ ID NO: 86128 - protein, 236 aa, Zea mays
  misc_feature: Ceres CLONE 1572558
  misc_feature: SWISSPROT Homolog: EC 2.7.11.1 Non-specific serine/threonine protein kinase
  misc_feature (177)..(177): Xaa is any aa, unknown, or other
MAAATAAGRLLLAAAALILAAASSGVPLAAAQAKSEADVLSEFRATLRGPDPDGGPPAELNQWATGGAPCDGNATSWPRVRRCVDGRVVVLQLEGLRLQGAAPDLALLAPLRSLRSLSLSNNSLAGAFPDVSPLPALKFLFLWQNKLAGEIPDGAFAALRGLQRVDLSRNEFSGPIXSSIASSAKLLSVKLANNNFSRPRPERLRKLGANVQLQGKNSLRGHGGTPWPPVLGGLPG

SEQ ID NO: 86129 - DNA, 949 bp, Zea mays
  misc_feature: Ceres CLONE 1572560
  misc_feature: Encodes the peptide sequence at SEQ ID NO. 86130
ctccccgcggtggcggccgctctagaactagtggatcccccgggctgcaggaattcgtctcacccctagaaaaaaataacagcctcaggttactcgcagaaaaaattattagctcgctgcgggggtcgaaccgaggctcctagctgatcgcgcgcgcacagggcgagcggacaagaaagcttgctttgtgctcaccggcggcacggaccccctgcgatggaagccgtcggcgtcactcctgcccccgtggcggcgccggagaagaagaagctgcttgacctcaaggaccccttccccgccgccgcgaacggcggcgcctaggcgtccccggcggcgaagtgggcgatgaagaagaagctggtgggcggcgacgccggctacgtgctcgaggacgtgccgcacctcacggattacatgccccagctcccgacatacccgaatcctctccaagacaacccgggcgtattcagtcgtcaagcagtatttcgtcaacccagacgacaccgtcacgcagaagattgttgttcataaagacagttgcaggggcacccactttcggcgttgccgggcaccgcagcgggtgtcctccagtcccataaggtgaacgccccctttgtcacctgtggaagctcctgcccgggattgaaaccggtcatccccaaacttgtttgcggcttgattgaaatgtattggggccccccgcgcccccggcataaagggggaaccagggggtcctttccaaaaaaaacggtggggggaacccaaaggcggggaaaaaacccccaaaaagggggggaatgcccccgaaaccccaaagggggggggaaccccccaaatcctttttttgtcttcagaaccggggtttaaccagtcttttttttggagggccgcgcccccaaaagcgcccctcttttttttaggaaaaccggaaacccccccttattctttt

SEQ ID NO: 86130 - protein, 61 aa, Zea mays
  misc_feature: Ceres CLONE 1572560
MKKKLVGGDAGYVLEDVPHLTDYMPQLPTYPNPLQDNPGVFSRQAVFRQPRRHRHAEDCCS

SEQ ID NO: 86131 - DNA, 959 bp, Zea mays
  misc_feature: Ceres CLONE 1572561
  misc_feature: Translation starting site: 197
  misc_feature (903)..(903): n is a, c, t, g, unknown, or other
ctccccgcggtggcggccgctctagaactagtggatcccccgggctgcaggaattcgtctcacccctagaaaaattcccgttccccaattcgaaatcgagtcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacggccccactgtgcagcttgaggccaccacgcagttcaggaagctgctctccatagagcgtagtcccccaattgaagaggtgatcagcacaggagtcgtgccccgattcattgagttccttacacgtgaggaccatccacaactccagtttgaggctgcatgggcgctcaccaacattgcatcaggcacatcagagaacactaaggtggtggtttgagagtggtgctgtgcccatctttgttaagctcctcaactcccatagcgaagatgttcgtgaacaggctgtatgggctttaggtaatgttgctggtgactcccaaaagggccgtgatctggtgctaagccatggtgggctattccccttgcttgcacagcttaatgagcatgctaagctctcgatgctggagaaatgcactgggacactatcaaaacttctgccgtggggaagccacnaccgaaactttgatcaggtcaaaaccagcattggcagcactgcaagcaactattcc

SEQ ID NO: 86132 - DNA, 969 bp, Zea mays
  misc_feature: Ceres CLONE 1572562
  misc_feature: Encodes the peptide sequence at SEQ ID NO. 86133
  misc_feature (68)..(68): n is a, c, t, g, unknown, or other
  misc_feature (71)..(71): n is a, c, t, g, unknown, or other
  misc_feature (139)..(139): n is a, c, t, g, unknown, or other
  misc_feature (734)..(734): n is a, c, t, g, unknown, or other
  misc_feature (736)..(736): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
ctcacccgcggtggcggccgctctagaactagtggatcccccgaggctgcaggaattcgtctcacccnctngaaaaaaaaaaaaaaaaaaaaaaaaaaaaaaaaaatttcccgtcgtcgtcgtcagcagcttctgcttngctttgtggggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcctccgagccggccgtgtccgtgcagctcggcgaccacggccacctcgcttactcccacaccaaccaggcgctcctccgccccaggtcgttcgcggccaaggacgaggtgttctgcctgttcgaaggggtgctggacaacctgggtcggctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctcgtcgcatccgaccccgagggcagggtgccgctcttctggcggagtactacgcagcgctcgcgggcacgactcgcgggncnttttccctgcggannnnnnnnngggaaattttcctctttcccaaagggaacgacaccttcccgggtcaacaaaatggggattcttggctttaacccggggtgtgccccttggggacccccaaccttgactttcctggtggggcctgaacaccgggagcgaacttctttcgtgggggccctgggaattgaataaactgggccgcccttattttcaccccacctacaggggttcc

SEQ ID NO: 86133 - protein, 236 aa, Zea mays
  misc_feature: Ceres CLONE 1572562
  misc_feature (173)..(173): Xaa is any aa, unknown, or other
  misc_feature (178)..(178): Xaa is any aa, unknown, or other
  misc_feature (179)..(179): Xaa is any aa, unknown, or other
  misc_feature (180)..(180): Xaa is any aa, unknown, or other
MLAVFSGQVVEVPAELVAAGSRTPSPKTKASQLVGRFLAASEPAVSVQLGDHGHLAYSHTNQALLRPRSFAAKDEVFCLFEGVLDNLGRLSQQHGLSSKGANEVLLVIEAYKTLRDRAPYPASFMLAQLTGSYAFVLFDKSTNSLLVASDPEGRVPLFWRSTTQRSRARLAGXFPCGXXXGKFSSFPKGTTPSRVNKMGILGFNPGCAPWGPPTLTFLVGPEHRERTSFVGALGIE

SEQ ID NO: 86134 - DNA, 899 bp, Zea mays
  misc_feature: Ceres CLONE 1572563
  misc_feature: Encodes the peptide sequence at SEQ ID NO. 86135
  misc_feature (567)..(567): n is a, c, t, g, unknown, or other
ctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctggggccggtgagaagccaatgatagttgttcagcacaaggggggagagaaacagcttgcagccgaagagatctccctcatggntctcagtcagatgcgtgagatcgctgaagcctaccttggcagcacgatcaagaatgctgttgtcacggtccctgccgtaactcaacgactcacaaagggcgggccacgaaggatgcttggggtgattgctggccctaaaggtgcggggtacatccatgagccaccccctgctgctttggcccttggggccttacaaaaagcaaccaaccgtcgggagaaaaaatgtccccaccttgaccttggaaggggggaccttcaaaggtcccccccttcatatttgggaaagggtatcttgtagggaaaggccccacgtgggaaccccctttttgggg

SEQ ID NO: 86135 - protein, 225 aa, Zea mays
  misc_feature: Ceres CLONE 1572563
  misc_feature (9)..(218): Pfam Name: HSP70 Pfam Description: Hsp70 protein
  misc_feature (127)..(127): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGAGEKPMIVVQHKGGEKQLAAEEISLMXLSQMREIAEAYLGSTIKNAVVTVPAVTQRLTKGGPRRMLGVIAGPKGAGYIHEPPPAALALGALQKATNRREKKCPHLDLGRGDLQRSPPSYLGKGIL

SEQ ID NO: 86136 - DNA, 922 bp, Zea mays
  misc_feature: Ceres CLONE 1572564
  misc_feature: Encodes the peptide sequence at SEQ ID NO. 86137
  misc_feature (757)..(757): n is a, c, t, g, unknown, or other
  misc_feature (797)..(797): n is a, c, t, g, unknown, or other
ctccccgcggtggcggccgctctagaactagtggatcccccgggctgcaggaattcgtctcacccctagaaaaaagcgccagcgcggcagagagtcgagaccttctagctaggccgctgccacgtcaaaactagctcctccagacaaccaatcagctagccgaagccggtcgattagcatgcagcagcgctagtagacgtcgtctccgggtctccactctccacacagaaacccatacaaaatccgcatccagaatcaccggagatacgagtccgcgcgtacgttgcagttgaattgtgaagagaggctgtgcgcagtgctgctgctgcttcttcttcttcgacgcatgcacgcacatggatggtgctgctgagtgctgacctccggccgtacgtgatcttcgatctccacacggcggcaagcgatcgagaggcgtggttcccgtggcgtcaaccgacacctagcagctgctagctcatctgcttgatctctagctgagactccgagcaaaatgcagcagccaggaacaacaagctaggccccctcacgcagaccgcacgaccgagcgcgcggcattgaccgacccatcgccgccgccgccgcctcgatcgaccatgacgcttgcgagcacggacaaggtggtgctgggatgcatcgcgttcagcatcttctgggtgctggccgtcttcccctcggtgcgttcatgccggtgggccgcaccgcgggctcgctcctgggcgccatgctcatggtgctncttcgcgtgatgacccccggagggaggctactaggcatcngacctcccgatcctgggcctgctcttcggcaacatggtggtcagcatcttcctggagcgcgccgacatgttcagttacctctgcagccccttgggcgtgcggaacccggggcaccaaggacctgc

SEQ ID NO: 86137 - protein, 50 aa, Zea mays
  misc_feature: Ceres CLONE 1572564
  misc_feature (48)..(48): Xaa is any aa, unknown, or other
MTLASTDKVVLGCIAFSIFWVLAVFPSVRSCRWAAPRARSWAPCSWCXFA

SEQ ID NO: 86138 - DNA, 949 bp, Zea mays
  misc_feature: Ceres CLONE 1572565
  misc_feature: Encodes the peptide sequence at SEQ ID NO. 86139
  misc_feature (897)..(897): n is a, c, t, g, unknown, or other
acccgcggtggcggccgctctagaactagtggatcccccgggctgcaggaattcgtctcacccctagaaaaagtactggccgccaccactcgccactcggccccaggaccctcctcttcctcgccagcaagccggcacgatccctcccttccgggaaaaaggctcccaacctgttccgagccagccggccatggcgattagggctggccgctcgccccttctccacctcctcgccctcgccttcctcatcctcgccttcctcttcctcgccgcctctccctgcctccaagctcgagtggaccatcacaaacagatatctcactggactgggcaacccaactttgacctgcagaatgtctcatcgggtcgaaaggatggccctcatctcctgggtagatcaaaggaaataacacacatgaaattaaggagagttgctgtaaggaagaaaatggaagtagtgcagcacgatgatgaagcgttagttaaacttgagaatgcaggtatcgaacgtgcaaaagctgttgactctgctgtgctgggaaaatacagcatctggagacgtgaaaatgaaaatgaaaacgcagattcaagggtccgtttgatgcgagatcaaatgatcatggccagaatatattctgttcttgccaaatcgcaggacaagcttgatctctatcatgagctgcttgcaacgctcaaggaaagccagcgatcccttgcggtagctactgctgatgctgaacttcccaagagtgcgtcggatagaaccaaagcatgggccagttgtatcaaaagcaagggacctactgtacgattggcagtaaattaccagcgtttgagagcaatgcttcagtcagcagatgagcatgtccagagcctgtagaagcaaagcagcttccnttagccgctagcagctaagacaatcccaattgcatccattgtcttttcatgt

SEQ ID NO: 86139 - protein, 229 aa, Zea mays
  misc_feature: Ceres CLONE 1572565
MAIRAGRSPLLHLLALAFLILAFLFLAASPCLQARVDHHKQISHWTGQPNFDLQNVSSGRKDGPHLLGRSKEITHMKLRRVAVRKKMEVVQHDDEALVKLENAGIERAKAVDSAVLGKYSIWRRENENENADSRVRLMRDQMIMARIYSVLAKSQDKLDLYHELLATLKESQRSLAVATADAELPKSASDRTKAWASCIKSKGPTVRLAVNYQRLRAMLQSADEHVQSL

SEQ ID NO: 86140 - DNA, 975 bp, Zea mays
  misc_feature: Ceres CLONE 1572567
  misc_feature: Encodes the peptide sequence at SEQ ID NO. 86141
ggagctccccgcggtggcggccgctctagaactagtggatcccccgggctgcaggaattcgtctcacccctagaaaaaaaaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttaggtccattgcatcttctgcggttgcggttagtattgctgtttcttgctccttgtttcttgctcttttgcttctaaccatggacgcaggaaccccctccatctcatcagagaagagccacacggcggcagcggcgcggccccctcttcaggaaggccggcactcggccctacatgccgtcgctgagcacaggatcgcgcaacccgtcggccaagtgctacggcgataggttcatcccggacaggtcggcgatggatatggacatggcgcactacctgctcacggagcccaggagggaccaagagaacgcggtggcagcgtccccttccaaggaggcgttccggaggctgcttcccgaaaaagttgctcaacaacccggacccgcatccttggccttcaggaacaagccgccctgtgttccgaaaacgtcttcgggagcgttcacagcgttcctcctcccctggccaagctgggtcaagcagcggtcaacttattccccagtctgcaaaaaggactttggaccccaccaaagctgtttacgaataactactccacctggttggattggggaacaaaaaccggggtttccagtggcctgggggaacacgggaataccggggggaacccctcactggaacccctctttgaccctgtgaccttccgcaa

SEQ ID NO: 86141 - protein, 160 aa, Zea mays
  misc_feature: Ceres CLONE 1572567
MPSLSTGSRNPSAKCYGDRFIPDRSAMDMDMAHYLLTEPRRDQENAVAASPSKEAFRRLLPEKVAQQPGPASLAFRNKPPCVPKTSSGAFTAFLLPWPSWVKQRSTYSPVCKKDFGPHQSCLRITTPPGWIGEQKPGFPVAWGNTGIPGGTPHWNPSLTL

SEQ ID NO: 86142 - DNA, 943 bp, Zea mays
  misc_feature: Ceres CLONE 1572571
  misc_feature: Encodes the peptide sequence at SEQ ID NO. 86143
  misc_feature (548)..(548): n is a, c, t, g, unknown, or other
  misc_feature (805)..(805): n is a, c, t, g, unknown, or other
ctccccgcggtggcggccgctctagaactagtggatcccccgggctgcaggaattcgtctcacccctagaaaaagttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttttgatcaagctcttgcctcaggaaagatttatgatggagatgggttcaactacatcaaagaatcttttgaaaatggtactcttcaccttattgggttgttgagntgatggtggtgtccactcccgccttgaccaactgcagttacttctgaaaggtgtcagtgagagaggagcaaaaaaaattcgtgtgcacatccttacagatgggcgtgacgttttggatggcagcagtgttggtttcgtggagaccctagagatgatctttttgagcttcgagcaagggtattgatgcacagattgcttctggtgggtggaaagatgtatgttacattggacgttatgagaatgactggggatgtggntaaacgtggctgggatgctcaagtgctccgaggagcaccctacaatttcaaagggcacttgaagctgtgaaaacctgaaaagcacagctatgctaatgaccatacctgcccccatttgtgatattaatacagcgcaac

SEQ ID NO: 86143 - protein, 130 aa, Zea mays; identical to SEQ ID NO: 83886
  misc_feature: Ceres CLONE 1572571
  misc_feature (15)..(129): Pfam Name: iPGM_N Pfam Description: BPG-independent PGAM N-terminus (iPGM_N)
  misc_feature: SWISSPROT Homolog: EC 5.4.2.1 Phosphoglycerate mutase

SEQ ID NO: 86144 - DNA, 799 bp, Zea mays
  misc_feature: Ceres CLONE 1572572
  misc_feature (767)..(767): n is a, c, t, g, unknown, or other
  misc_feature (770)..(770): n is a, c, t, g, unknown, or other
ctccccgcggtggcggccgctctagaactagtggatcccccgggctgcaggaattcgtctcacccctagaaaaaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcaggtcttggggtcttcctcctctcgcatccgctagcgccggcgcaaggactcgtcccgacgtccccaaatggaaacaggcaaggttgccgcccacccctccggggaaacccccattatggggacctccccctattggttccacccggaagttcccttcccggacctcccggccaaagaagggccccaaggggcttataaccgtggtaaagggtggggcccccttcccccccattctgggggggcccccccccccccgggggccgccccaaaggggggggggttccccccccccgtgcgaaaaaaaaaaacaggtggtggggggggggcccccccccccccccccgaaaaaaacccccgcggggggggaaaaaaaaatacccccccgcaaataaaaccccccgggggggggggggtctctccccccccccccccctgggggagaataaattacggccccccccgcgtgaaaatagggtgtttaaaaaaaccccccctttttttttccaaaaaaaaagggtttctccccccccgccccnttntttgaaaaaaagaaaaaagacccccccct

SEQ ID NO: 86145 - DNA, 955 bp, Zea mays
  misc_feature: Ceres CLONE 1572573
  misc_feature: Translation starting site: 194
  misc_feature: SWISSPROT Homolog: EC 1.4.1.2 Glutamate dehydrogenase
  misc_feature (955)..(955): n is a, c, t, g, unknown, or other
ctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagagtaaccgcaccacaccctcgtacgtcgccttcaccgactccgagcgcctcatcggagatgcggccaagaaccaggtcgccatgaacccccatcaacaccgtctttgatgccaagcgtctcattggcaggaggtttagtgatgcctctgtccagagtgatattaagctgtggcccttcaaggtcattcctggggcccggtgagaagccaatgatagttgttcagcacaagggggggaggagaaacagtttgcagcccaagagatctcctccatgggtctcatccaagatgcgtgagatcgctgaagctaccctggcagcccgatcaaaaaatgctgttgtcacggtcccctgcctcttttcaccactcacagaggcaagcccccaaagatgctgggggtgaattgctggccctcaatgtgctgcggatctccatgaacccacccgctgctgccatggcctatgggcctgaaaaaaagggcacccgcgtcggtgaaaaaaatgtccctctctttgaccctggaggggggaccttccaggtccccccccttataattaagaaagtgtcttttagggaaggcccaccttggcacccccatcttgggggggggggattttaaaacggagggccaccccttgtcccggatttcaaaaan

SEQ ID NO: 86146 - DNA, 960 bp, Zea mays
  misc_feature: Ceres CLONE 1572574
  misc_feature: Encodes the peptide sequence at SEQ ID NO. 86147
  misc_feature (803)..(803): n is a, c, t, g, unknown, or other
ctccccgcggtggcggccgctctagaactagtggatcccccgggctgcaggaattcgtctcacccctagaaaaaactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccctcggaaatccctcgaagggactggttcccctctgacttcatctttggtgccgccacttcagcgtaccaaattgaaggtgcacggaacgaagatggaaagggggaaagcaattgggatcacttctgccacaattttccggaaaggataatggacgggagcaatgcagacattggagcgaattcgtaccatatgtacaaaacggatgtcagattgctgaaggaaatgggcatggacgcatataggttctctatctcttggcctagaatactgcctaagggaacggtcgaaggaggtattaaccaggatggcatcgattactacaaaaggctcatcaacttgttgctagagaatggcatagagccatatgtaacaattttccactgggatgtccctcaagccctagaagaagaagacggcggattcttagataagactcattaagaggatttgtaatgattacaaaacttcgcctaaggggtggcttcnacaacttttggggaaaaagtggaagaatttgggtggacctttaatgagccccaagaaatttacttcatttttcttaggggaaccgggggtctttggcccaagggagcatgcttcccgggaacagggctggggccatcccaacttgggaaattccccc

SEQ ID NO: 86147 - protein, 204 aa, Zea mays
  misc_feature: Ceres CLONE 1572574
  misc_feature (63)..(205): Pfam Name: Glyco_hydro_1 Pfam Description: Glycosyl hydrolase family 1
  misc_feature: SWISSPROT Homolog: EC 3.2.1.21 Beta-glucosidase
MNHAAHPVLRSHLGPNNESFSRHHLSSSPQSSKRRFNLSFTPRSARVGNQNGVQLLSPSEIPRRDWFPSDFIFGAATSAYQIEGARNEDGKGESNWDHFCHNFPERIMDGSNADIGANSYHMYKTDVRLLKEMGMDAYRFSISWPRILPKGTVEGGINQDGIDYYKRLINLLLENGIEPYVTIFHWDVPQALEEEDGGFLDKTH

SEQ ID NO: 86148 - DNA, 920 bp, Zea mays
  misc_feature: Ceres CLONE 1572575
  misc_feature: Encodes the peptide sequence at SEQ ID NO. 86149
atagctggagctccccgcggtggcggccgctctagaactagtggatcccccgggctgcaggaattcgtctcacccctagaaaaaccctcacagtcacagacacacaccgctgcttcaagaaaccaccgagagcccaaccgcacaggcaggagagagagcagggagccagggacagtagcgtggggccggggagcaacgatggaggggaaggaggaggacgtgcgcctgggcgccaacaagttctcggagcgtcagcccatcggcacggcggcgcagggcgccggcgccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgccggcatctccagaggacacatcaacccagctgtgaccttcgggctgttcttggccaggaagctgtccctgactagggccatcttctacattatcatgcaatgcctgggtgccatctgtggagctggaattgttgaagggctccaggcagggctttaatgggcaaaggtggtggggcaaatgttgcccccccgggtacacaaagggggatgggcttgcccctaaaatgtttggcaactttatcctggggaaaaccttctttaggggctcctttgccaaaaggaaccccgggggacccaatgttccccactccttgccccaccgccaatttgggtctcccgtgtttccttggtaccccttggtctccccccccatacacgggtcgcggg

SEQ ID NO: 86149 - protein, 163 aa, Zea mays
  misc_feature: Ceres CLONE 1572575
  misc_feature (50)..(164): Pfam Name: MIP Pfam Description: Major intrinsic protein
MEGKEEDVRLGANKFSERQPIGTAAQGAGAGDDDKDYKEPPPAPLFEPGELKSWSFYRAGIAEFVATFLFLYITVLTVMGVSKSTSKCATVGIQGIAWSFGGMIFALVYCTAGISRGHINPAVTFGLFLARKLSLTRAIFYIIMQCLGAICGAGIVEGLQAGL

SEQ ID NO: 86150 - DNA, 951 bp, Zea mays
  misc_feature: Ceres CLONE 1572577
  misc_feature: Encodes the peptide sequence at SEQ ID NO. 86151
  misc_feature (738)..(738): n is a, c, t, g, unknown, or other
ctccccgcggtggcggccgctctagaactagtggatcccccgggctgcaggaattcgtctcacccctagaaaaatgccacacatccatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacgagaagatcgtgcgcgacacctgccgcgagatcgggttcacctccgacgacgtggggctcgacgccgaccgctgcaaggtgctggtgaacatcgagcagcagtcccccgacatcgcgcagggcgtgcacgggcacttcacgaagcggcccgaggagatcggcgccggcgaccagggccacatgttcgggtacgccaccgacgagacccccgagctgatgccgctgagccacgtgctggccaccaagctcggcgcgcgcctgacggatgtccgcaaggacggcacctgcgcctggctcatgcccgacggcaagacccaggtgacggtggagtacgtgtacgagggcggcgccatggtgcccngtcgcgtgcacaccgtgctcatctccaccagcacgacgagaccgtcaccaacgacgagatcgccgccgacctcaaggagcacgtcatctagcccgtcatcccggataggtacctgtacgagaagacatctttcacctcatcccgtcggggcgcttcgtcatcgtgcgggccccacgggtacgcgtggctcacctggcgcagatcatcatcgac

SEQ ID NO: 86151 - protein, 258 aa, Zea mays
  misc_feature: Ceres CLONE 1572577
  misc_feature (4)..(103): Pfam Name: S-AdoMet_synt_N Pfam Description: S-adenosylmethionine synthetase, N-terminal domain
  misc_feature (118)..(239): Pfam Name: S-AdoMet_synt_M Pfam Description: S-adenosylmethionine synthetase, central domain
  misc_feature: SWISSPROT Homolog: EC 2.5.1.6 Methionine adenosyltransferase
  misc_feature (188)..(188): Xaa is any aa, unknown, or other
MAAESFLFTSESVNEGHPDKLCDQVSDAVLDACLAQDPDSKVACETCTKTNMVMVFGEITTKASVDYEKIVRDTCREIGFTSDDVGLDADRCKVLVNIEQQSPDIAQGVHGHFTKRPEEIGAGDQGHMFGYATDETPELMPLSHVLATKLGARLTDVRKDGTCAWLMPDGKTQVTVEYVYEGGAMVPXRVHTVLISTSTTRPSPTTRSPPTSRSTSSSPSSRIGTCTRRHLSPHPVGALRHRAGPTGTRGSPGADHHR

SEQ ID NO: 86152 - DNA, 920 bp, Zea mays
  misc_feature: Ceres CLONE 1572578
  misc_feature: Encodes the peptide sequence at SEQ ID NO. 86153
  misc_feature (785)..(785): n is a, c, t, g, unknown, or other
  misc_feature (816)..(816): n is a, c, t, g, unknown, or other
ctccccgcggtggcggccgctctagaactagtggatcccccgggctgcaggaattcgtctcacccctagaaaaatgtcaattgtcaggggaggtcttacacctattgatgttttttctgttgaatggattcaaagtgggactatgcattatggtacaaccgtatcatattttggttttgttagcgatgttcttgagctctcagagaagtatcagaagcattttggtcctttacgatactttgtagctggttttctcaaattcctgtgtttgccaaagtacagttttgaattggaatatcttccagtatcagatgttaatggcgccgagcataaaattttggtaggacaagaaaaggttgacgcgtctgatctatatgatgatgtaattcggagatcaagagcagaatgtttaccacgcgcctcaagtttatctagcattgattcaataatgtctacaggcatcatgtctggggcagagctggaggtttgtagtcctcgtgcaaataatgaaccttctgaggttgttcgtggacttgatccgaaatcaaagcgcttatcgttaggaagagctagtacatttaaagaaccagaagaagtgctccatccccactcccatggtacatctactcccagctggcgtagatctaagtcaaaatcaaggactgaaaaggcaaagccaggcttgtctgctacacacgatgcaaaatcttctaaggttaatgcagacaaagaggacacatcatccacaatttctgatcctggacctgtggctgtatgggattcangaccaagtgggacgatgaacctaatgggatnaatcacctgactgggaacccgagtactcattgagctcatagccctcgcgaggatatgagcttgtctgactaagagctggtactagtttagatgaaaggggacat

SEQ ID NO: 86153 - protein, 250 aa, Zea mays
  misc_feature: Ceres CLONE 1572578
  misc_feature (238)..(238): Xaa is any aa, unknown, or other
  misc_feature (248)..(248): Xaa is any aa, unknown, or other
MSIVRGGLTPIDVFSVEWIQSGTMHYGTTVSYFGFVSDVLELSEKYQKHFGPLRYFVAGFLKFLCLPKYSFELEYLPVSDVNGAEHKILVGQEKVDASDLYDDVIRRSRAECLPRASSLSSIDSIMSTGIMSGAELEVCSPRANNEPSEVVRGLDPKSKRLSLGRASTFKEPEEVLHPHSHGTSTPSWRRSKSKSRTEKAKPGLSATHDAKSSKVNADKEDTSSTISDPGPVAVWDSXPSGTMNLMGXIT

SEQ ID NO: 86154 - DNA, 934 bp, Zea mays
  misc_feature: Ceres CLONE 1572579
  misc_feature: Encodes the peptide sequence at SEQ ID NO. 86155
  misc_feature (668)..(668): n is a, c, t, g, unknown, or other
agctccccgcggtggcggccgctctagaactagtggatcccccgggctgcaggaattcgtctcacccctagaaaaaggcggctccatcccctccgagctcccgctcccctccgcccccggcgtcaccccgcgccccgcggatcgcaccgtcgcctccgcatcccccgtcgcagccgcggtcgcacggccacgcgtaccggtcgcttcgcctgccgccgctgcggcggcagccgcgatgccttccttcctcacaaacccgtcccgaatcggccgtcacttcgacgaggacgagcgcacccccttcgagcccaccacgccacgccgtcccgcgccgtccccaacgtcgttcgcacccgctcccgtggtggcgcccaccagatcaggtccggggaacgcatggggcccgaagaaggaggcctcttcggcgccttcccctgtgggtcatgctcctgcctccgccggcgaccagatctggtccgcgacacgcatcgcccaggcgagcgcagtggagaaggtaatctccggaagatggcacccgcccgagcccacgtctccgccggcgccggtgtcagttccggtgttggagactcccgtagccccgccagagattgagaggcctacgtccagtggggtgagagactagataggggggtgggagaggggcgccncaccagtgagacccgcgtccctgaaggaaaggattgggcaagggagagctgggggaggtgccagagagaacccagttggaagctgccttccccgggcccagccaattgaatgatccttgaacgacctccttgctattgtcgaaaccaaaacagggtgcccccaggtcccaggtgaacgcgggccccttagaaagggcgaagataaaccttggttgggaaccaaaagtgtagggcctccctaaaaaaagggatttcttggaaaaaat

SEQ ID NO: 86155 - protein, 213 aa, Zea mays
  misc_feature: Ceres CLONE 1572579
APRGGGRSRTSGSPGLQEFVSPLEKGGSIPSELPLPSAPGVTPRPADRTVASASPVAAAVARPRVPVASPAAAAAAAAMPSFLTNPSRIGRHFDEDERTPFEPTTPRRPAPSPTSFAPAPVVAPTRSGPGNAWGPKKEASSAPSPVGHAPASAGDQIWSATRIAQASAVEKVISGRWHPPEPTSPPAPVSVPVLETPVAPPEIERPTSSGVRD

SEQ ID NO: 86156 - DNA, 789 bp, Zea mays
  misc_feature: Ceres CLONE 1572580
  misc_feature: Encodes the peptide sequence at SEQ ID NO. 86157
  misc_feature (308)..(308): n is a, c, t, g, unknown, or other
  misc_feature (700)..(700): n is a, c, t, g, unknown, or other
ctccccgcggtggcggccgctctagaactagtggatcccccgggctgcaggaattcgtctcacccctagaaaaaagtactactcttgtgtagtagcttttaatttcccccagctagctagctagctagtttctacttccgtccgcgcgcgctcatctgcgcacgcacgtgtccccgtccgcaatggagtccgaggccggcctgcttgtccgctcctccctgaacggcgagggcctgtgcatgccggcgccgcgcgccgacccgctgaactggggcaaggccgcggagggcctgctccggtagccaccntggacgaggtgaaatcggatgggtggcggtagtcccggcgagcccgctggtggaagatcccagggcgccaagccttaaacggtccccccaagggtgggcccccccctggccccggggggcccccgggggggcgggcaaaagccccccctttggaaaagtggggaaaaaaatccccccccccccaaaaagcgcgtttagggggcccccccaacccccaccttggggggttttttggggccccccccgttgtgttttaaaaaaaggggccccccaaatttttttgttttggggggggttcccccccccacccgggtttttttggggggttttttttttctccccccccccgcggggggggaaaaaaaaaaaaaaaaaaaagggggggggggggntccccctcccccccaaaaaagaggaggaggagagaccccccccccccccaaaaaaaaatctccttccccccccccccggttgggggggt

SEQ ID NO: 86157 - protein, 39 aa, Zea mays
  misc_feature: Ceres CLONE 1572580
  misc_feature: SWISSPROT Homolog: EC 4.3.1.5 Phenylalanine ammonia-lyase
MESEAGLLVRSSLNGEGLCMPAPRADPLNWGKAAEGLLR

SEQ ID NO: 86158 - DNA, 826 bp, Zea mays
  misc_feature: Ceres CLONE 1572582
  misc_feature: Encodes the peptide sequence at SEQ ID NO. 86159
ctccccgcggtggcggccgctctagaactagtggatcccccgggctgcaggaattcgtctcacccctagaaaaagatcttggcttgagaagtttcggatcctcgcatcgtccgcaccttatcctctcgactttacagtacctgctctcagctcctccctatctcaatggcatccgcgaatgccatctccaccgcctcccccttccggcccctctctcaaggcacggcgacaaggtcacagcggttcgtggtgcgtgcgaacgccaaagacattgcctttgacaagaaatccagagcaacgctgcaagccggcgtcgagaagctcacaaacgccgtcggtgtcaccctcgggccacgagggaggaatgtggtgctcgatgagtacggcaaccccaaagttgtgaatgatggagtcactattgcccgtgctattgagctgtatgatccaatggaaaatgctggtgcagcattgattcttgaggttgctagcaagaccaatgattcagctggagatgggactacaactgcatgcgctcctgctcgcgaaatcatcaagctaggcattctgagtgtacatctggtgcaaatcctgtacactaaagaaaggatagacaaaactgtgcaggggctaattcaggagcttgaaaatgagtctagaccatcaaggggtggtggggatatcaaagctgttgcatctatctctgctgggaaagatgaatttatcggaatccttaattgctaaaacaaatgaaaaaaaggggggcctgagggaggttccaaaaatggaaatcccccccggcttttggaaaccacttggttgagactaa

SEQ ID NO: 86159 - protein, 191 aa, Zea mays
  misc_feature: Ceres CLONE 1572582
MASANAISTASPFRPLSQGTATRSQRFVVRANAKDIAFDKKSRATLQAGVEKLTNAVGVTLGPRGRNVVLDEYGNPKVVNDGVTIARAIELYDPMENAGAALILEVASKTNDSAGDGTTTACAPAREIIKLGILSVHLVQILYTKERIDKTVQGLIQELENESRPSRGGGDIKAVASISAGKDEFIGILNC

SEQ ID NO: 86160 - DNA, 993 bp, Zea mays
  misc_feature: Ceres CLONE 1572583
  misc_feature: Encodes the peptide sequence at SEQ ID NO. 86161
  misc_feature (719)..(719): n is a, c, t, g, unknown, or other
  misc_feature (720)..(720): n is a, c, t, g, unknown, or other
  misc_feature (727)..(727): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (766)..(766): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (785)..(785): n is a, c, t, g, unknown, or other
  misc_feature (807)..(807): n is a, c, t, g, unknown, or other
  misc_feature (813)..(813): n is a, c, t, g, unknown, or other
  misc_feature (847)..(847): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (903)..(903): n is a, c, t, g, unknown, or other
  misc_feature (904)..(904): n is a, c, t, g, unknown, or other
  misc_feature (907)..(907): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (928)..(928): n is a, c, t, g, unknown, or other
  misc_feature (984)..(984): n is a, c, t, g, unknown, or other
ctccccgtcggtggcggccgctctagaactagtggatcccccgggctgcaggaattcgtctcacccctagaaaaagtaaagggtagaacgtctccactctcccgtacgccgatacccactgacgccaccgcccgaagcctccccgagaaacaggagccggcgcggggatgtcgtccatctcgcggaatctccggcgatccctcgccccggaccgcctgcgccgcctctcccagcacccgcgagagtatgtgacgtcggagtgccaccgccccgtcgtcctccacaagcgcggccccgacatcctccacgacccctggttcaaccggggcacggcgttctcgatgaccgagagggaccgcctcggcctccgcggcctgctcccgcccaacgtcgtctcctcgcagcagcagaatcacagatttcctgcttgatcttgaacaggctgcagaatatgcaagagaatggccgtctggatacctatccattgggagaatggcgccgccccttaccaattgcgtgggccgaaaagaaaaaaaaagggtgtccccaaggggctaattgataacaattgagggggggtggagagcgcaccttcgtttcttccacccacaccgctttggacttggtttgccgcaaaaaaaacaaacgggggggcgttgtccacccccctggggggatgtaggattactatgggccaaaataattcggcggggagatgnnataattnccctcagtgtagggaatggnnncccccaagccaataggnaaagtnnngtnnnccatgntattatgcccatgagcaggaanttgggncctggggaactctggggggggcggcgttgggctncccctggaaaaattgcggggtctttgtgtgcgcgnnngcgcatagtcgagaattcnnccngnnnnnnnnacaaaaaagggntgttttccgcgttatatgacaacaaacccctaggacccttactgggcccaacccgncctgagggg

SEQ ID NO: 86161 - protein, 87 aa, Zea mays
  misc_feature: Ceres CLONE 1572583
  misc_feature: SWISSPROT Homolog: EC 1.1.1.39 Malate dehydrogenase (decarboxylating)
MSSISRNLRRSLAPDRLRRLSQHPREYVTSECHRPVVLHKRGPDILHDPWFNRGTAFSMTERDRLGLRGLLPPNVVSSQQQNHRFPA

SEQ ID NO: 86162 - DNA, 969 bp, Zea mays
  misc_feature: Ceres CLONE 1572586
  misc_feature: Encodes the peptide sequence at SEQ ID NO. 86163
  misc_feature (496)..(496): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
ctccccgcggtggcggccgctctagaactagtggatcccccgggctgcaggaattcgtctcacccctagaaaaaccaccaccaccggtcaccgaaacgcagcaactgacaggcacctgacggagagctagtcgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtgccggtgccgccggcgcggccgttcctggacacgttccacgggaacctcaaggagaccttcttcccggacgacccgttccgcggggtggtgcgggagcgcggcgccgggcggcggaccgtggccgcgctgcgctacttcttccgttcctcgagtgggcgccggcctacgcgctgtccaccttcgagtccgacctggatcgcggcnatcaccatcgcagcctcgccatcccgcaagacatcagctacgccaagctcgccaacctgcggcccgtgctggactctactcgaggctcctgccgccacctgtgttcccccttatgggaactccagactgcggggggaaaaattgtttnnnnnttttttnnngggttgggnnnaaagggttggggggggagttgtgcccaaagggagcccccgtactttattggcccacccccttcgggcttggttttggggcggggaaaaaaaggacccccgcgggggaaaaagaggggccccccctgtgacccgggggggggccccccaaattcccccgtcctttaattgagagaggaatcttgtggtggccgcccccccttggggccccccgtgggtgggggggattctccccccggagggggcccccttttgtggggtgtttgaaagaaaaaaagggtttttggtggacccccgctccct

SEQ ID NO: 86163 - protein, 196 aa, Zea mays
  misc_feature: Ceres CLONE 1572586
  misc_feature (133)..(133): Xaa is any aa, unknown, or other
  misc_feature (134)..(134): Xaa is any aa, unknown, or other
  misc_feature (136)..(136): Xaa is any aa, unknown, or other
  misc_feature (137)..(137): Xaa is any aa, unknown, or other
  misc_feature (140)..(140): Xaa is any aa, unknown, or other
  misc_feature (141)..(141): Xaa is any aa, unknown, or other
MGGSADANGAGSVRVPVPPARPFLDTFHGNLKETFFPDDPFRGVVRERGAGRRTVAALRYFFRSSSGRRPTRCPPSSPTWIAAITIAASPSRKTSATPSSPTCGPCWTLLEAPAATCVPPYGNSRLRGEKLFXXFXXGWXXRVGGGVVPKGSPRTLLAHPLRAWFWGGEKKDPRGGKRGAPPVTRGGAPQIPPSFN

SEQ ID NO: 86164 - DNA, 1027 bp, Zea mays
  misc_feature: Ceres CLONE 1572589
ctggagctccccgcggtggcggccgctctagaactagtggatcccccgggctgcaggaattcgtctcacccctagaaaaatacactacatgaaaggtcgctcttcagctgaaactgaagtctgaaaccaccgcccagcgctcgcctgtttctgcggccgtcgatggagctccacctcgccaccatcgcccaccgcccgcctttgccggtaccggcgcggggccaccacctccgccgccgcctccaccacctcccggatcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgctgttcctcgcgccacgggcccgtcgaggctatgcccgcaggcggtggcagctccttctccaatcttcctctccacaatccccgggggctggtggcttggaccctctcccttgtcgggagcagggggccttacatcggggttcaaaaacgcccgtgggccatttcggggggctccccctttaacggcccgccttttttccggcctttccccaaaaaaaggtaaagcggggggcccatccgtcaatttgcctttcttccttcccggcgcggggttttgttttaaaaggggccccccgcgccaccgaaaacccccccccttatttcctaaaaagaggcttggggaacgcacccccttaggacctttccccaggggggtgacccctcaccagagcccttttttttcccccggctttgcccaaaaccaaggggagagggcgggggggggtgttctacccccacacataaaagcctccccgcggggggggggaaaaaacgcccccctcattcttgcgagaaaaatggggccccttgtggagaagacaatccccccctctggtgaaaatgg

SEQ ID NO: 86165 - DNA, 983 bp, Zea mays
  misc_feature: Ceres CLONE 1572591
  misc_feature: Translation starting site: 296
  misc_feature: SWISSPROT Homolog: EC 3.2.1.4 Cellulase
  misc_feature (974)..(974): n is a, c, t, g, unknown, or other
ctggagctccccgcggtggcggccgctctagaactagtggatcccccgggctgcaggaattcgtctcacccctagaaaaagcgccacacccacacccacaccgcaccaaccaaccccggccggccagccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccgggggccgccacatcaagccgctgccggtgccggggccgccgggggccatcgactccaagtacggcgacgcgctcggggtcgcgctccagttcttccaggtccagaaggcggggaagctggagaacaaccagatcccgtggcgtggggactcggcgttgaccgacgggaaggaagcggggctggatcttttccaagggaatgtatgatgctggggatcacatgaagttcaccttcccgatggcattcacggcgacggtgctctcgtggtcggtgctggagtaccgggatcagatgagcgcggcaaagcaactggaccctgccctcgatgcactgaagtggattacagatttccttattgctgcacatccctctgaccatgtgctgtatatccaagtccggtgatcctgatctggacacaaatggtggggaaaggccagaacatgaccgagaaagaactctcaccagattcacaggaagaccccccgatcagatgttgctgctaaggaacagcaccatgggagctgcttcaagggtctcaattccaagatcccacgttttctgtgggcctctcanctgctcaat

SEQ ID NO: 86166 - DNA, 887 bp, Zea mays
  misc_feature: Ceres CLONE 1572595
  misc_feature: SWISSPROT Homolog: EC 1.2.1.3 Aldehyde dehydrogenase (NAD(+))
  misc_feature (823)..(823): n is a, c, t, g, unknown, or other
tggagctccccgcggtggcggccgctctagaactagtggatcccccgggctgcaggaattcgtctcacccctagaaaaatctatccatcaccaccacctcctcctccttcccacgactcccgagcgctttctccgcctgcgtgtggcggcagcatggcgactgcgaacgggagcagcaaggggccgttcgaggtgcccaaggtggaggtcatggtcaccaagctcttcatcgacggctagttcgtcgacgccgtctcctgcaagacgttcgagacccgggaccctcgcacgggcgagttgatcgccagcatccccgagggaggtataggcaaactcaaactccccgtaaagccgcccctgaaggcctttaaaaaggggcctgggcccaggaaaaagggaaccaaaccgggtgggaaccccccaagtttccgggaccgttttaaaaaacccctttaaaaaattgggggcctcttaaacattggaaaacccggaaattttttcccccgggggaagagggggggaaaatcccgggggggccccccatatttgggtgggtattataaaggggggggcccaacaaagagggtggcgggggccccccctaaaaaaattggcccacaaaaatacgggggggccccccaaaaaaaaaaccggggggggggggggggaacaaaatttggcccgtaaaaaaaacccccccccaccatttttttttttataagaggaggcgccccccccccccagggggggccgccccctttttttatcaccaccccaacaaaaaaaaaaatggtttttgttttttttttttcttttcccctcntatagagggggggggggccccccccccccgcccaaatataaagtagggggggtagccgccccct

SEQ ID NO: 86167 - DNA, 958 bp, Zea mays
  misc_feature: Ceres CLONE 1572598
  misc_feature: Encodes the peptide sequence at SEQ ID NO. 86168
  misc_feature (868)..(868): n is a, c, t, g, unknown, or other
  misc_feature (946)..(946): n is a, c, t, g, unknown, or other
ctccccgcggtggcggccgctctagaactagtggatcccccgggctgcaggaattcgtctcacccctagaaaaaccctctccacttccgtttccggatcccgtttccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcgcatgcgagggcgtgcagatccagatccggtgggcgggaaggacttgatcgcccccaccaccatggccggcgcggtgtcggcgctcttcctgctggacatgaagggccgcgttctcgtctggcgcgactaccgcggcgatgtctccgcgctccaggccgagcgcttcttcaccaagctcctcgacaaggagggcgattcggaagtgcactcgcctgtggtctacgacgacgctggcgtcacttacatgttcttccagcacaacaatgtcttcctcctcagcgtcgctcgacagaactgtaacgcggccagcatcctcctcttcctccaccgtgtaatagatgtgtttaagcactacttcgacgagctggacgaggagtcgctcagagataacttcgtcgttgtgtatgagtagctcgacgagatgatggattttgggtaccacaatacacggaggcgaagatattgagcgagttcatcaagacagatgcgtcacggatggaggtcacacagcgtcctaccatggccgtgacaaatgctgtgtcatgcagaagccaggagatccgtacaagaagcatgaaatcttcctggatgcagctggaagtgtttacattctagttacagncatggccagattgtgaagacagatgtggtgggggcactgagatccaactctttgaatggaattgccgatgcaacttgncttgaatgaacg

SEQ ID NO: 86168 - protein, 136 aa, Zea mays
  misc_feature: Ceres CLONE 1572598
MRGRADPDPVGGKDLIAPTTMAGAVSALFLLDMKGRVLVWRDYRGDVSALQAERFFTKLLDKEGDSEVHSPVVYDDAGVTYMFFQHNNVFLLSVARQNCNAASILLFLHRVIDVFKHYFDELDEESLRDNFVVVYE

SEQ ID NO: 86169 - DNA, 983 bp, Zea mays
  misc_feature: Ceres CLONE 1572602
  misc_feature: Encodes the peptide sequence at SEQ ID NO. 86170
  misc_feature (696)..(696): n is a, c, t, g, unknown, or other
  misc_feature (924)..(924): n is a, c, t, g, unknown, or other
ctccccgcggtggcggccgctctagaactagtggatcccccgggctgcaggaattcgtctcacccctagaaaaagcctcgtgccctcctcctcctcctcctcccagatctcgtgaccattgccattccctccctccgctacacgccgagcgcccccgtccggaccaggcgtctccgcggctcctagtcctcgctccctccctctcccgtggaggactgccgcggggcggcgagggagaggagatccgtcggtgctggctgctggttggtcggctggtcaatccctttccatcgtttgctggtgcgtgagctcagggtttggacagtttggccccgtctgttgcggattggacccggactggattgggttcgtgtggctgccgcgtcggcgggtgctgattccagcttgtcccctcccccctagattgcgcgagacggtgcttcaggactgccccctggcgcggaggccgcacaggctcggcggcgccggcggcgagatgaagggcgcgaccatcccttcggtcgcgatcatgccctcgccgctcttcctctggcggtttaaggttgtgttgtttcttctatggggcttatgttgttgcaagataagttgggactcggttatgagaatgagtgttgatctcagagacttatttctttatgaggctttcttgtactataatcctcttcatcttgtggncttgatgatttggttgtgggggagtaaatctatgggtttttggcaccatcatctgtgaattatgcaaaaagtgtttgatcttcccacaacccatttttccccaccgagagatatggaggtgtggccacctgggctgaactttaattggcccctattagcatggacagcctacctatatccggtactccccatgggagaaatggtctcttgggagcatccccaccaagnttctctctggatggcaaatcctttgagagaaacccccctttccccctttggaatggtgc

SEQ ID NO: 86170 - protein, 85 aa, Zea mays
  misc_feature: Ceres CLONE 1572602
  misc_feature (67)..(67): Xaa is any aa, unknown, or other
MKGATIPSVAIMPSPLFLWRFKVVLFLLWGLCCCKISWDSVMRMSVDLRDLFLYEAFLYYNPLHLVXLMIWLWGSKSMGFWHHHL

SEQ ID NO: 86171 - DNA, 934 bp, Zea mays
  misc_feature: Ceres CLONE 1572603
  misc_feature: Encodes the peptide sequence at SEQ ID NO. 86172
  misc_feature (833)..(833): n is a, c, t, g, unknown, or other
  misc_feature (852)..(852): n is a, c, t, g, unknown, or other
tggagctccccgcggtggcggccgctctagaactagtggatcccccgggctgcaggaattcgtctcacccctagaaaaagctaccccctcgcctcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggccactcccaccgtcccacagcagcttcgcgtcggcttctcgcgccgccgcgcccagcgcgtcgtcgccatggctggatccggcaagttcttcgtcggaggcaactggaagtgcgtaagtgcatgttctgcttcttcagctttacgcggcttggagatgctgtgtaccgatgatcctggagatgctgtgtaactgtatcattttttggctgttgccgcattgggcattccaacgggacagggacgagatttttttgtcgtcatgcataccacggctccatcgaccatcgccacagtgttgcgccggcctcccctccttggttcctgccgtagtgcagcgctggccgccggcaccatacatatatcgtgatttactccgtacatggccacttctagaaatacaatcgcttctctgctgcccagcccagcttggtctgccagccagagccgttttgttcggtatataaaaagtgtgtctgtgtgtttttttggaaaggcaggtgtataaaagttgatattgcatcattcgccttttagaaacttttagctgagaaaccaggtatgccactagttcctgcctcctgagtatagagaggccntgttagcttcttgactctncttgctaagctttgagagactggccggagagagaagatgtaagtggtgcgtgtcgtgaactttgagtgtgggtgtttataga

SEQ ID NO: 86172 - protein, 88 aa, Zea mays
  misc_feature: Ceres CLONE 1572603
  misc_feature: SWISSPROT Homolog: EC 5.3.1.1 Triose-phosphate isomerase
MAAAPSSLVSSHLSRLADLRRAAAPATPTVPQQLRVGFSRRRAQRVVAMAGSGKFFVGGNWKCVSACSASSALRGLEMLCTDDPGDAV

SEQ ID NO: 86173 - DNA, 946 bp, Zea mays
  misc_feature: Ceres CLONE 1572604
  misc_feature: Encodes the peptide sequence at SEQ ID NO. 86174
  misc_feature (819)..(819): n is a, c, t, g, unknown, or other
  misc_feature (825)..(825): n is a, c, t, g, unknown, or other
  misc_feature (836)..(836): n is a, c, t, g, unknown, or other
tccccgcggtggcggccgctctagaactagtggatcccccgggctgcaggaattcgtctcacccctagaaaaaatgttgttccccaggcgcagcagcacggcagtcctccgttttctcctcgtcgctcgccccggttgtctcctcctcgacctcccccgtcgcaacaccgcccgatctctctagcgcacggcgggccggagaagaggaggaggggggggacgatctcattcatcggaccggcgtgcctgtgtcgtctgctgttttcgtttttttctttactctttttttttcctcctttgcttgttcaattcaatcagtatattaagatttctgatttgggggcggctcgccatgggattcggaatggggaataataacaacggggcgagctcctcgtcgtcgcggctggaccccgcggcgccgctgctgccgcgccacggcagcagcgggggccgcgagggtggtggcctgtcgtcgcagcccaagacgttcgccaacgtcttcatcgcggtggtcggcgccggcgtgctggggctgccgtacaccttctcgcgcaccgggtgggcggcggggtcgctgctgctcttctccgtcgccgcgctcaccttctactgcatgatgctgctcgttgcgtgccgccgccgcctcgccgacgagcaccctaagatcgcctcgttcggggacctgggggacgccgtgttcggcgcgcacgggcggtttcgcgtggacgtgatgctggtgctcagccaattcagcttctgcgtcggctacctcatcttcatctccaacacatgggggcacctctatccgattaccgncgcggngtgtctaatcnttcggggctcctctcccccaaggggctcgtcttcttgggcgatgctgcctttccagctcgggctcaactccattcagaccctggaccctgcttgcgccgcctcacatttt

SEQ ID NO: 86174 - protein, 198 aa, Zea mays
  misc_feature: Ceres CLONE 1572604
  misc_feature (156)..(156): Xaa is any aa, unknown, or other
  misc_feature (158)..(158): Xaa is any aa, unknown, or other
  misc_feature (162)..(162): Xaa is any aa, unknown, or other
MGFGMGNNNNGASSSSSRLDPAAPLLPRHGSSGGREGGGLSSQPKTFANVFIAVVGAGVLGLPYTFSRTGWAAGSLLLFSVAALTFYCMMLLVACRRRLADEHPKIASFGDLGDAVFGAHGRFRVDVMLVLSQFSFCVGYLIFISNTWGHLYPITXAXCLIXRGSSPPRGSSSWAMLPFQLGLNSIQTLDPACAASHF

SEQ ID NO: 86175 - DNA, 966 bp, Zea mays
  misc_feature: Ceres CLONE 1572605
  misc_feature: Encodes the peptide sequence at SEQ ID NO. 86176
  misc_feature (793)..(793): n is a, c, t, g, unknown, or other
  misc_feature (795)..(795): n is a, c, t, g, unknown, or other
  misc_feature (796)..(796): n is a, c, t, g, unknown, or other
  misc_feature (808)..(808): n is a, c, t, g, unknown, or other
atagctggagctccccgcggtggcggccgctctagaactagtggatcccccgggctgcaggaattcgtctcacccctagaaaaactcttcctcggcgacctccacgccggtctagagccggcagcgctgcggcggagcaccaaccgagctccgatcccaccccgctcccaaccgcgcagccctgtccatggcgcgcgcggtgcggcggcgagcccccatgcattcccgccgccggagcgcggcctgctaagcgacgaccattcctctccgcgcgcccacctccctctctccctctcctaaatccactcccccacgtgtcttcatgggccctccgtcctacaccgcctccccctgcacggggtctgccctcttctccaacacccgagcgccgccgccgccaccgcggcttcttatcagatggggcccggggccgccgtcggccgtggggaggcacggaggccgcgtagctccgtcgcaggagaggcgcggccccgccccgtcgcaggagaggcgccgacccgccccgtctcaggagaggcgccgacccgctccgtctcaggagaggcgccgcccctcggagtcttcgtcccagtctcaccagctccaggaacggaagcggcactggaaggcgggggagttcccggggaccgctgccgatggaggaagtggcggcggaaggcgccccgcactagggaaccggcattcgaaggccggggagtttcccgggacggacggcgtccgcgccgcccccgcgccgccgcatgtgaagcggcactggaaggccggcgagttncnnggggcgcgcggncgcccccggttcggggacgccgaggactcccctcaagaacgtcaagaagcggctggacgcccgcgcggacgctaggcgtgggcgtgcaccgtcaccgaggccctcgcggacgcgtcagctccaagactggcagaagcgcttcaggtctttggatgcta

SEQ ID NO: 86176 - protein, 186 aa, Zea mays
  misc_feature: Ceres CLONE 1572605
  misc_feature (157)..(157): Xaa is any aa, unknown, or other
  misc_feature (158)..(158): Xaa is any aa, unknown, or other
MGPPSYTASPCTGSALFSNTRAPPPPPRLLIRWGPGPPSAVGRHGGRVAPSQERRGPAPSQERRRPAPSQERRRPAPSQERRRPSESSSQSHQLQERKRHWKAGEFPGTAADGGSGGGRRPALGNRHSKAGEFPGTDGVRAAPAPPHVKRHWKAGEXXGARGRPRFGDAEDSPQERQEAAGRPRGR

SEQ ID NO: 86177 - DNA, 824 bp, Zea mays
  misc_feature: Ceres CLONE 1572610
  misc_feature: Encodes the peptide sequence at SEQ ID NO. 86178
  misc_feature (657)..(657): n is a, c, t, g, unknown, or other
acccgcggtggcggccgctctagaactagtggatcccccgggctgcaggaattcgtctcacccctagaaaaactctcttttcccctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaggtatccaacattcgttgatgctcttcgtgacttggatgactgccttacaatggtgcatctgtttgcggcattacctgctgttgacggtgaacgtgttgaggtcaaacgaatccataactgccgcaggttaagccatgaatgggcagcatacatatcccgaacccattctctngagaagacattatttccgtgaagggcatatatatcaggctgaagtcaaggacaaaagatcacctggctaactcgcatgctcttcagcaagtataaaggatgatgttgattccaatgggatgctttcttttctaaaatctatgaaaccctctaggattgtggacttca

SEQ ID NO: 86178 - protein, 183 aa, Zea mays
  misc_feature: Ceres CLONE 1572610
  misc_feature (8)..(184): Pfam Name: Pescadillo_N Pfam Description: Pescadillo N-terminus
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWAAYISRTHSLEKTLFP

SEQ ID NO: 86179 - DNA, 905 bp, Zea mays
  misc_feature: Ceres CLONE 1572612
  misc_feature (374)..(374): n is a, c, t, g, unknown, or other
acccgcggtggcggccgctctagaactagtggatcccccgggctgcaggaattcgtctcacccctagaaaaattgtacacaccgcccgtcgctcctaccgattgaatggtccggtgaagtgttcggatcgcggcgtacgggggcggttcgccgcccccgacgtcgcgagaagtccattgaaccttatcatttagaggaaggagaagtcgtaacaaggtttccgtaggtgaacctgcggaaggatcattgaagaacaactcccagttcgctacgcgctcaccgaacctgacgttcaggacccacaagctggtgacacattaacccaccaaatagcgtcacccaccactgttcgtcgtccgcaaaccaataatttnggggagaaaattcccaattacggcgggcaaagagagtgatagagaggaaatattttttctctctctctccaatttttcacccccaattctgactcgccagcggcgccaccatctcgccggaatcctagtcgaggtgttggtagcgtcgggccgtggtcgggagcccgcttgtcgcggcgagctcgaccgccgcggatcgctggagcccgtgggcggcggcggcggaagctatggtttgctgctctacccggagcagctagcgggccagatcgtccggccggcggggctgcatatattttgtgcctttcgccggcgagatatcgatgcagccgccggtcaaagaagttcggccgcgtgtacacggtccagctcaaagcccatatcgtggagggactggggccccatggcgccgaactctactttcgcagcctcaccaagttcctgggctgccacctccggagggaccaattcctaaagcctgccccgccgccattggggaagggagaaaatcagggtgccacaattcctttt

SEQ ID NO: 86180 - DNA, 946 bp, Zea mays
  misc_feature: Ceres CLONE 1572614
  misc_feature: Encodes the peptide sequence at SEQ ID NO. 86181
ctccccgcggtggcggccgctctagaactagtggatcccccgggctgcaggaattcgtctcacccctagaaaaagacccgacctgtcctcgcctcacttcactagagagatcccaacagttcgctgccgtcgcctactcgcctccgccagaccgccgccgcgacactacacaccagcgcccccgcagaaggagcaaggggggagaaggaaagcggcacccgccgcacatacgccgcgcggcggagccatggccgagctgcggcacgccacggcggcggcggcggcgacgcgcgccactggctccccttccaagcgcgacgccgaggccgcgtcctcgcccttggtcgcgtctccccgcgtcggcggcggcaaggacgggctccgcccccaccagaggtggccgctcccgccccccgtccgcgccctcctcgcgtgcgaggaccccaggtcccccaccgcctccgcctcctaccggatcctggtcgcggccatcgcctgcttcgccctcgctgcgctcttctccgcgccttccctctgggcacgcctcaacgcgccgtacctgtgccgcaaggaggggattcggctccactgccccagggtcagccagccagactctctgtgggagaatcctcatgcagcagcaacttcgtggaagccgtgtgctgagcgtcagagacatgaggtctcagaccttgtgtcagagaagaaacttctggggttatattattcacgctgagggtggataaaccagccacgtatagctatatgtaatgctgttgcattgctaagataatgatgctacacttattctgcggtgctaaagcagacaaatatggaagatcaaacgaattcgaggactctttgatgagaccatttataatatttgaagaggatggcgcatggtcgtgaattcctgacgggttacgaaaagatgacctttcactat

SEQ ID NO: 86181 - protein, 162 aa, Zea mays
  misc_feature: Ceres CLONE 1572614
MAELRHATAAAAATRATGSPSKRDAEAASSPLVASPRVGGGKDGLRPHQRWPLPPPVRALLACEDPRSPTASASYRILVAAIACFALAALFSAPSLWARLNAPYLCRKEGIRLHCPRVSQPDSLWENPHAAATSWKPCAERQRHEVSDLVSEKKLLGLYYSR

SEQ ID NO: 86182 - DNA, 932 bp, Zea mays
  misc_feature: Ceres CLONE 1572615
acccgcggtggcggccgctctagaactagtggatcccccgggctgcaggaattcgtctcacccctagaaaaagccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcattttttttaactgtcaaggataagcaagtgacctctgtgtgcataccaccaccaccatacgtagcatacacaggcacagatggcagagcataaagggaacgttctccttgcacaagtatgagatggggaaattgcctggccatgcacctttgccaaggtttacatgctcgtaaaacgcgactccggaaagtgccgcgatcaagtgattgatacgagaagttatgaaagtggtctcattgatcaaatccgcgagaaattctgtgatgaagcctagtagcatcaaacaccgacagctctatgagtcatggccccaaaccaaatatcttgtgctggacatgtaaaagag

SEQ ID NO: 86183 - DNA, 952 bp, Zea mays
  misc_feature: Ceres CLONE 1572619
  misc_feature: Encodes the peptide sequence at SEQ ID NO. 86184
ctccccgcggtggcggccgctctagaactagtggatcccccgggctgcaggaattcgtctcacccctagaaaaagctgaatcagcagcagcaactctctccctctccgttcttggtggtccgagacccttggccgtacgctctgcctcactcctccgtctcttgcttcccttgccgccggcggcgcgcggcgccgggcgcggatcggcggcgggtgcatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccatgcagcagtagcggaaggtgatggagcgggagctgctgtaacacatgccggcgccgctggcggtggcggacgatgcatggaggacttcttcgactgcctcctcggcttgctcggcgcgttaggcatgacatgggctgcggcgcggccccagcggcagccgcgcccgccgctgcctcgcgtggctgcgggggcggggcctgctccaactgactcccggcgtttcgcggcggatctcatggtcacccccggcccgatcggcggcaatggcgccctgcgccctcacgtcactgtacacgctgcagggcaaaaaggccgtcgaacagggatgctatgatcctccgggaaaaactccggtccagagatgataccacctttttgtggggtggttgaacgccatggaccttattgccatttgggtggccaaaagataaaaaatccgctgcccccaaagtttggaaaaaggttgccaacggaagaggggaaatataaccccactggccacttaagcccaaacccgcggaggttgcttccccgaacccctagaacaaagtaattccggccttctcctcttaaacccccaaaatggggaggttccct

SEQ ID NO: 86184 - protein, 228 aa, Zea mays
  misc_feature: Ceres CLONE 1572619
PRGGGRSRTSGSPGLQEFVSPLEKAESAAATLSLSVLGGPRPLAVRSASLLRLLLPLPPAARGAGRGSAAGAWWRPPPGAGQAPAVGGLAAAEGSTGTWSRSPSPRASPWSPPGPWVHAAVAEGDGAGAAVTHAGAAGGGGRCMEDFFDCLLGLLGALGMTWAAARPQRQPRPPLPRVAAGAGPAPTDSRRFAADLMVTPGPIGGNGALRPHVTVHAAGQKGRRTGML

SEQ ID NO: 86185 - DNA, 942 bp, Zea mays
  misc_feature: Ceres CLONE 1572620
  misc_feature: Encodes the peptide sequence at SEQ ID NO. 86186
ctccccgcggtggcggccgctctagaactagtggatcccccgggctgcaggaattcgtctcacccctagaaaaaactgccagatctcctctcctctccactgaggactctgaccagtgggactaggatattccttcttcttcacccacgactccgccttcctagttcttgggcggccggtgaggacgaacacggactcgcgctctcgctcgcgccatcggaggaaaggagatccactcggagcatgcgggccgccgcgcggtagatgaaactgaggaacacggcaataacacgagcaaattcagcttgtcttcccatgggggatcgtgttggttgtcagtacaacagcatccatgaggctgaagagcataagggaggggcttggcatccccaaaggttccatgataccccctcatattcctcaaattttatgaaattttcaaggggggcccctttggaaattaaaggaaaagggtcaaaggctgcggggccccccaccgggaaatttttgggggttttcttttcggtttggcccccctttgggggggtttccaaaaagccttaaatcccggccggaaggggggccactttgttccccccaaaaaagggggtgttttttttttcgggggtttttctcccccctgtgggccccctcgggggggttttcccacaggtgggggggaaaatgggcccccccggggtcaaaaaaaaaaagccccccccccccccccccttttttggaggaaaattaaaaaaaccagggtgggccccccctctggggggggggggcccccacaaaaactaaaggggggttgtttttcccccaggggggggtgcttaaatataaaaaaaacaaggggggggggtgttttttgggggggggggggggggccgcccctctgtggggggggtccccccctcccccccccctcgctagaggaag

SEQ ID NO: 86186 - protein, 99 aa, Zea mays
  misc_feature: Ceres CLONE 1572620
MKLRNTAITRANSACLPMGDRVGCQYNSIHEAEEHKGGAWHPQRFHDTPSYSSNFMKFSRGAPLEIKGKGSKAAGPPTGKFLGVFFSVWPPFGGVSKKP

SEQ ID NO: 86187 - DNA, 856 bp, Zea mays
  misc_feature: Ceres CLONE 1572623
  misc_feature (783)..(783): n is a, c, t, g, unknown, or other
  misc_feature (809)..(809): n is a, c, t, g, unknown, or other
  misc_feature (815)..(815): n is a, c, t, g, unknown, or other
ctggagctccccgcggtggcggccgctctagaactagtggatcccccgggctgcaggaattcgtctcacccctagaaaaaggccttgcctctgcccctcgccctcgcctcgcctccaggatcttgtcctcccccatctcctcgggccaaggaatcgttctcatccggcgacctacctccgttacgtctcgggtcttgttctgtatcacaagcaaagcaaaggatcggaggctactccattcggcagcaagctgactctgaagtctgaacgttggagtagaacaaggtgcttgttcaaaattgttagttgcatggagatgggaatgactcctgaagtaatgtatggacaaaatgttttcagttcctggctactgcaaatccccgtaccaatatgggctattacacgaagcttgggatccccccattggaaatgggattagggggccccaaaccttttcgggaatggctaaccaaaaaaaatttttcttttttcgggtaaaaaaggaagtaaatgggctaaaaattttggaaaccccccaaaaaaagggggttttttttcccccacaccccccacaatttttttttttcccccaaaaaaaattttttttttttttccccccccaagggggggcctttttttttttcccccccccaaaaaatttttttttttttaacccccctttttgttcctctccccccggggaaaaaaaaaaaaggggggcgggcccccccccccccaaaatttttttttcgccgcgggggggggtttctttcttcttttttnaaataaaaaaaaaaaaaaaattattntttttncccgcagaagaggaaaaaaaaccaccctccctccccccccc

SEQ ID NO: 86188 - DNA, 875 bp, Zea mays
  misc_feature: Ceres CLONE 1572624
ctccccgcggtggcggccgctctagaactagtggatcccccgggctgcaggaattcgtctcacccctagaaataaagtaccgcaccaccgccaagctgcgcaaccggagccggagccagaggagggcgagaggccgaggggataggagcgataggaggccgccgaccgaccgtgcgtccggccccgcggcggcgtctgcaggtcttacacggcagacgaggagctatctgcagcacgaggcggccgggcccgggccacgccttgccggataaggaggcgctggccgccgcgttctgcggcgaggcggtgatctccgagttctagtccctcacgcgggtctccgccgccttgcagcttgtcacgctgcgccggatcctggcagacaacgcctgcgcctagtacctccgctgccggggtctctcgggcctctccgacgccgccatcttccgagcctgcgtgcctctctccacgcacgccgacatccaggcctaccttgcgcgtatcgccgacagtgacacgtcccccgtgctctccggcaagcccatcacctccatctccctcagctcctgctcgacgcaaggcgaactcttgtgcctgggcttccaccatgaactcgtcgggtcctgaacgcagatatgccggacttcctactccctctggtgctgtgcgttccccctggatgacggcttagcgctgcagttagctactgctgccggaagttcacaccaagggcctgctgacggcgactctgatgcctacaggctgtgctctgcgtggatgtcatgcttgcgatgcgctcctatcactctaaggtgtggaccgcgcgagtcggcgatctttcagcagctaacttcgcgcgtactctctgctttcct

SEQ ID NO: 86189 - DNA, 932 bp, Zea mays
  misc_feature: Ceres CLONE 1572625
  misc_feature: Encodes the peptide sequence at SEQ ID NO. 86190
  misc_feature (827)..(827): n is a, c, t, g, unknown, or other
  misc_feature (828)..(828): n is a, c, t, g, unknown, or other
ctccccgcggtggcggccgctctagaactagtggatcccccgggctgcaggaattcgtctcacccctagaaaaaactcctctccccgagtcctctcctctccggggtattgaattcgaaccaaaaaatcaaaacaactcagcgattcgattcgcggcgagtcaagcgggatgccgccgcgcacggctccggcggcgacctcaaccccgccgcggaaggtgcccctccggaagctgctgcgtgcggcgtcggtcgcctgcggggtgcagttcggctgggcgctgcagctgtcgttgctgaccccgtacgtgcaggagctgggcatcccgcacgcctttgccagtctcgtctggctgtgcggtccgctgtccggcctcctcgtccagcccctcgtcggccacctctccgaccgcatcggccccgccgcttcgccgctcgggcgccgcaggcccttcatcgccgccggcgccgcgtgcatcgccgcagccgtgctcaccgtcggcttctccgctgacctcggccgactcttcggcgacgacgtcaccccgggctcaacgcgcctcggcgccatctgcgtctaccttgtaggattctggctgctcgacgtgggcaacaacggcacgcaggggccctgcagggcgttcctcgccgacctcacagagaatgacccaaggaggactcggatcgctaatgcatacttttcactcttcatggccctgggaaacatacttggatatgccaccggagcatacagtggatgggtatcgatatttcctttcactgttacagagtcctgcggcatcagttgtgccaaccttaagtctgccnnttctcctgaacattatgttctggtcatcacaacgtacactactgttacatccgtgcaagaactccaacttttgggagtgatgaagcacaaaatccaggtgctga

SEQ ID NO: 86190 - protein, 254 aa, Zea mays
  misc_feature: Ceres CLONE 1572625
  misc_feature (220)..(220): Xaa is any aa, unknown, or other
MPPRTAPAATSTPPRKVPLRKLLRAASVACGVQFGWALQLSLLTPYVQELGIPHAFASLVWLCGPLSGLLVQPLVGHLSDRIGPAASPLGRRRPFIAAGAACIAAAVLTVGFSADLGRLFGDDVTPGSTRLGAICVYLVGFWLLDVGNNGTQGPCRAFLADLTENDPRRTRIANAYFSLFMALGNILGYATGAYSGWVSIFPFTVTESCGISCANLKSAXSPEHYVLVITTYTTVTSVQELQLLGVMKHKIQVL

SEQ ID NO: 86191 - DNA, 943 bp, Zea mays
  misc_feature: Ceres CLONE 1572627
  misc_feature: Translation starting site: 118
  misc_feature: SWISSPROT Homolog: EC 1.1.1.86 Ketol-acid reductoisomerase
acccgcggtggcggccgctctagaactagtggatcccccgggctgcaggaattcgtctcacccctagaaaaactctttccagccacctcactcttcactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgcggagggatctgttcccgctgttaccggaggccttcaagggaatcaaacagatcggtgtaatcggctggggctcgcagggtcctgcacaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgatatctgattctgctcaggctgataactacgagaaaattttctcgcacatgaaaccaaacaggattcttgggttggcacatggatttctccttggacatttgcaaactctggggtttggaattccctaaaaacatcagggtggttgctgtatggccccaaggaatgggcccattcaggcaaaaaaatttcttgtcagggcaaaaaaaccaagggtgcgggaaccaaagccaactttgccgttcccaggatattttaaggaaaggccacacattggagca

SEQ ID NO: 86192 - DNA, 1120 bp, Zea mays
  misc_feature: Ceres CLONE 1572630
ctccccgcggtggcggccgctctagaactagtggatcccccgggctgcaggaattcgtctcacccctagaaaaatgattttctgggtgaatttttcccggcctccgctccggccagatcggcgcgggtgaaccccggcccctaccgatccggatccgtccccatcgcctcgtgtgttttccgtcgagtattttagcgtgtgtgtctccccttcttcgcttcggttggtgcgtgcggctgtctcgggtagatctggtggtttagttcgccttgaaggcgcgcggcggcggtgtcgcggcttgtagcttgcgatttcacggtggagcttgtcggctgttggggtcggatttggtgcgtggctgcttcggcgctaggcgatccttgtgctgttccccccggatattttgtcgttgaatagataggtgaaatttgctggaaacatttgcttaccgtggtgggggactgttaaagaatctgttcacggctcgtgccaggcttgtgtctcaatttccccccgatgggttccggggctgatactctttaaaatgaacccccatagcttgttagtgacctctttttattcataattggtttccccgataccctgttatgctcacctcctcctcatgggtgacctcggccttgatcgctttgctgttctgtgtttgtttttatccctgtttttgtatggcctcctcgctattgcttggctgatcatttacctttgctaataatcattttctgtcccggctaactgaagacacatctcttcggcctttttccgcttttattggtggaactatatgctacgacactctctgtatgtcgtttgtgttctcacgtccgtctcatcacgttctgtgtgtgttagtttacctctcctatatacaccaattatgctcgctaatcctcttctgtagggtgactatacttcagtgtggtatgtgtgatctcgcttatcttgcgtggcctcattggtgttctacgccacctgctgattgtgctttaggtccgtcaccgtgaccttcagtcctctctacggttacatctcttgttacctcatgcgctctcgtggccgacggttcctgttgttatgctcgcgttgcgttctatttgttccc

SEQ ID NO: 86193 - DNA, 942 bp, Zea mays
  misc_feature: Ceres CLONE 1572632
  misc_feature: Encodes the peptide sequence at SEQ ID NO. 86194
acccgcggtggcggccgctctcttacttgtggatgcgccgggctgcatgatttcgtgtcacacctataaagaatgtgtctcttctagtcgactcgccttggtgttcacgccgtcgctagctcctggcgcggcgaatcttctgtcctccccggtggctgggtgcggtcgtcgtcggcgaggaagatggctggcggcttcatggtactgcatctggtcaggccttttctaggctttcgtgtcataggtgcagagcgacgattggacgataccgttgagagaaagaagttatatacaccgtcatttccctcttcattttcccggtctgcctccagctcccactctatggcattcattataccactggagctgatcctttctgctggatgcgtgttatcctcgcaccaatccgtgacactgtgaacgagctccttattactccgattgtgacatctgggatggacatgcaacttcttgatacatcgaacatcattgaacttgacaactatgtgagagaggatcgcgctctggtgaatggtgcacaagagctgcttggtatcctgattcgctattcggcgagctcgtggatatgtcccgtctagaatctatgataatgtcatccagcttgaaacaccgaatgctatcctctctatgactcagcttttactggctcgcatcattgtcatactgtctgcatcgacttctccagagaggcttatggatttggatctggcatttctctggtacatgctacgatatgtgcgacatatcatctggtaggtatttagccctagacagtaagaatggtcttggtgctcatttgcacgagctatcatggactggttatccgttgatacgagaacgttcagtccgtgctctcggatgatttatacaccagatcttccattgtatcattttgctgcacagcttggtcttctcatacat

SEQ ID NO: 86194 - protein, 71 aa, Zea mays
  misc_feature: Ceres CLONE 1572632
MRVILAPIRDTVNELLITPIVTSGMDMQLLDTSNIIELDNYVREDRALVNGAQELLGILIRYSASSWICPV

SEQ ID NO: 86195 - DNA, 962 bp, Zea mays
  misc_feature: Ceres CLONE 1572633
  misc_feature: Encodes the peptide sequence at SEQ ID NO. 86196
  misc_feature (594)..(594): n is a, c, t, g, unknown, or other
ctccccgcggtggcggccgctctagaactagtggatcccccgggctgcaggaattcgtctcacccctagaaaaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaaggaggggagaagatgtagttcacccacttaaagtttctctggaagatctttacaatggcacctcaaagaagctctctctttcgcgcaatgtcatctgctccaagtgcaagggcaagggctcgaagtctggtgcctcaatgaggtgccctggttgccagggctcaggcatgaaagtcactattcgtcagctgggcccttccatgatacagcagatgcagcagccttgcaatgagtgcaaggggactggagagagcatcaatganaaggaccgctgtccagggttgcaagggtgaagatgtcattcaagaagaaaaagttccttgaggtcatggttgaaatgggatgccacccacccgaaaatccccctcccctggtaaactaaataaaccccggacctggccctggaaacgtgtattccccccccacgagagggcccccccaattaaaaaaagaggggaaaatcctttttagaaaacccttttccctaacaaaaaaattggggtcccatttttctttacaatttggaaaagggggtttcttcaaataaaccgggggggttttttaccccccacttcggggtttttgtgggggggcgcctttcccacgctctttaggagagaccctccccttc

SEQ ID NO: 86196 - protein, 131 aa, Zea mays
  misc_feature: Ceres CLONE 1572633
  misc_feature (54)..(127): Pfam Name: DnaJ_CXXCXGXG Pfam Description: DnaJ central domain (4 repeats)
  misc_feature (122)..(122): Xaa is any aa, unknown, or other
MGGGGSHVDPFDIFSSFFGPSFGGGGGSSRGRRQRRGEDVVHPLKVSLEDLYNGTSKKLSLSRNVICSKCKGKGSKSGASMRCPGCQGSGMKVTIRQLGPSMIQQMQQPCNECKGTGESINXKDRCPGLQG

SEQ ID NO: 86197 - DNA, 889 bp, Zea mays
  misc_feature: Ceres CLONE 1572634
  misc_feature: Encodes the peptide sequence at SEQ ID NO. 86198
  misc_feature (235)..(235): n is a, c, t, g, unknown, or other
ctccccgcggtggcggccgctctagaactagtggatcccccgggctgcaggaattcgtctcacccctagaaaaaaatctctctcttctcctcgcctcgccttggtgttcacgccgtcgctagcgcctgccgcggcgaagcttctgtcctccccggcgccgggctcgggtcgtcgtcggccaggaagatggctggcggcttcagggtactgcatctgagtcagggccttttctggnctttcttgccagaggtgcagagcgcggtaggaaataccttcagagaaaagtatatacctgttatttcctctcattttcctgtctgcagcagctccactctatgcattcattcaacactggagctgatccttctactggatgcgtgttatcctcgcatcaaaccgtgcactgtgaatggagttgggtattacttccattttggacttctgggatggtgatggcaactttcttggttgattccaaaaaccctggaagtttgacaacccgttggaaaaaaggaaccgggcccctccctcaaaggggggcccaaaaaagtgggcttggggaaccccccaattgtctatttgggggaaaaacctgtgggaaaatttttccccctccccggaaaaatttttggcccggttttaaccccaaccttggggaaaaaggggaagagctctccccccccctttattatcttcacctttttttttttggggggggaacatttttggacccccgggggggggggaaaaacctctcccccaaaaaaaaatattggggcggggagaaaatgggaattttctctttttgtgtgttggtcccccaaaattggggggaaaaaattaatttttggagggagggttttttctcccccccccccacatcaaaggg

SEQ ID NO: 86198 - protein, 88 aa, Zea mays
  misc_feature: Ceres CLONE 1572634
  misc_feature (17)..(17): Xaa is any aa, unknown, or other
MAGGFRVLHLSQGLFWXFLPEVQSAVGNTFREKYIPVISSHFPVCSSSTLCIHSTLELILLLDACYPRIKPCTVNGVGYYFHFGLLGW

SEQ ID NO: 86199 - DNA, 961 bp, Zea mays
  misc_feature: Ceres CLONE 1572635
  misc_feature: Encodes the peptide sequence at SEQ ID NO. 86200
  misc_feature (850)..(850): n is a, c, t, g, unknown, or other
  misc_feature (933)..(933): n is a, c, t, g, unknown, or other
ctggagctccccgcggtggcggccgctctagaactagtggatcccccgggctgcaggaattcgtctcacccctagaaaaacttatccgcttgacgctccccactgcgcctaaaaatggccgcgtcccactgaaccaaccgtctgcacatcctcctcctgttgccgctcgctcgccgtgccgcaatggctacggccgtcgcctcccatacgttgctctcctccgccttcgccccgcgccactaccaccgccgcctgacccggaccgcgtccgtggggccgcgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgagaagacatggtatgttgttgatgcaacagacaagatcctaggcaggctagcatccaccattgcagtacatatcaggggaaagaatgaacccacttacactcctagtgtagacatgggagcttttgttattgtggtcaatgcagataaggttgctgtttctggtaaaaagcggtcacaaaagctttataggaggcactccggaaggcctggagggatgatagaagaaacagacaccagacgcagtcggctgccgcagactggtagtagccggcgcgccgtcaccgtatcctcagatcagcggcgagcagaaacacaccactctactgacgcccgacgagcagtgtaacatttttcctgcagccatggggtaaggagaagactcacatcancattgtggtcattggccatgtcgactctggcaagtcgaccacacctgggcacctgatctacaagcttggaagtattgacagcnaagtgattgagaggttccagaaaaaggc

SEQ ID NO: 86200 - protein, 207 aa, Zea mays
  misc_feature: Ceres CLONE 1572635
  misc_feature (96)..(192): Pfam Name: Ribosomal_L13 Pfam Description: Ribosomal protein L13
MATAVASHTLLSSAFAPRHYHRRLTRTASVGPRRAAPVGLAVRCEKSDKQKRQPLAALVPREQRFMFEGDELCGPDIWNTTWYPKAADHVTTEKTWYVVDATDKILGRLASTIAVHIRGKNEPTYTPSVDMGAFVIVVNADKVAVSGKKRSQKLYRRHSGRPGGMIEETDTRRSRLPQTGSSRRAVTVSSDQRRAETHHSTDARRAV

SEQ ID NO: 86201 - DNA, 891 bp, Zea mays
  misc_feature: Ceres CLONE 1572636
  misc_feature: Encodes the peptide sequence at SEQ ID NO. 86202
  misc_feature (648)..(648): n is a, c, t, g, unknown, or other
ctccccgcggtggcggccgctctagaactagtggatcccccgggctgcaggaattcgtctcacccctagaaaaaagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacatactatccgtcagacgctctcaagcataatggactctttgtatgctcatgtgtacttcgcccgttcgggatatcccgtggaccctacggatcccgaatatgagcagaaatcttcgtcttgggagaaccatcccggtgtgggcattctggnaaaatcaaaaccggtaaaaaaaaaaactgcttgaaaatccgaagaaccggaaggaaaagaccccgccataagggagataaaaaaccggaggttaaaaacaagggcccaccgaaattttctttttttggaaaccaaaggaaacaaaaatcgggtgaaaattccacggggttccccaattagggccccccccgtggtgcccaattttaaatggggaccccttccgggaaatttctccccaggttt

SEQ ID NO: 86202 - protein, 147 aa, Zea mays
  misc_feature: Ceres CLONE 1572636
MSQPAATVAAAAQPQGRGPAGRQGGLGQSIAGIVRMAVFWYFASKFFGPKRPPADPGMLMSNLFQKGEPMDMWMYLSENEKFNDFANEDALIWHEANIPYAVWGPTSTRTRSLTYYPSDALKHNGLFVCSCVLRPFGISRGPYGSRI

SEQ ID NO: 86203 - DNA, 932 bp, Zea mays
  misc_feature: Ceres CLONE 1572637
  misc_feature: Encodes the peptide sequence at SEQ ID NO. 86204
ctccccgcggtggcggccgctctagaactagtggatcccccgggctgcaggaattcgtctcacccctagaaaaaaaccttcttcttcatcttctccagtcctccctcccgccccgtccatcgacacagcagcttgcttgtcaccaagctagccaagcaggaggagtaagagtacagccagagagagagagagagagagcaccaccctgattccacccaccgctgtcccttgcttatttacaggcgttcgtgatcaccaacagctactcgtcagctagagagagtgcaacgggccgggcagagctagagagagagagagagaaagcggccttctttttctgtgttcaccaagcaacaaccccagtccaagctctccgtgttggccgatcgtttccggcaaacagagcaagcaactcacagccccggaggcgactgactgactggcgcaactgtgttgctcgatccatcgaagcagacgcaggcggcggattcgcggaggagagatgatgagggagcagagcctcctggaggcgacgtgcggcgacctcttcgaccacatcgacgacctgctcgacttccccaatgaggactcggccgccgacgtgctcctgctggacgcgccggcgcctgtgagcccgctgtcgtcggcgcgcatcatcgacgtctgccgcgccggcagtgcgtccgctccaccgcgctggcgccgtcgcttcccgcgcagcaagacacaacagcctcttctccacagctgggtccgacgtgttcgacccccgggacgtcagcgctcaccttggctcgtgcgacgacattgacatggacatggcccacctggagtggctgtcgtggctcttccaaaacacatccatcccgcaggagcggcgtttcccggcgcgcggccatcttcatgagtctcccgctgcgggcggcccgctc

SEQ ID NO: 86204 - protein, 102 aa, Zea mays
  misc_feature: Ceres CLONE 1572637
MMREQSLLEATCGDLFDHIDDLLDFPNEDSAADVLLLDAPAPVSPLSSARIIDVCRAGSASAPPRWRRRFPRSKTQQPLLHSWVRRVRPPGRQRSPWLVRRH

SEQ ID NO: 86205 - DNA, 949 bp, Zea mays
  misc_feature: Ceres CLONE 1572641
  misc_feature: Encodes the peptide sequence at SEQ ID NO. 86206
  misc_feature (808)..(808): n is a, c, t, g, unknown, or other
  misc_feature (813)..(813): n is a, c, t, g, unknown, or other
  misc_feature (854)..(854): n is a, c, t, g, unknown, or other
  misc_feature (866)..(866): n is a, c, t, g, unknown, or other
ctggagctccccgcggtggcggccgctctagaactagtggatcccccgggctgcaggaattcgtctcacccctagaaaaaatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcggcgatctgttactacggtggcccgtggggaacaagttcggctcctgtcgtcacgcgaccgcggtccactcgcaggggcagtgaccgtgctgctgccggcgactgcgacggcgaggatcctggggtcgcggcatggcgagcgagagatctcgacgaggcatctcgtcgctgttcctgttcccactggcacgctaccgagagactttnaggcngggcgtcgcccctgcgacatgatggtgcgagcgcggcgacnttccgtacgtcnagcggcgaatgacgccggcatgtggacagcaacgcgtggccacgacccgacctgcgggggtcaaggccgctggacgtgcttcc

SEQ ID NO: 86206 - protein, 235 aa, Zea mays
  misc_feature: Ceres CLONE 1572641
  misc_feature: SWISSPROT Homolog: EC 3.2.2.22 rRNA N-glycosylase
  misc_feature (213)..(213): Xaa is any aa, unknown, or other
  misc_feature (215)..(215): Xaa is any aa, unknown, or other
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTSSAPVVTRPRSTRRGSDRAAAGDCDGEDPGVAAWRARDLDEASRRCSCSHWHATERLXGXASPLRHDGASAATFRTSSGE

SEQ ID NO: 86207 - DNA, 630 bp, Zea mays
  misc_feature: Ceres CLONE 1572642
  misc_feature: Encodes the peptide sequence at SEQ ID NO. 86208
  misc_feature (454)..(454): n is a, c, t, g, unknown, or other
ctcccgcggtggcggccgctctgaactagtggatcccccgggctgcaggaattcgtctcacccctagaaaaagcggaggcctcgctctggttggaaggtttggagaaactccccggctcgaggagatcgtgcacattcgataggactatggtgagggcgcgtcgctccttcctcctgcctctggtctcggcgttgtcttcaatcacgctcgaccgtgctgacagcgtcgatgagacttgagcgaatggtcgtctcaagagatgatacaagctgtgtgagcatgccaaaatgatgggccatgaggaatttgggcccccccttgtttgttggaaaaagggccaaggaaaatttcccccccttatatcacagggaaacctttttgtattgaaaacccccttttccccccttttaaaaaaggggagggggggacaccagggggggcccccccggcgcntttttttaaaaaaattgggagaaacaccctcccaaaaaatttggggcccccctttttaatatcccccccaagaggggggcccccccccccccccctttaaaagaaaaaaaaaaccccccccccccccccccccaaaaaaaaaaccccctcccaaaagaggggggcaaccccccccc

SEQ ID NO: 86208 - protein, 30 aa, Zea mays
  misc_feature: Ceres CLONE 1572642
MVRARRSFLLPLVSALSSITLDRADSVDET

SEQ ID NO: 86209 - DNA, 867 bp, Zea mays
  misc_feature: Ceres CLONE 1572643
  misc_feature: Encodes the peptide sequence at SEQ ID NO. 86210
  misc_feature (720)..(720): n is a, c, t, g, unknown, or other
ctccccgcggtggcggccgctctagaactagtggatcccccgggctgcaggaattcgtctcacccctagaaaaagtgccacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagctaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagtgccacatgttcgggtacgccaccgacgagacccccgagctgatgccgctcagccacgtgctggccaccaagctgggcgcgcgcctcaccgtagtgcgcaagaacggcacctgcgcctggctgatgcccgactgctagacccatgtgacggtggagtacgtgaacgatggcggcgccatggntgcccgtccgcgtgcacaccgtgctcatctccacccagcacgacgagtaccgtcacctcgacgagatcgcccgcgtactcaaagagcacgtcatccaagccggtgatcccctgaggagtacctcgacgagaagacatcctcccaacc

SEQ ID NO: 86210 - protein, 119 aa, Zea mays
  misc_feature: Ceres CLONE 1572643
  misc_feature (67)..(119): Pfam Name: S-AdoMet_synt_M Pfam Description: S-adenosylmethionine synthetase, central domain
  misc_feature (1)..(52): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MVMVFGEITTKATVDYEKIVRDTCREIGFTSDDVGLDADRCKVLVNIEQQSPDIAQGVHGHFTKRPEEIGAGDQCHMFGYATDETPELMPLSHVLATKLGARLTVVRKNGTCAWLMPDC

SEQ ID NO: 86211 - DNA, 961 bp, Zea mays
  misc_feature: Ceres CLONE 1572645
  misc_feature: Translation starting site: 206
  misc_feature (412)..(412): n is a, c, t, g, unknown, or other
  misc_feature (479)..(479): n is a, c, t, g, unknown, or other
  misc_feature (580)..(580): n is a, c, t, g, unknown, or other
tggagctccccgcggtggcggccgctctagaactagtggatcccccgggctgcaggaattcgtctcacccctagaaaaactatctagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacggcggcggcttcgatgactactactgggacgacgacttccatttccacgacgacggcttctccgcctcccctacgacccccggcagcggtggtgcgccccgccagcagcagcagatgggtgatatttcagcctcggactacaaagaaggcgaagacatgcangggataccctgggaaagactcaactacaccaggggaccagtatcgtcggatgaggctcaaagagtancagagctaccagaacctcacgaggtcgcacagcgggctacaacacaggtatgcaaacaggtggagaagaaggacacatcctacgagttccatctgaacccnaaagccgtcaagtcaacgatagggcatttccagctgaaggacccccgggggccaactcaaaaccaacctggacccggtggaaaacttcccccggacccatgggttgcccgggccccgaaagaaaaaagggttccaaagggccgggcgggttgccacacccaaaatgtaaaggggctgaccctttttaaaggttaaatacaccccggggttgaaaaaaaccccctgggggccgggggttcccgggaaaacctttttaaatccttttaaaaccccgggggtgattttccaccattagggggggggaatttttttaaaaacgccttaattttataaaaccccggggccccccggggttgggggaaaacactgttgtgggaatat

SEQ ID NO: 86212 - DNA, 827 bp, Zea mays
  misc_feature: Ceres CLONE 1572646
  misc_feature: Encodes the peptide sequence at SEQ ID NO. 86213
ctccccgcggtggcggccgctctagaactagtggatcccccgggctgcaggaattcgtctcacccctagaaaaagcgacaccacgatgtggggtgagttcgcgggtccagcggaagataagcttctggtggtggcggctctcgtggtccagcaagaggggagagacgaaccggcggcagaggtgaatggcggtggagtaccactgctgctcagctgcctttttagatcacatcttcttgatcatcgtgctcgtggtcttcgcgagcctcatgtcgagcactcaccctgtgcctcatgtcccttagcctcgccgatctcgtaggacctcgccaagtccgtggagccagcacgtatctgcaagcacgcatgctgagaattttttcctgcttgtgaggaacagcacgctctgcatgcacgcatctcatctgcatgacgctgcatgggagctctgcccatatccctgatagcctgtgacagctagggtgctatttatgtagtcgcacagatgctgctttttgggaaacctacccctggccttaggtcccttttggtggccatggggccccaaggcccccattacccggggcgccttttggcttaatttccctttgggggcccatttaaaaaacatttggaacctttgggcgggaaaggcccaaaaagccttttttccggcaggccccacaaaaaaaaattgggcccctttccccggggaataccggggtggggcccggggggagaaatttatcccccgggggtgggaagccccccctttttagggggggaggttctttccccccctgccgtttataaaagagaacctcccc

SEQ ID NO: 86213 - protein, 39 aa, Zea mays
  misc_feature: Ceres CLONE 1572646
MAVEYHCCSAAFLDHIFLIIVLVVFASLMSSTHPVPHVP

SEQ ID NO: 86214 - DNA, 955 bp, Zea mays
  misc_feature: Ceres CLONE 1572647
  misc_feature: Translation starting site: 182
  misc_feature: SWISSPROT Homolog: EC 4.3.1.5 Phenylalanine ammonia-lyase
  misc_feature: SWISSPROT Homolog: EC 4.3.1.3 Histidine ammonia-lyase
  misc_feature (595)..(595): n is a, c, t, g, unknown, or other
  misc_feature (613)..(613): n is a, c, t, g, unknown, or other
  misc_feature (767)..(767): n is a, c, t, g, unknown, or other
  misc_feature (781)..(781): n is a, c, t, g, unknown, or other
  misc_feature (847)..(847): n is a, c, t, g, unknown, or other
  misc_feature (912)..(912): n is a, c, t, g, unknown, or other
  misc_feature (914)..(914): n is a, c, t, g, unknown, or other
ctggagctccccgcggtggcggccgctctagaactagtggatcccccgggctgcaggaattcgtctcacccctagaaaaaaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgctngccgtcggaggtcacccngcgcggcgatgctggtgcgcatcaacaccctcctccagggctactccggcatccgcttcgagatcctcgaggccatcacgaagctgctcaacaccggtgtcagcccctgcctgccgctccggggcaccatcaccgcgtcgggcgacctggtccngctctcctacatcngcggcctcatcacgggccgccccaacgcgcagggcgtcacgtcaacggaatggaaggtgaccccgncaaggcgttcaagatcgcggcatcgagggcggcttctcagctcaacccaaagaaggctcgcatcntnaaagcacagtctgggctcccgctcccggcacgtgatgtaaa

SEQ ID NO: 86215 - DNA, 955 bp, Zea mays
  misc_feature: Ceres CLONE 1572651
  misc_feature: Encodes the peptide sequence at SEQ ID NO. 86216
  misc_feature (720)..(720): n is a, c, t, g, unknown, or other
  misc_feature (760)..(760): n is a, c, t, g, unknown, or other
  misc_feature (766)..(766): n is a, c, t, g, unknown, or other
  misc_feature (770)..(770): n is a, c, t, g, unknown, or other
  misc_feature (826)..(826): n is a, c, t, g, unknown, or other
  misc_feature (940)..(940): n is a, c, t, g, unknown, or other
ggagctccccgcggtggcggccgctctagaactagtggatcccccgggctgcaggaattcgtctcacccctagaaaaagggagagaaagccagacaggactcctcctccttccctcccctaaaagctaaaaacatttggagagagagagagagagagggagatagaggggaaaccgagcaaccaagacgcagacgacgatggagcgagcggacgaggacgcgtgccgggtggcgctgctggacgcggacggcggcggcggcgagggcggcaagaagcagcagcagctcgcggcgcgggtgtgggaggagtcgaggaagctgtgggacatcgtggcgccggccatcttcagccgcgtcgtcacctacagcatgaacgtcatcacgcaggccttcgccggccacctcggcgacctcgagctcgccgccatctccatcgccaacaccgtcgtcgtcggcttcaacttcggcctcatgctgggcatggcgagcgcgctggagacgctgtgcgggcaggcgttcggcgcgaggaagttccacatgatgggcgtgtacatgcagcggtcgtggatcgtgctgttcatgtgcgcggtgctgctgctgcccatgtacttcttcgcggaggacgtgctgctgctgacggggcagccgccggagctggcggcgatggcggggaaggtgtgcgtgtggttcatcccgctgcacttctcctttcgcttcccntctccgctgcagcgcttcctgcagtgccagatgaaggacntcgccnacgncgccgccgccgcagccgcgctctgcgtccacctcctcggcagctggctcctcgtcntcaggctccgcctcggcctcgccggcatcgccctcacgctcaactttctcctggtgggcaccggcgccatgttctccgcctacgtcgcatgcggggggctgccccgaacctggnacggcttctcgctcg

SEQ ID NO: 86216 - protein, 252 aa, Zea mays
  misc_feature: Ceres CLONE 1572651
  misc_feature (47)..(207): Pfam Name: MatE Pfam Description: MatE
  misc_feature (188)..(188): Xaa is any aa, unknown, or other
  misc_feature (190)..(190): Xaa is any aa, unknown, or other
  misc_feature (191)..(191): Xaa is any aa, unknown, or other
  misc_feature (210)..(210): Xaa is any aa, unknown, or other
  misc_feature (248)..(248): Xaa is any aa, unknown, or other
MERADEDACRVALLDADGGGGEGGKKQQQLAARVWEESRKLWDIVAPAIFSRVVTYSMNVITQAFAGHLGDLELAAISIANTVVVGFNFGLMLGMASALETLCGQAFGARKFHMMGVYMQRSWIVLFMCAVLLLPMYFFAEDVLLLTGQPPELAAMAGKVCVWFIPLHFSFRFPSPLQRFLQCQMKDXAXXAAAAAALCVHLLGSWLLVXRLRLGLAGIALTLNFLLVGTGAMFSAYVACGGLPRTWXGFSL

SEQ ID NO: 86217 - DNA, 944 bp, Zea mays
  misc_feature: Ceres CLONE 1572653
  misc_feature: Translation starting site: 303
ctggagctccccgcggtggcggccgctctagaactagtggatcccccgggctgcaggaattcgtctcacccctagaaaaagaaaacagagggaggaaagaaaaaactcacccccctctctcttcccaccacctctctcacgtgtgtgaggtggcgagcccaaggaggagcgggaggccacaagtccgatccgcccgtatctaatccgctcgagcgcagcggctcgttcctcgcgggggcgcacggctggcatttcgagtgctgatacatcagcttcattgaatcctaaagcacggttgagccatggctggctcccttgctgcctcagccttcttccctgggccaggggcgtctccagcagcatccgcgaataacttggctggtgaagtaccggatagcttgagcgtccgtgggattgtcgcaaagcctaatgccaattctgggaacatgcgagtgaaggctcaagcacaaacccttcccaaggttaatggcaccaaggttaacctcaagaatgcaagctcagacacagaggaggcgataccctacactgctcccaagacattctacaaccaactgccagagtggagcatgcttcttgcggctgtcactacacatcttcctggcagcagacaagcagtggacactgcttgactggaagccgaagaaacccgacatgcttgttgatacattatgttttggtgggatcatccatgatgggatggtgtttacgcaaaacttcattatccggtcctataagattggtgccgatcggactgcttctatagagacattaatggatcacttacaggaaacagctctcaccattgtgaagacagctagcctttcttggagatggatctcgcagcccgcctcaaatgagcaaacgaaacttgatctggggtgtcagcaaaattcagcttcttgctcagaagtacccctaataga

SEQ ID NO: 86218 - DNA, 932 bp, Zea mays
  misc_feature: Ceres CLONE 1572655
  misc_feature: Encodes the peptide sequence at SEQ ID NO. 86219
  misc_feature (932)..(932): n is a, c, t, g, unknown, or other
tccccgcggtggcggccgctctagaactagtggatcccccgggctgcaggaattcgtctcacccctagaaaaaggagctgtgagctgagctgagctgagctcaccaccaccacacacgggagatagctatagctagcatagcaagccagccagtcagcgacttagcagcagctagctagccatgctgccgtccttcgtgtcgccgacggcgagcgccgcggcctcggtgactcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgccgccttcaccgcgctcttcgacccggacctcgtggacaagcgcgacatcctcatcgggccctataacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccatgctggacgccgtggacgcggagttcggcaaggacgacggcagcgaccagaagcctccgccagctacctcgtccccctgcagcagtgcatctttccgttcctctgcaaggcgttcgtgggcgacgaccccgtcagcccactggctgggtggacaacttcggcttcacaatcctggacatctgggctgccgctgcagatcctgcccacgcagtaaatcggcctcgtccacccccctgggaggactgctcatccaatacttcccggtggccn

SEQ ID NO: 86219 - protein, 250 aa, Zea mays
  misc_feature: Ceres CLONE 1572655
  misc_feature: SWISSPROT Homolog: EC 4.2.1.92 Hydroperoxide dehydratase
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDQKPPPATSSPCSSASFRSSARRSWATTPSAHWLGGQLRLHNPGHLGCRCRSCPRSKSASSTPLGGLLIQYFPVA

SEQ ID NO: 86220 - DNA, 947 bp, Zea mays
  misc_feature: Ceres CLONE 1572656
  misc_feature: Encodes the peptide sequence at SEQ ID NO. 86221
ctcctcggtggcggccgctctagaactagtggatcccccgggctgcaggaattcgtctcacccctagaaaaaacccctccgccgccgccgtatcctccacggcgctcgctgcaaaccctagctctggcgccagcgaggaaggaggcgcccgctctccgccgtcgccgtctcagagggggcgggccaaggtggtgatcgttatgggcgccacgggcgccggcaagtcgcggctggccgtcgacctcgcggcccacttcgccggcgtcgaggtggtcagcgccgactccatgcagctctaccgcggcctcgacgtcctcaccaacaaggctcccctccacgagcagaacggtgttcctcatcatctacttagcgtgattgatccctctgtcgagttcacttgccgtgatttccgcgaccgtgccctgccgattatacaggaaatagtggaccgcggtggcgtccctgtggttgtcggcggcacaaacttctacatccaggctctcgttagtccattcctcttggatgatatggcagaagaaatgcagggctgtactctgagagatcacatagatgacggccttaccgatgaagatgaaggcaatgggtttgaacgcttgaaggagatcgatcctatggctgcgcagaggatccatccaaacgaccatagaaaaacaaacgctacctcgagttgtatgcaaccacgggtgccctacccagcgatctgtttccaggagagggcgctaaggtgaggaaattttcgctgtacttgtctgctctgcttgtataatgtcctccctttgttattgacatgaacagacttttgcctcacaaggtttttggtttgtttggttccccgattgagataaaatggctggaaattctgggtcacatgtcagaacaaaatgggggcccgcctattaactccgaacctacggccgttttctggg

SEQ ID NO: 86221 - protein, 182 aa, Zea mays
  misc_feature: Ceres CLONE 1572656
  misc_feature (30)..(183): Pfam Name: IPPT Pfam Description: IPP transferase
  misc_feature: SWISSPROT Homolog: EC 2.5.1.8 tRNA isopentenyltransferase
MGATGAGKSRLAVDLAAHFAGVEVVSADSMQLYRGLDVLTNKAPLHEQNGVPHHLLSVIDPSVEFTCRDFRDRALPIIQEIVDRGGVPVVVGGTNFYIQALVSPFLLDDMAEEMQGCTLRDHIDDGLTDEDEGNGFERLKEIDPMAAQRIHPNDHRKTNATSSCMQPRVPYPAICFQERALR

SEQ ID NO: 86222 - DNA, 975 bp, Zea mays
  misc_feature: Ceres CLONE 1572658
  misc_feature: Encodes the peptide sequence at SEQ ID NO. 86223
ctccccgcggtggcggccgctctagaactagtggatcccccgggctgcaggaattcgtctcacccctagaaaaaattggttgcagtagcagccagccagtcacgctgttcgagcagagccccatccccgtgccaggccgctcggccctcgacgccgtgagtcaggcaggcaggcgcctctttctgtccctccacccgggtctccacgccgccgccgccgccgcctcgaccgcccccacgcatccgccgctcctctacccatcctcggcccgcggcccagggagaagaccgcacgggcgggcgagatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgaaccgtggaagtggtcgggggcatcaaaagcaaacagtcttgccatccttaactgatgcgggggcacctcctttctgatggggcaccatttgccatatcgttattccctcctcggggctcctggatgggaaccaaccccccaacacgccattggggttcttccggaatgaaaaatcttgggggccttgggtcccacttcagcccaataggggtacctgggggggatacctggattatagagggttttgtaagggctcctttaaaaaaaagggggatgggggggggcccccccattttttccttgtcccgcttttaaaatttttttcaaaaatataaaagggctttttttggggcccaaaaaccggggccgggggttgaaacccccggggaacccccaaaaacagggttggggtttttacaaaaagcctctcctccataaaaaaaaaaaaaggggtgtttttttt

SEQ ID NO: 86223 - protein, 94 aa, Zea mays
  misc_feature: Ceres CLONE 1572658
MENHNPLHSQIAEVKMDISASASVASGNKFCKGGACDFSDSSNSSKDAKERSTSMRKLIIAVILCIIFMNRGSGRGHQKQTVLPSLTDAGAPPF

SEQ ID NO: 86224 - DNA, 955 bp, Zea mays
  misc_feature: Ceres CLONE 1572659
ctccccgcggtggcggccgctgtttaccgatttaattatactagtatgatgagtactcctcctgcccataaaactgaggaagaaatgggttcagttgtttatggaactctgacaaatattgcttttgcctggcatggaaaaatccagctagctcttgccaagcttcgacctgcgcgactcctccttgactgccatcgatattctgtgtaatggaagtatttatcggaaccatcagcaatgtcatgcctcgccgctcctctacccatcctcggcccgcggcctcaggagaagaccgcaccgagccgcccagatggcccacttcaccctatacagactcatattactcgacgctcaacaggcacatcttttcaatcgccttgactggaaaaaccctggaattccccaacgtaagcgcctgtgatatctccccctttcgcaatctgggatatatgccaagaagacctccacgttcgccattaccaacatttgcgcagcctgaatgggcaatggaatcttgtacgcttgaattgttcgggaagatcagagtaaattttctgtgcaatcagcacagtgcttaaccccatcggctcgaatccggaaaatccttccatatcaaaagatcacacggagatagtgtaaggggtagtccactttggcacaaaatcccttttcaagaacgggaccccgacgccaaggccaaaaaccgtccattggggaatggccccttactgaaacataaccctattcaatttttttggagccaaggtgcctaaaaccataatcccgaaccctaaggggaccccccatttgaaatttttcggggaaaacccgggcaaatttgcctaaaaggaaggcaaaaaaaccaaagggtggcgcccctcgggcctcccaaatttaaagggtccctgtgatataacccccacacccccccctttaagaccccaaaagggggcgt

SEQ ID NO: 86225 - DNA, 911 bp, Zea mays
  misc_feature: Ceres CLONE 1572660
  misc_feature: Encodes the peptide sequence at SEQ ID NO. 86226
  misc_feature (726)..(726): n is a, c, t, g, unknown, or other
  misc_feature (738)..(738): n is a, c, t, g, unknown, or other
  misc_feature (786)..(786): n is a, c, t, g, unknown, or other
gcggtggcggccgctctagaactagtggatcccccgggctgcaggaattcgtctcacccctagaaaaaaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgctgccgtcggaggtcacccgcgcggcgatgctggtgcgcatcaacaccctcctccagggctactccggcatccgcttcgagatcctcgaggccatcacgaagctgctcaacaccggtgtcagcccctgcctgccgctccggggcancatcaccgcgtncggcgacctggtcccgctctcctacatcgccagcctcatcacgggccngcccaacgcgcagggcgtcaccgtcgaacgaaggaagttgaccccgcccaagccgtcaagatcccggcatcaagggcgcttcttcagctcaccccaagaagggctcgccatcttcaaaggacgtc

SEQ ID NO: 86226 - protein, 247 aa, Zea mays
  misc_feature: Ceres CLONE 1572660
  misc_feature (41)..(245): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature (186)..(186): Xaa is any aa, unknown, or other
  misc_feature (190)..(190): Xaa is any aa, unknown, or other
  misc_feature (206)..(206): Xaa is any aa, unknown, or other
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEVTRAAMLVRINTLLQGYSGIRFEILEAITKLLNTGVSPCLPLRGXITAXGDLVPLSYIASLITGXPNAQGVTVERRKLTPPKPSRSRHQGRFFSSPQEGLAIFKGR

SEQ ID NO: 86227 - DNA, 937 bp, Zea mays
  misc_feature: Ceres CLONE 1572661
  misc_feature: Encodes the peptide sequence at SEQ ID NO. 86228
  misc_feature (733)..(733): n is a, c, t, g, unknown, or other
  misc_feature (908)..(908): n is a, c, t, g, unknown, or other
ctccccgcggtggcggccgctctagaactagtggatcccccgggctgcaggaattcgtctcacccctagaaaaaaagaagagcacgcccactcctccggctcttcttctccaccggtcaccagtccacctcctcctgcctgcgcgcggccccaaccaaccactccgcagcgcagcaatggcgggcaacggcgccatcgtggagagcgacccgctgaactgggacgcggcggcggcggaactggccgggagccacctggacgaggtgaagcgcatggtggcgcacgcccggcagcccgtggtgaagatcgagggctccaccctccgcgtcagccaggtggccgccgtcgcctccgccaaggacgcgtccggcgtctccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcatgcatctcaacgcctgaatcttcggcaccggcagcgactggcacacgctgccgtccgaggtcacccgcgcggcgatgctggtgcgcatcaacaccctcctccagagctactccggcatccgcttcgagatcctcgaggccatcacgaagctgctcaacaccggtgtcagcccctgacttgcgctcgggggcancatcaacgcggctggcgacctgagtccgctctgctacatcgaccgtctcatcacgggccgccccatggcgcatgccgtcaccgttctacggaaggtaggtggactcctccgaagcgctctagatcacgggcatcgaggtcggggtccttcaagccatacccaaagaagggcctcncatcttcaaacgtaacatccgttgctccc

SEQ ID NO: 86228 - protein, 126 aa, Zea mays
  misc_feature: Ceres CLONE 1572661
  misc_feature: SWISSPROT Homolog: EC 4.3.1.5 Phenylalanine ammonia-lyase
MAGNGAIVESDPLNWDAAAAELAGSHLDEVKRMVAHARQPVVKIEGSTLRVSQVAAVASAKDASGVSVELDEEARPRVKASSEWILDCIAHGGDIYGVTTGFGGTSHRRTKDGPALQVELLMHLNA

SEQ ID NO: 86229 - DNA, 953 bp, Zea mays
  misc_feature: Ceres CLONE 1572662
  misc_feature: Translation starting site: 354
  misc_feature: SWISSPROT Homolog: EC 2.7.11.1 Non-specific serine/threonine protein kinase
ggccgctctagaactagtggatcccccgggctgcaggaattcgtctcacccctagaaaaattttgtgtcgtaggcggtttgcactagcgtttccgtgaggtgggcgaaggcgtccgtgaccgaccgaccgaccggagcttcatgcgccaggggcggcggcttcaccccgtcgtttgatgggcaacgcatgcagcggcgcccttagatccaagtacctgcacagcttcaagcacgccgcgtcgcagcgccacgactccgagtacagcgccagcgccagcgccgacgactcgcccaggaagcccacaccgcccgccaccacggacgcccacgcgccggcgccgcccgccgccgccatgaggcgcggcgcggctggcgcgacgccggacctcgggtccgtgctcggccacacaacccccaacctccgcgacctctacgcgctcggcaggaagctcgggcaggggcagttcggcaccacctacctctgcaccgagctcgccacggggatcgactacgcctgcaagtccatctccaagcgcaagctcatcaccaaggaagacgtcgacgacgtgcgccgcgagatccagatcatgcaccacctctccggccacaaaaacgtcgtcgctatcaagggcgcgtacgaggaccaggtctacgtccacatcgtcatggagctctgtgccggggggcgagctcttcgaccggatcatacagcgcggacactacagcgagggcaagggcgccgcgctcccaaggacaccgtccgggtcctccaaggcctgcactcgctcggggtcatgcaccgggaaccctaagcccgaaaacttcctggctccccaacaggaaagataaacttctcgcccaaggccatcaatttcggaaactccggtctttttcagacctgggcaatttttcaccgaattaatttggtaggccctttattggtagctcccaag

SEQ ID NO: 86230 - DNA, 970 bp, Zea mays
  misc_feature: Ceres CLONE 1572668
  misc_feature: Encodes the peptide sequence at SEQ ID NO. 86231
  misc_feature (398)..(398): n is a, c, t, g, unknown, or other
tccccgcggtggcggccgctctagaactagtggatcccccgggctgcaggaattcgtctcacccctagaaaaaaagctacccagctacctacctaccttccccctgcgccgtcactagcgaaccggcaccatgctccgggcgctcaacccgtccccgtcccagctccgcgcgcgtccggcgtgccgcgccgcgccgcgccggcgcccgcgcggggcctgggcgcgcccccgtgccgcggcggtcccgcagcagccgccggtgcgccggccctccggagaccggctgcgcgcgccgtcacggggcgccgccgccgccgaccagctgccggcgcctgatgttggcgcggcggcgcccggggcgcggggcgagctggaggcgttcctggagattgcgcccncaaggatgcggcgcgggctggcgcggcaccaggagctgcgggacctcgtcgaggtcatcatggacctcggccgccgcccgatcgcgcggttcccgtccagggactgggccatctccgaccagcccgtcaccgccgatgacctcctccaagccgtcgccaaggtaggtgacttctctgaggacaaccgatctgggatcattcactcgttgcaccggatcagcgctattcggaaacgggaaagctcaatcataggcctcaccttgccgtgttggtcgaactatatctggcagtgccaaagatgatccggggacctggggcggagtggtgggttaaaaattggcgaatggaaccccctggaagttgggaaaacacctctgaatcaggaaataaccaaaaattttggccaaaaaaggtaaaaaaaccgttgatcttggtggacccatctcatggaataagaaaggggaaggggattttccctcaatccgggcctttggaagggcttagaaaaaaacaaggtccccagagtatctaatggccgccaaagaaaatgacggaaaaacattggaaaaacc

SEQ ID NO: 86231 - protein, 189 aa, Zea mays
  misc_feature: Ceres CLONE 1572668
  misc_feature (90)..(90): Xaa is any aa, unknown, or other
MLRALNPSPSQLRARPACRAAPRRRPRGAWARPRAAAVPQQPPVRRPSGDRLRAPSRGAAAADQLPAPDVGAAAPGARGELEAFLEIAPXRMRRGLARHQELRDLVEVIMDLGRRPIARFPSRDWAISDQPVTADDLLQAVAKVGDFSEDNRSGIIHSLHRISAIRKRESSIIGLTLPCWSNYIWQCQR

SEQ ID NO: 86232 - DNA, 964 bp, Zea mays
  misc_feature: Ceres CLONE 1572670
  misc_feature: Encodes the peptide sequence at SEQ ID NO. 86233
tccccgcggtggcggccgctctagaactagtggatcccccgggctgcaggaattcgtctcacccctagaaaaactatctagctctcccgtttctgctcgcaagtcacacacgcagctccggtagatccggccctcgcctctggctccatgaagagattagcttcagacggctcggatcgatactagcaagcaagcaagcatggcgcagtacttgtgcgaagacttggagctcatcgccgacaacagcggccgcttcaatcactactactgggacgaccacttccatttccacgacgacagattctccgcctcccctacgacccccagtagcggtggtgctccccggcagcagcagcagatgggtgatatttctccctcggactaaaaagaaggccaacacatgcatgggataccctgggaaagactcaactacaccagggaccagtatcatccgatgaggctcaaagagtacaagagctaccagaaactcacgaggtcgcacagagggctacaacaacatgaatgcaaacatgtggagaggaaggacaattctacgagttccatctgaacacgagagccgtcaagtcaacaatagtgcatttccagctgaggaaacttctggcgtctactttgaagcccaacgtgtacttggggcaaagctactccgttacccactggttctgccctgctcccggagaagagaaaaggtctcaacttggccgggccggtagtccccgaaccctaacattaaaaggggctggacctttttacaaggggtcacaataacccccatagattgttaaaggaacaacttattgggggccgggggggttcccgggaagacccttattgccaataccttttttaacccccgggtgggaaatatagacccaacttaaccgggggtagggtgttccattcacgaaccccctacgaattttctctgggcaccaggaggcacccc

SEQ ID NO: 86233 - protein, 55 aa, Zea mays
  misc_feature: Ceres CLONE 1572670
MHGIPWERLNYTRDQYHPMRLKEYKSYQKLTRSHRGLQQHECKHVERKDNSTSSI

SEQ ID NO: 86234 - DNA, 897 bp, Zea mays
  misc_feature: Ceres CLONE 1572671
  misc_feature: Encodes the peptide sequence at SEQ ID NO. 86235
  misc_feature (617)..(617): n is a, c, t, g, unknown, or other
  misc_feature (666)..(666): n is a, c, t, g, unknown, or other
  misc_feature (692)..(692): n is a, c, t, g, unknown, or other
  misc_feature (791)..(791): n is a, c, t, g, unknown, or other
  misc_feature (863)..(863): n is a, c, t, g, unknown, or other
ctggagctccccgcggtggcggccgctctagaactagtggatcccccgggctgcaggaattcgtctcacccctagaaaaaatcttcccagctccgcctccttttcctgccttcctcctcactagtcgctcccccgcggctcgcgcaggcgggcgacacaacgaggctaaatccctatcgcgaggaggcgtgtgaggccagcggctttgcgatgacagcaccagcggacaaggggaagaaggccaagactgatgccgacggcggcgaggagaacgaacagatcgacggcgtcctcgtcctctccatcgagaagctccaggagatacaggacgagctcgagaaggtaaatgaggaagcaagtgacaaggttatggaggtggagcagaaatacagtgagatccgcagacctgtctatctcaagaggggtgacattatcaagaccatcccggacttttggctcacagcgtttatgagccatcctctattaagtgagcttctgactgaagaggaccagaagatattcaagtacttagactccattgatgtggatgattctgatgttaaggcaggatactccattcatcttaaactctctgagaacccgtactttgaggacancaagcttgcaaagacctatatcttttgctgatgatgggaacacccacantaaaagctcccgaaattaagtggaanggaaggaatgggacctgcaaatgggaaatggtattaccaaaaaggggagtaaccggccattattagagggagagttttttacccgggttgggggaaccnaaccccaaaatctttcctaatgggggccaaaaaaaaggggcgggaaacccaaaaggaaaattttggggcccnaacccttggagaacctccaaacaggagggggaca

SEQ ID NO: 86235 - protein, 145 aa, Zea mays
  misc_feature: Ceres CLONE 1572671
  misc_feature (32)..(146): Pfam Name: NAP Pfam Description: Nucleosome assembly protein (NAP)
  misc_feature (136)..(136): Xaa is any aa, unknown, or other
MTAPADKGKKAKTDADGGEENEQIDGVLVLSIEKLQEIQDELEKVNEEASDKVMEVEQKYSEIRRPVYLKRGDIIKTIPDFWLTAFMSHPLLSELLTEEDQKIFKYLDSIDVDDSDVKAGYSIHLKLSENPYFEDXKLAKTYIFC

SEQ ID NO: 86236 - DNA, 889 bp, Zea mays
  misc_feature: Ceres CLONE 1572672
  misc_feature: Encodes the peptide sequence at SEQ ID NO. 86237
  misc_feature (889)..(889): n is a, c, t, g, unknown, or other
ctggagctcaccgcggtggcggccgctctagaactagtggatcccccgggctgcaggaattcgtctcacccctagaaaaagtagaagtacgtggacgatgccaatcccagtgtttgtgtttgtctcctatactcctcaaagccctctttcaccctctccaacttgactcactcacttgagccactcttcttcctcctcatcaatccgtatcatccaccaattattcggaacaaaaagaaactagaacaccctaactatacaacaaggaatcatggggagcgggcgcagccacctcctgctacccgcagcatccgcctgcctgtgggcgctgtcctgcacgatgctgctgacctcgtcccctcaccgctctagcacccgcgacagcgggatgctgacggtctggctcaccacgtgcggcagcgggctcaaccactccgcgctggcgagcggccaaggccgctaggcatcaggaggcaagccgtctcgggtcctccggcggctgccacgtccctctcgtctactacctcaacaccaagtactatggggtcatctagcatcgtcatcaccgcacgataacttcaccgtcatcttccacaccggcagctacaacctctgggtcccctactgcatatgctacttctcgattgcctgctacatgcaccacaaatacaacttcgccaagtctatcacgtacaacgcggacagccagacctgcaagatcacctacaggtgctgctcgatctcagggttcttcatcgaccacgacgtgctggtctgggacctgatcagaacatagctcatgtcatacggacactcacgataaagcattacattcataatcgacatgtcgacagcatcctcggtctgggaaacccgagatctcatgagn

SEQ ID NO: 86237 - protein, 46 aa, Zea mays
  misc_feature: Ceres CLONE 1572672
MHHKYNFAKSITYNADSQTCKITYRCCSISGFFIDHDVLVWDLIRT

SEQ ID NO: 86238 - DNA, 966 bp, Zea mays
  misc_feature: Ceres CLONE 1572673
  misc_feature: Encodes the peptide sequence at SEQ ID NO. 86239
  misc_feature (785)..(785): n is a, c, t, g, unknown, or other
  misc_feature (834)..(834): n is a, c, t, g, unknown, or other
  misc_feature (865)..(865): n is a, c, t, g, unknown, or other
ctccccgcggtggcggccgctctagaactagtggatcccccgggctgcaggaattcgtctcacccctagaaaaaagttctcctgcctaccccgtccctccccaagcgcgccgtctagggtttcacagccgtgccccgatccattcgagcgccccgcaccgccgccatggagtttgacgaatacgagtacttggagaaggcggtagagcccgctcccccacaggccaatggttccggctccggctccggcgagaaggaccgcggctcgcgccgccgcgagggcggcgaggaccgcatatcgaagcgctctcgctcgggggaggaccgcgaccgggacaggcaccgcagcggccgggagcaccgtgaccgggacaaggatgacgtgaaggaggagaggagccgcgaaagccgcgggaaggacagggacagggaagggagagaacgggagaaggagaggggtgacaggcaccggctgagagagagggaagtggaacgggagcggaggagccggagccgctcggagcggcgccgtgccgaggaagaggagatggttagggagctggagcgggagcgcgagcgcagcgagcgacatcactatcgcgaccgtgatgtcaggcgtaggatagatgacggggcagagcctgaagttgatccagatagggaccagacgactgtatttgccttccagctatctttgaaggcagactagagagatgtttatgagttcttctcaagggctggggaggttcgtgatagtcgtcttatcatggaccggaactcaagacngtctagaggagtggggtacattgagttttacgacgttatgtctgttccnatggcaattgctctgtctggtcaaccgctgnctgggacagcagtgatgggtaaaccatctgaggctgaaaagtacttagggtcatcaatgccgacatcaggtggtgcggcttcaggtgaaggcagaaagtgt

SEQ ID NO: 86239 - protein, 180 aa, Zea mays
  misc_feature: Ceres CLONE 1572673
MEFDEYEYLEKAVEPAPPQANGSGSGSGEKDRGSRRREGGEDRISKRSRSGEDRDRDRHRSGREHRDRDKDDVKEERSRESRGKDRDREGREREKERGDRHRLREREVERERRSRSRSERRRAEEEEMVRELERERERSERHHYRDRDVRRRIDDGAEPEVDPDRDQTTVFAFQLSLKAD

SEQ ID NO: 86240 - DNA, 949 bp, Zea mays
  misc_feature: Ceres CLONE 1572675
  misc_feature: Translation starting site: 225
  misc_feature: SWISSPROT Homolog: EC 2.7.11.22 Cyclin-dependent kinase
  misc_feature (908)..(908): n is a, c, t, g, unknown, or other
ctccccgcggtggcggccgctctagaactagtggatcccccgggctgcaggaattcgtctcacccctagaaaaagcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtggggcaaggggaggtcgtccccgcagcccgaagcggggtcgccctccgcagtcgccgccaccgacggggacgggaggccgcggcggcggctcgggggccgcagggcgtcgggacccaggcagggttgcgtccccgcggctgccgcggcggagcagctcgccgccggttggccaccgtggctcgttgcagtcgctggggaggccctccgcggctgggcgccgcgccgcgccgacacgttcgagaagcttaataagataggatcgggcacgtacagcaacgtgtaccgggcgagggacaccgtctctggccggatcgtcgctcttaaaaaggtccgcttcgataacctcgagccagagagcgtcaagtttatggcccgggaaatactgatcctaaggagactcgaccaccccaacatcatcaaattagagggcttggtcacctccaggatgtcatgcagccctttacctttgtctcgagtacatggagcatgatcctgctggtcttgcggcaagttgtgatgtcaagttcacgttgcctcagataaaatgtacatacagcagctgttgtcaagacttgagcatgtcttgacattatgtattccacggggatacaagggggcaacttgntggttggatattatgggatccttagattggggatttgggca

SEQ ID NO: 86241 - DNA, 921 bp, Zea mays
  misc_feature: Ceres CLONE 1572676
aaagctggagctccccgcggtggcggccgctctagaactagtggatcccccgggctgcaggaattcgtctcacccctagaaaaagaaaacagagggaggaaagaaaaaactcacccccctctctcttcccaccacctctctcacgtgtgtgaggtggcgagcccaaggaggagcgggaggccacaagtccgatccgcccgtatctaatccgctcgagcgcagcggctcgttcctcgcgggggcgcacggttggcatttcgagtgctgagacatcggcttcattgaatcctacagcacggttgagccatggctggctcccttgctgcctcagccttcttccctgggccaggggcgtctccatcagcatgcgcgaagtaacttggctggggaaatagcgggatacctccaccctcccgtgggattggccgcaaaagcctaatgcccaattgctggaaacattgcaatttaaaggttcaagccccaaaccctttcccaaggggttatgggccaccaagggttaaacccccaagaatgggaaggctccaaacccccgaggaaagggatatacccttaacatgggtcccccaaagaaatttttttaaaaacccaaatggccaaaaaatgggaaaaaatgtgtttttttggggggtttttaaaataaaaaacttttccccgggggggaaaaaaaaaacggggggaaaacccccccctccccccggggaaccccaaaaaaaaacaccccgcgggcgggggggggaaaaaaatatgtggtttgggggggggaccccccccagaaaagggggagggggttttttaaaaaaaattctttttattcccccgcccataaaaaaaagtggtgcccaaaatgggggggtttcttttttaagaaaatattgtgagacccctctcggggagaaaccc

SEQ ID NO: 86242 - DNA, 878 bp, Zea mays
  misc_feature: Ceres CLONE 1572678
  misc_feature: Encodes the peptide sequence at SEQ ID NO. 86243
  misc_feature (565)..(565): n is a, c, t, g, unknown, or other
tccccgcggtggcggccgctctagaactagtggatcccccgggctgcaggaattcgtctcacccctagaaaaaatgcctgtaggagggagagagctttcggtttagaaaataagagggtgccgcgggctggactgagagagcggaaggaaggaaggagccggcgatgggcgggtggaactggctcttctgcggccgatccaaagccggaggcggcgagctccggcctcccgagcccttccagctgccggcgcccttgcccgagtggccgcaaggaggggattttgctaagggcacaatatgcataggagaggttgatgttacaagtattaccaaattccggagtatatggacctgctcagatgctacattttatgagccagaaggaattcctgatggtttccactgccttgggcactacgcccaacagaatgaccgccccttacagggatttcttctggtggcaagggaaatggctagccaccaagttattgataccaagcccgcccttgagaaacatcagattactcccttgtttggaccagtgctgacgcatatgaagatgancatagcgaatgtggttgcatctggctgccatgtcccacgaatgggtataaagcccctgcctattgtgtttctaaaggaccaaagagccatcccgggaacccattcgggggggtgcaaatgacctaccgaaccccgcgaaaatttcattcaattgcaaatgggacaaccttgccaaatttgaaaaaaaggccttcccccgagaggggggaagggggggaaaaccggcggggaattgcccggggaaaccatttcaaaaaggggttaaataacccccccgcgcgaaaatggcccccaattgggggcccgcccaacc

SEQ ID NO: 86243 - protein, 173 aa, Zea mays
  misc_feature: Ceres CLONE 1572678
  misc_feature (20)..(173): Pfam Name: DUF946 Pfam Description: Plant protein of unknown function (DUF946)
  misc_feature (134)..(134): Xaa is any aa, unknown, or other
MGGWNWLFCGRSKAGGGELRPPEPFQLPAPLPEWPQGGDFAKGTICIGEVDVTSITKFRSIWTCSDATFYEPEGIPDGFHCLGHYAQQNDRPLQGFLLVAREMASHQVIDTKPALEKHQITPLFGPVLTHMKMXIANVVASGCHVPRMGIKPLPIVFLKDQRAIPGTHSGGCK

SEQ ID NO: 86244 - DNA, 986 bp, Zea mays
  misc_feature: Ceres CLONE 1572679
  misc_feature: Encodes the peptide sequence at SEQ ID NO. 86245
  misc_feature (515)..(515): n is a, c, t, g, unknown, or other
ctccccgcggtggcggccgctctagaactagtggatcccccgggctgcaggaattcgtctcacccctagaaaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaagaggtgcagatcgcgcaccgncgccgcaacagcaaactcaaagaaaagtggcttccgccgacgaatgctccgccaccaccgagtccgacatcgaggagaccctcaagcccctctggtccgatgtccgccaagtccccgaggaggggtccaaggcctcagaaaccagaacgtcgaccttgttttaccgggaatccaaagaattccgcccccggttggcccgtgcaaaaaacccaggaacccggaattgccgaacccccttaatcccagggaactccgtaacaacaaaaaggggggcccgtaaaagctcctccaaaaaaaatcccaacgcccctccaaatgggggtaaaccgggggggccaccccccccccaaggaaaaaaagccttggggggaaagacaccccccaaaaaagttttggaagggcgcgcccattttttctcccgccgtgggaaaacccccccaaaaaaaatgcgccattaaggacccctctcca

SEQ ID NO: 86245 - protein, 199 aa, Zea mays
  misc_feature: Ceres CLONE 1572679
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNSKLKEKWLPPTNAPPPPSPTSRRPSSPSGPMSAKSPRRGPRPQKPERRPCFTGNPKNSAPGWPVQKTQEPGIAEPP

SEQ ID NO: 86246 - DNA, 939 bp, Zea mays
  misc_feature: Ceres CLONE 1572680
  misc_feature: Encodes the peptide sequence at SEQ ID NO. 86247
ctccccgcggtggcggccgctctacaactagtggatcccccgggctgcttgaattcgtgtcacacctagaaaaaacgggcgccactcgaggctccgcccctatgttaagacgccaccacgggaccacctggtccgctaacaaggcacgcaacaccgcagcgtaacgtacccggctaggggaagagctctttgcttcagatgtgccgtgcacaacgcacggcacgctggtatggtttgcatctcccccgccaagaaacactctgccgtgaacagtctgagcaggcgggaagacatgcatcaggcgggcgacttgccgagcagcagcgagttctccgggtcggtgaacactcaagcacgtgaaactggggtaccagtacctggtgaaccacttcctgacgctactgctgggtaccggtgatagccagccactgcgctgtgagctggcgcgcctcggccccggcgagctgactctctctgtgtgcgcatcactggatctggacctggtccacatgctctgctccgcgttcatggtcgtctgtcttcggcaccgtgtgcgtgatgtcgcgaccctggtcggtgtacctgatggactactgctgctacaatgcacccgcctgctgcagggtgccattctcagcttgatggatcaacgcgcctggtctgcgactacgacagatcgtgcgcctgcagacatcatgccgtatacctcggggatgcttgaagacagtgcctcccgcccgcgaacactaattcgcgaccaacccggcatgaagcctcgggcgcgaaggccaagtacgctttttcccgcaatcgaaacctagtccccgacaggaggtcagcccaaggaacaagactcaaggaagggacggatccttttttccggagacatttttacccgcatggcggattaaaagtgagctccggaaaaattccaatctc

SEQ ID NO: 86247 - protein, 62 aa, Zea mays
  misc_feature: Ceres CLONE 1572680
MVCISPAKKHSAVNSLSRREDMHQAGDLPSSSEFSGSVNTQARETGVPVPGEPLPDATAGYR

SEQ ID NO: 86248 - DNA, 963 bp, Zea mays
  misc_feature: Ceres CLONE 1572681
  misc_feature: Encodes the peptide sequence at SEQ ID NO. 86249
  misc_feature (436)..(436): n is a, c, t, g, unknown, or other
  misc_feature (961)..(961): n is a, c, t, g, unknown, or other
  misc_feature (962)..(962): n is a, c, t, g, unknown, or other
acccgcggtggcggccgctctagaactagtggatcccccgggctgcaggaattcgtctcacccctagaaaaaaaaaaaaaatctcccacaccacagctcccaccacagcaggcagcagctcgatcgctagctcctccgaaccggaaagccaagcccgctttggcgatcgtgcttgcttgcttggttccttcaattcctgccggagccagcgagagctagctgctgctgtcgcgtggtagacgtcgtcttgccagcgagagcctagctcgatcggtctctctggtacaacgtagggagaaagatcgagggggagaggacgacgactatggccggcgcgaccgtgaccgtggaggaggtgaggaaggcccagcgcgccaccggccccgccaccgtgctggcgatcggcaccgccacgcccgacaactgcgtgtaccangccgactacccggactactacttccggatcaccaagagcgagcacctcaccgacctcaaggagaaattcaagaagatgtgcggacagtcgatgatcccgaaaggttacttgcaccttacggaggattccctggcggatacccaatccatgggcccttaacatgcgcccttccctggaacccctgaagaatttggtggtgggtgaaggggccaaaacttgggaaaggggggggcccaaaaggtctcaaagagggggggggaccaaatcgggaaaacccaacctgggttccccccccctccgggggggaaatgggggcccccaatccagggaacaagggggggggggcggggcccccctgaaccccctttaaaatcaaaaggggggttcttggggggaaaagttctccctgtgacaaaaaccccaaaaaaaccccgcccgcgtggtggggggggggggcaaaaataagagggttttgggggcgccccataaacccccactgttgtgggggccctttttcaaaacccnnt

SEQ ID NO: 86249 - protein, 89 aa, Zea mays
  misc_feature: Ceres CLONE 1572681
  misc_feature (6)..(89): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature (37)..(37): Xaa is any aa, unknown, or other
MAGATVTVEEVRKAQRATGPATVLAIGTATPDNCVYXADYPDYYFRITKSEHLTDLKEKFKKMCGQSMIPKGYLHLTEDSLADTQSMGP

SEQ ID NO: 86250 - DNA, 937 bp, Zea mays
  misc_feature: Ceres CLONE 1572682
  misc_feature: Encodes the peptide sequence at SEQ ID NO. 86251
ctccccgcggtggcggccgctctagaactagtggatcccccgggctgcaggaattcgtctcacccctagaaaaaaacacacagtaccgcgacgaggcaatccttccgcctctcgtccacgacgacgctgcgaaggtggcgtccttggattcgggaaacgactttggcctgcagcagaccgccacggtgcttgcgtccctggggtccgacgagatgtcttcgtcgaccacgctcctcgccggctccatatccgaccgctacattccgccgctctacgacgacgactgctacaccatgccacagccgtttgtcgatactctcgccaaccccgacgatgacctcctccaggagctcgacgtgttggacgaggatgccgcgagcgccaacgcggctgacgacgattcaggcgttgtcctcgtctatgcgccgctcgactcgaacatcgacagcagcggatcaccgcgctacccgtgcctccccgagggcgcggtgttgttccatcgggacccgcacgagaaggtcctcatcggcaggacggagttgtccggcgaagtccgccgcctccgtttctccttgtcgtcaccagaccaggcgatgaaccccgcgctcgtcccaacaccgacgcagaggaaggagatgttctcaccatcacgcccacccagtgttcgagcatatacctcaaccgcggcatttactccgtccccaaccgggtcttcatcgtcagcacctactcggggactgcgacggctaccacgtcggagtcgacgtcgacatccttcctacctccgagttcgacgagggtcccatcttcgacgaggaggcctagcttcacggcagctccctggatcagatccaactctccctacgactgggtcggccccgtcattcgcgtcacgggagcggcgaaactgagctgtctccagcgaaacgaacaggcc

SEQ ID NO: 86251 - protein, 302 aa, Zea mays
  misc_feature: Ceres CLONE 1572682
PRGGGRSRTSGSPGLQEFVSPLEKNTQYRDEAILPPLVHDDAAKVASLDSGNDFGLQQTATVLASLGSDEMSSSTTLLAGSISDRYIPPLYDDDCYTMPQPFVDTLANPDDDLLQELDVLDEDAASANAADDDSGVVLVYAPLDSNIDSSGSPRYPCLPEGAVLFHRDPHEKVLIGRTELSGEVRRLRFSLSSPDQAMNPALVPTPTQRKEMFSPSRPPSVRAYTSTAAFTPSPTGSSSSAPTRGLRRLPRRSRRRHPSYLRVRRGSHLRRGGLASRQLPGSDPTLPTTGSAPSFASRERRN

SEQ ID NO: 86252 - DNA, 925 bp, Zea mays
  misc_feature: Ceres CLONE 1572683
  misc_feature: Encodes the peptide sequence at SEQ ID NO. 86253
  misc_feature (634)..(634): n is a, c, t, g, unknown, or other
  misc_feature (892)..(892): n is a, c, t, g, unknown, or other
ctccccgcggtggcggccgctctagaactagtggatcccccgggctgcaggaattcgtctcacccctagaaaaactcccctctcttgttccgccgaccccacgccagtagagatgagggccacatcgtccccagtgcccgccgccgtcctcgtcgccccctcctccgccgccgtagcagtgaaacctcgtgccgcagcgagtggcggcggaggcagcacagcaggcaggcgcgacgtgcttgccgccggtaccgggctgggcgcggcgctgctgctggcgctggggccggcgcgcgcggcggacgaggagtacgtgagcgagacgaaggaggtgatcgggaaggtgcggtcgacgatcgggctggacaagtcggacccgagcgtggccgactcggtggcggagctccgggacctgtccaactcgtgcgtggccaagtacaggcgggagaagtcgctgctggggcgtccgtcgttccgggagatgtactcggcgctcaacggccgggtcgggccactaaatgagcttcggccccaggggggccatcccggggcaaaggccccgcccccaatccccaaggaaatggaccccccccaaaaaaggggccccaagggggcggggtgggccaaatccccncaaaaggtggccctttttcaagaaacccaagtgcccagttggggaaaaaaggccccattttggtttgttaaaaaccgggaagaaattatcccccctttttttccccccctggaaaattggttttaaacctcgggaaaaaaaattcccccccttttttgggcgtctaaaaaaaaaaagggccccgcggggggttaaaaaaaaattttttccaccccttttcttttgtgtccctcccccctcaaaaaaaaaaaaaaaccncgccccggggggattttgggccccccccccccc

SEQ ID NO: 86253 - protein, 215 aa, Zea mays
  misc_feature: Ceres CLONE 1572683
MRATSSPVPAAVLVAPSSAAVAVKPRAAASGGGGSTAGRRDVLAAGTGLGAALLLALGPARAADEEYVSETKEVIGKVRSTIGLDKSDPSVADSVAELRDLSNSCVAKYRREKSLLGRPSFREMYSALNGRVGPLNELRPQGGHPGAKAPPPIPKEMDPPQKRGPKGAGWAKSPQKVALFQETQVPSWGKKAPFWFVKNREEIIPPFFPPLENWF

SEQ ID NO: 86254 - DNA, 994 bp, Zea mays
  misc_feature: Ceres CLONE 1572684
  misc_feature: Encodes the peptide sequence at SEQ ID NO. 86255
ggagctccccgcggtggcggccgctctagaactagtggatcccccgggctgcaggaattcgtctcacccctagaaaaaatgaagagcacgcccgactcctccggctcttcttctccgctggctcatgttacctcctcctggctgtgtgcggctccaactaaccagtccggacaccaccagaggtcggcaacgcgcgccatcgccggagagcgaccacgatggaagtggagcatgtcagttgtggaactggcctgcatccatctgcaccaggtgaagcgcatggtggcgcacgcccggcagcccgcggtgaagatcgagggctccaccctccgcgtcagccatgtggccgccgtcgcctcccccaaggacgcgtccggcgtcgccgtcgagctcgacgaggacgccctcccccgcgtcaaggccagcagcgagtggatcttcgactgcatcgcccacgggggcgacatctacgggggtggcctgcggcttcgagcggaacatcttaccggtcgctcctaggtagagggcccgcggtccccggtcgagcttggtcatgcatctcaaacttcgggaaatcttcgggctccggggaccggactggctcccttgctgtcgctccggagagtcacccctccgccgtgcctatgcttggttgagagcttcaaacaacccgcgcttcccgggggcctaacttccgggcaatccggactatccttaattccctccgaaggcccttcgaggataacctgggtgaaaaccccaggttgtgtcaggctcccgtaccctggcctgtttcggggggcataattttacggagtgtgggggttaaacctgattctcaccttcttctcttgggcgccaccgcccttcattcttgggccgagcctcaatgggggctagcgctgtttaccttttaaacgtcaaggaaggttgtaattcctccacaagcttttctattacacaggggcgttcgatgggcgggttctattaattt

SEQ ID NO: 86255 - protein, 95 aa, Zea mays
  misc_feature: Ceres CLONE 1572684
  misc_feature: SWISSPROT Homolog: EC 4.3.1.5 Phenylalanine ammonia-lyase
MSVVELACIHLHQVKRMVAHARQPAVKIEGSTLRVSHVAAVASPKDASGVAVELDEDALPRVKASSEWIFDCIAHGGDIYGGGLRLRAEHLTGRS

SEQ ID NO: 86256 - DNA, 943 bp, Zea mays
  misc_feature: Ceres CLONE 1572685
  misc_feature: Translation starting site: 181
  misc_feature: Pfam Name: DUF21 Pfam Description: Domain of unknown function DUF21
ccgcggtggcggccgctctagaactagtggatcccccgggctgcaggaattcgtctcacccctagaaaaagcgacgcaggaggtggggtgagttcgcgggtcgagcggaggagaagcttctggtggtggtggctctcgtcgtcaagcaggaggggagagaggagccggcggcggaggtgaatggcggtggagtaccactgctgctcggcggcctttttcgagcacatcgtcatcatcatcgtgctcgtgctcttcgcgggcctcatgtcgggcctcaccctgggcctcatgtcccttagcctcgtcgatctcgaggtcctcgccaagtccggcaccgagcaggatcgcaagcacgcagctaagattttacctgttgtgaagaaccagcaccttctgctatgcactcttctaatctgcaatgcggctgcaatggaggctttgcccatattccttgatagcttggtgacagcttggggtgctatttttaatatcagtgacactgattctgctttttggtgagatcttaccacagtccatctgctcacattatgggctggctattggtgcctcagttgctccattagtccgtgtgcttgtttgggtctgcttttctattgcctatcctatagcaagctattgaactttgtgctgggtcatggtcagacagttctcttcctaaagctgaactaaaacacttgtcctctgcccgggatgaagctggcaaaggggaaaattaccctggtgaaactcccttttgccggacctcttgaccggccgaaaaaaaacttaaatgttttccacccttgggaaaaacttgcaattggttaaggcaaaattggcgggatctatcgaaagggctttaaaagggctcccaaatcccgggtttttaaaaaaaaaaaatttggggggaggggggaggcccccctaaaaacgcgacttttta

SEQ ID NO: 86257 - DNA, 942 bp, Zea mays
  misc_feature: Ceres CLONE 1572687
  misc_feature: Encodes the peptide sequence at SEQ ID NO. 86258
  misc_feature (441)..(441): n is a, c, t, g, unknown, or other
  misc_feature (472)..(472): n is a, c, t, g, unknown, or other
ctccccgcggtggcggccgctctagaactagtggatcccccgggctgcaggaattcgtctcacccctagaaaaaaaaaacccctaatccctagccacaccacgccctcttccctccttccccgttggcttcggcggcgggcggccatcagcaaccagcatcgtacggaggagaagcgctgtttacacccgtctggcagggatgccgctggggcagcgttcgggggacaagagcgactcccgctactgcggggtggaggttctcgacttccccgccggggagggcctccctgccgtcctcaatcactccctcgcctccgccttcgacttcatcctcgcccctctggttgatcccaactaccggccggcgcccggcgccgttctgccagtgtcagcgtcggacctcgtcctcggcccgtcccagtggagcaaccacgtcgtcnggaagatcagcgagtggattgatttggacgncgaagacgagccgctccggctggactccgagctcacgctgaagcaggagatcgcctgggcatctcacgtttccctgcaggcatgtgttatccctgccccccagaaaatcttttgccggcattaatgcccggtttgggaatcaaatttggcaggccggaccaaaatgaattgtgggcttaggttgccccctggaaaaccccaaccctgggagggggaccttgaaaaaaaaaggaacacaccccccccctcccggggaaaaccccaacccgcgggaatatgggaattcctcaaatggtttgggaccttggagcccaattgggggggcctgtttttttcgggccccgcgccctaaaacacttatagccctgtttggggaaccctaagggtcctttttacaaaaaagtttttttttaaaaagaaagaaattctttttaaaaacgccaaaaggggcccaaatttttatattttct

SEQ ID NO: 86258 - protein, 131 aa, Zea mays
  misc_feature: Ceres CLONE 1572687
  misc_feature: SWISSPROT Homolog: EC 2.1.1.125 Histone-arginine N-methyltransferase
  misc_feature (81)..(81): Xaa is any aa, unknown, or other
  misc_feature (91)..(91): Xaa is any aa, unknown, or other
MPLGQRSGDKSDSRYCGVEVLDFPAGEGLPAVLNHSLASAFDFILAPLVDPNYRPAPGAVLPVSASDLVLGPSQWSNHVVXKISEWIDLDXEDEPLRLDSELTLKQEIAWASHVSLQACVIPAPQKIFCRH

SEQ ID NO: 86259 - DNA, 1124 bp, Zea mays
  misc_feature: Ceres CLONE 1572688
  misc_feature (870)..(870): n is a, c, t, g, unknown, or other
  misc_feature (1124)..(1124): n is a, c, t, g, unknown, or other
ccgcggtggcggccgctctagaactagtggatcccccgggctgcaggaattcgtctcacccctagaaaaaatctcggtcctgggtgggtagccgccatcctctcccctatccaagagccgagagctccgctcctgcgccgccctgtactgtctgccgccttttcactccccgtagctagctgctgtcgcggagcaaccccgcgattccaagaaaagcaacttggtcaagaaagagtgcaagaaaggaggacggtgctgacgatgatggcgataagccaccccatgattcgccccatcattccgtcgcctccggggcctgcgcgctagctgctagaagggcctcgccgtccgtcatggtggtggtggtggtggtgtgcgcggggcgggagggccccccccggggaggtgggccccaccgctcttctttccagcacgccccaacgggtgagttgatgtgtctttgagagcgacgccctatactccgcgtatgttgtctcggggggccctcttccctgctcggctgcgccgtagggactctactaatcggccctcccattcccgtcccgcttttcccccgtctctcttactcttctcatattctagcaccttttacccgcctacttcgctggtacgaccctaggcgccttactctacatatgcattttgactgacacgcacgcatacccgcgcagacgcctttttactgagcgcacttctctatcctctgtagcggtctgcctcgcagctcggtctctctgatactttatctgtgcgtgttggtaagtcgcgagtgtgacgctatctcaccgtttcaaacctgcgctcatgccgctgctcgtcgcgggaatagatcgccgtagagtgcagcgnctctgtattcgcggcgttatcgcgtcgtaccgttgtactgtcgtgcgctatcttgtcatcctgtctccgcgcatgtgctttgctatctggacgtcaccagtcgtccactctccctagccgtgtgtcgcctgattctcttgttccaccgcttacgtatattatctccttacccgtcaccacctctgttgttgtccgtcacgctccttgtatgaggtcgcgttctacctcactgcgcatctacacggctctactgn

SEQ ID NO: 86260 - DNA, 886 bp, Zea mays
  misc_feature: Ceres CLONE 1572689
  misc_feature: Encodes the peptide sequence at SEQ ID NO. 86261
  misc_feature (787)..(787): n is a, c, t, g, unknown, or other
  misc_feature (881)..(881): n is a, c, t, g, unknown, or other
acccgcggtggcggccgctctagaactagtggatcccccgggctgcaggaattcgtctcacccctagaaaaagacgctcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaagactggagggaggatgggattgtgagcccagtgaaaaaccagggccactgtggatcatgctggaccttcagcactactggtgcacttgaggctgcatatacccaggcaactggcaagcccatctctctctctgagcaacagcttgttgactgtggtttttgcattcacaatttcggatgcaacggangcccttccatccaggcctttgaatacatcaaatacaatggtggccctgacactgaaggaatcttacccctaccaaggtgtcaatggaatctgcnagttt

SEQ ID NO: 86261 - protein, 242 aa, Zea mays
  misc_feature: Ceres CLONE 1572689
  misc_feature (59)..(115): Pfam Name: Inhibitor_I29 Pfam Description: Cathepsin propeptide inhibitor domain (I29)
  misc_feature (143)..(242): Pfam Name: Peptidase_C1 Pfam Description: Papain family cysteine protease
  misc_feature: SWISSPROT Homolog: EC 3.4.22.16 Cathepsin H
  misc_feature (210)..(210): Xaa is any aa, unknown, or other
  misc_feature (241)..(241): Xaa is any aa, unknown, or other
MAPRRLLVLAVLALAATAAAANSGFADSNPIRPVTDRAASALESTVFAALGRTRDALRFARFAVRYGKSYESAAEVHKRFRIFSESLQLVRSTNRKGLSYRLGINRFADMSWEEFRATRLGAAQNCSATLTGNHRMRAAAVALPETKDWREDGIVSPVKNQGHCGSCWTFSTTGALEAAYTQATGKPISLSEQQLVDCGFCIHNFGCNGXPSIQAFEYIKYNGGPDTEGILPLPRCQWNLXV

SEQ ID NO: 86262 - DNA, 889 bp, Zea mays
  misc_feature: Ceres CLONE 1572691
  misc_feature: Encodes the peptide sequence at SEQ ID NO. 86263
  misc_feature (498)..(498): n is a, c, t, g, unknown, or other
  misc_feature (591)..(591): n is a, c, t, g, unknown, or other
ctccccgcggtggcggccgctctagaactagtggatcccccgggctgcaggaattcgtctcacccctagaaaaaactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcatgaagagtaccctcacgcgccaggcgagacctactccgtcaccctcaccgtgccgggtacctacngcttctactgcgagccgcatcaaggagccggaatggtcggcaagatcaccgtcaactaattaagctagctatcgatcgatatccattcatgtnatagcctgtgcttcctgctttgtactccgccgatctgttcatctctacatggtttcgtcttcaacaacaaacttctgctacgactacgtatttatgcatgctaataagaaactccctcccaatctcggcggctgcctttttgggcctccatttgggcccctgttcccttgaaggttcatctcaccctcaaccctggggtaaagagaagtcccccatcaacatttgggggttttgggccagggcgaacctggcaagtccaccaccccaggaaaccctttcttacaagctgggagggctt

SEQ ID NO: 86263 - protein, 155 aa, Zea mays
  misc_feature: Ceres CLONE 1572691
  misc_feature (59)..(155): Pfam Name: Copper-bind Pfam Description: Copper binding proteins, plastocyanin/azurin family
  misc_feature (137)..(137): Xaa is any aa, unknown, or other
MASLSSAAVTAPSFAAPAPARAVVRRRSFTVRASLRKATGTAAVAMAASALLAGGAMAQEVLLGAGDGGLVFEPSQFTVKAGDTITFKNNAGFPHNVVFDEDEVPSGVDATKISHEEYPHAPGETYSVTLTVPGTYXFYCEPHQGAGMVGKITVN

SEQ ID NO: 86264 - DNA, 969 bp, Zea mays
  misc_feature: Ceres CLONE 1572693
  misc_feature: Encodes the peptide sequence at SEQ ID NO. 86265
ctccccgcggtggcggccgctctagaactagtggatcccccgggctgcaggaattcgtctcacccctagaaaaagactgcgccacacccacaccgcactccgcaccaaccaaccccggccggccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccgggggccgccacatcaagccgctgccggtgccggggccgccgggggccatcgactcctagtacggcgacgcgctcgggggtcgcgctcccagtctccagggtcagaaggcggggaagctggagaacaccagatcccgtggcgtggggactccggcgttgaccgacgggaaggaaacggggctggatctttccaagggaatgtatgatgctggggatccctgaaagtccacttcccgatggcattcccggcaacggtgctcccgggtccggggcgggatacggggaatcaattaacccgggaaaacaaacgggccctgccccccaggcccggaggggaatccgattccccttattgggcccacccttcgaaaagggggcgtgtatccgggggggggacccggatcgggcccaattgtgggggggagggccaaaccatggcccgaaaaaacccccccccaaaaaacaaaaaaacccccgcaaaatttttgtcgtgggaggaaaaacccccggggggccctttaatgggtttaaaacagaaaaaccaccttgtgggtgggttcccccaagacgcaaa

SEQ ID NO: 86265 - protein, 54 aa, Zea mays
  misc_feature: Ceres CLONE 1572693
  misc_feature: SWISSPROT Homolog: EC 3.2.1.4 Cellulase
MGSKYTRGCCGWLIVALIAALVATAAMFAIMKRKPGGRHIKPLPVPGPPGAIDS

SEQ ID NO: 86266 - DNA, 965 bp, Zea mays
  misc_feature: Ceres CLONE 1572697
  misc_feature: Translation starting site: 163
  misc_feature: SWISSPROT Homolog: EC 1.4.1.2 Glutamate dehydrogenase
  misc_feature (906)..(906): n is a, c, t, g, unknown, or other
ggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgactagaaggctaccagtgtccgtgaagagaatgcctcatctttgatcttggaggtggtacctttgatgtctccctcctcaccattgaggaaggtatctttgaggtcaagccacagctggtgacacccatcttggttttgaagacttgaacacatgatggtccaccccttcctccangagttcaggaggaagacaggaaggtatccttgggcacccaagtctctcccgtagctgac

SEQ ID NO: 86267 - DNA, 936 bp, Zea mays
  misc_feature: Ceres CLONE 1572699
  misc_feature: Encodes the peptide sequence at SEQ ID NO. 86268
  misc_feature (832)..(832): n is a, c, t, g, unknown, or other
  misc_feature (878)..(878): n is a, c, t, g, unknown, or other
tccccgcggtggcggccgctctagaactagtggatcccccgggctgcaggaattcgtctcacccctagaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccggcccgaggacagccccacccgcctcctcttcagcgtcggcaagtgcaccgtcaactcggcgccctacggccccctgtggcgtgctctgcgccgcaacttcgtcgccgagatcgtgtccccgcaccgcgtcaagggcttctcctggatccgggagtgggccgtggacgcgcacttgcgccgcctctgcgccgagctcgcggcggacggtgccgtgcgggtcatggccagctgccgcctcaccatctgcagcatcatcatctgcatctgcttctgcagcaagatccccgacgagctcatccgggaggatcgagaggtgctcaaggacntgatgatgatgaccatgcccaagctgccggacttcctgcccctctnaaacgctctttaggagctacctcacgaagaccgagccctgggcgcgcctgctcaatgc

SEQ ID NO: 86268 - protein, 229 aa, Zea mays
  misc_feature: Ceres CLONE 1572699
  misc_feature: SWISSPROT Homolog: EC 1.14.13.68 4-hydroxyphenylacetaldehyde oxime monooxygenase
  misc_feature (211)..(211): Xaa is any aa, unknown, or other
  misc_feature (226)..(226): Xaa is any aa, unknown, or other
MDVNDVLLVVLAAALAAMWWRRCSKTGGVDGLPPGPPGWPVVGNLFQVILQRRPFMYVVRDLREKYGPIFTMRMGQRTLIVVTSAELIHEALVKQGPMFASRPEDSPTRLLFSVGKCTVNSAPYGPLWRALRRNFVAEIVSPHRVKGFSWIREWAVDAHLRRLCAELAADGAVRVMASCRLTICSIIICICFCSKIPDELIREDREVLKDXMMMTMPKLPDFLPLXNAL

SEQ ID NO: 86269 - DNA, 1333 bp, Zea mays
  misc_feature: Ceres CLONE 1572700
  misc_feature: Translation starting site: 264
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
aacgcaggcacaaagtttatataaaccgatccgcctgatttcccctcctataaacnnnccaaactggagctcaccgcggtggcggccgctctacaatagtggatcccccgggctgcaggaattcgtctcacccctagaaaaaaccagagggcacagcgaagacgacgacgtctgcgccacgcgggccggcgtcgcgaacgggcggacgacgacctgcctctagggaagcagcgctgcagcggcgaacaagcatctggccgcgtatggccggattctccgcgaacctagagctcgagaacggacggaactggtctcctggcggaacaggcccgtgcaagtcgttgtcggatacgtcgaagccagagagaaagtggaggctcgccagctgccctggggatcacgcccgtctagcggatgctggacaggatcagcgactccaggtgcgagagggtgacaatagactgcgccccctagacgcgcaggctgttgaagctcaagttagacgacccgagcccgttgatgcagccgatctccggcggcaccgctgctgctgagccacctgtcgcaagaagttgcatcagcttgggggcaatgagtgtcaccctggctagggactgggagcccacgacggctcatcgtaagaagcgtggtgcggggaaaaccctgggcgctggatccccgaaaggagacctaccagagctatcggatggttttctgcgggcccaactagtgcgattccttgcccgaaagcgtggtagcgattccagtggagggatttcacccgcgccatgtgcgggcgcttattgtgtggacttttctgctcccctctccaacgcgatagagggttttgtgttatggcttctgaagagagcaataccagatccccatataaagagtctggagctaagcacgccgcggagtggtgatttgtacagagccttttcgttcctttataaacccccacagtggtgccgacgcgttcaattctctgtgatgccgcaccctctatagagaaacaacacggctctctctcttgtggacaaaaacacgtgaaaaagcgcggtgtcccacagggaaacagggtgtgttgttgatagtagggtctcgtgctatgatgagttctcaatggcgaatggagggaaatatttctctcctctccaggtctcatcaccgcgaaaacaatgagacacccttctaatataaaatcagtggaattatgtgtgcctcacggcttacccgcgtgtatcacaccattttttatacaatatcacagtgatctcacacacgaactatatgtgtccgtactaaaatctacggtaagtgaggtgggacc

SEQ ID NO: 86270 - DNA, 938 bp, Zea mays
  misc_feature: Ceres CLONE 1572701
  misc_feature: Encodes the peptide sequence at SEQ ID NO. 86271
  misc_feature (779)..(779): n is a, c, t, g, unknown, or other
  misc_feature (811)..(811): n is a, c, t, g, unknown, or other
  misc_feature (822)..(822): n is a, c, t, g, unknown, or other
  misc_feature (867)..(867): n is a, c, t, g, unknown, or other
ctccccgcggtggcggccgctctagaactagtggatcccccgggctgcaggaattcgtctcacccctagaaaaaaccacaccagccaatgggtgaacctaaacccccacgccccactcagtccagccgaccagccaccctcaccatgcctcgccgcgcaggagccgcctggccatgcttcctcctgctccacattatcgcccacctacacctcgccgtcaacgccgccgacgccgacgctctgctcaccttcaagtcctccctcgaccgctccgaccgcctcccgtggcgccccgacacggcgcccgctttctgcgcctcctggcccggcgtgcgccagtgcgcccccgccggccgcgtcaccaagctcgtcctcgagggcctcaacctgacgggctccctcaccgccgcgctcctcgccccgctggccgagctgcgggtcctcagcctcaagtccaacgccctcacaggccccatcccggaggccctcccgcgcgcgctcccaaatctcaagctgctgtacctcgccgacaaccgcctccagggccgcgtccccgccaccctcgccatgctccaccgggccaccgtcatcgtcctctccggcaaccgactcacgggccagatcccgccctccctcgccgccctgccacgcctgacctcgctgctcctcgaccgcaacctgctcaccggcgccgtgccgccgctggcgcagcgcacgctcagggcgctcaacgtctcggccaaccgcctgtcgggggagatcccgcgctcgctcgccgncaggttcaacgcctcgtcgttcctcccaatgncgggctctgcngcggctctctagccgtccgctgcgtcgctggtggcccgagaccgnggccgctcaccgcgtccacggaggctttcgcgcccctgccccgccccggaccaaggacgacgcgcaagtaa

SEQ ID NO: 86271 - protein, 229 aa, Zea mays
  misc_feature: Ceres CLONE 1572701
  misc_feature: SWISSPROT Homolog: EC 2.7.11.1 Non-specific serine/threonine protein kinase
  misc_feature (212)..(212): Xaa is any aa, unknown, or other
  misc_feature (223)..(223): Xaa is any aa, unknown, or other
MPRRAGAAWPCFLLLHIIAHLHLAVNAADADALLTFKSSLDRSDRLPWRPDTAPAFCASWPGVRQCAPAGRVTKLVLEGLNLTGSLTAALLAPLAELRVLSLKSNALTGPIPEALPRALPNLKLLYLADNRLQGRVPATLAMLHRATVIVLSGNRLTGQIPPSLAALPRLTSLLLDRNLLTGAVPPLAQRTLRALNVSANRLSGEIPRSLAXRFNASSFLPMXGSAAAL

SEQ ID NO: 86272 - DNA, 917 bp, Zea mays
  misc_feature: Ceres CLONE 1572702
  misc_feature: Encodes the peptide sequence at SEQ ID NO. 86273
ctccccgcggtggcggccgctctagaactagtggatcccccgggctgcaggaattcgtctcacccctagaaaaaatgcaccgcccgctgccgtgcccgccctgccctccaccttctcccggcgcaataaacaagtcgaggcgaggcgaggcggcagcggcggcggcggcattgccgagatttccgtgattcttgcgcttgttagttgtgctgtgtatagttgggccggccgggggtggttccgtacagttccttctctgttggagtagtcggcggcgatgggtatcctcgcgctcatcaccggcaaggcgggcgccagcgggttcgggtcggcgtccacggcggagcatgtcaccgacggcgccgacgccagccgcctcaccgtcgctatcacaggaggagctagtggcattggtctggagacatcaagagtcttcgccctgagaggagcccatgtggtcatcgctgctagaaacacagaggctgcatcagaagcaagaaagaccatcatggagaagaacccaacggcacgtattgatgttctgaagctagacctcagctccctcaagtctgtcagggcttttgtggaacagttcaactcgatgaaactccctctaaacatcctgataaataatgcatgcgtcatgttcttgccttttcaactgtctaaaaacggggtccgagatgcagttcgcgacaaatcatctcggacactttctgcttaacaatctcctccttgataccatgaaagccactgccaagtcctccgggctttgaggggccgctttgtgaacttgttctcagtcggcccccccccttacttttccaaagggaattggcttccataacccccacgattgaggaaatttccacgcccacaatgggcttttgggacagccctagctgggggaacattgc

SEQ ID NO: 86273 - protein, 148 aa, Zea mays
  misc_feature: Ceres CLONE 1572702
  misc_feature: SWISSPROT Homolog: EC 1.3.1.33 Protochlorophyllide reductase
MGILALITGKAGASGFGSASTAEHVTDGADASRLTVAITGGASGIGLETSRVFALRGAHVVIAARNTEAASEARKTIMEKNPTARIDVLKLDLSSLKSVRAFVEQFNSMKLPLNILINNACVMFLPFQLSKNGVRDAVRDKSSRTLSA

SEQ ID NO: 86274 - DNA, 941 bp, Zea mays
  misc_feature: Ceres CLONE 1572705
  misc_feature: Encodes the peptide sequence at SEQ ID NO. 86275
ctccccgcggtggcggccgctctagaactagtggatcccccgggctgcaggaattcgtctcacgcctagaaaaagcctcgtgccctcctcctcctcctcctcccagatctcgtgaccattgccattccctccctccgctacacgccgagcgcccccgtccggaccaggcgtctccgcggctcctagtcctcgctccctccctctcccatggaggactgccgcggggcggctagggagaggagatccgtcggtgctggctgctggttggtcgggtggtcaatccctttccatcggtgtgctggtgcgtgagcatcaaggtttggacatatttggccccgtctgttgcggattggaccgcgactggattgggttcgtgtggctgccgcgtcggcgggtgctgattccagcttgtcccctcccccctagattgcgcgagacggtgcttcacgactgccccctggcgcggaggcacgacaggctcggcggcgcctgcggcgagatgaagggcgcgaccatcccttcggtcgcgatcatgccctcgccgctcttcctctggcggtttaagggtgtgtggttcttctatgggggctttgctgtttgcagattatttgggactcgttatgagactgagtgttaaccccaaaaacttgttcattaggagggtttcctggacaaaaaccctctccccttgggcccttaagaatttggtgaagggaaaaaaaaccgggttttttccccttcctcttggaatttgccaaatggttggatttccacaaaacatttattcccgagaaaattggggggggctcttgtgggaaattttttgtcccccacagggaaaccccccatttcggttccaaggaaaaaggtcccttgagagttcaaccgttccctttggaaattttctaaaaaaccccccccccctagagaggggaaaaccc

SEQ ID NO: 86275 - protein, 33 aa, Zea mays
  misc_feature: Ceres CLONE 1572705
MEDCRGAARERRSVGAGCWLVGWSIPFHRCAGA

SEQ ID NO: 86276 - DNA, 676 bp, Zea mays
  misc_feature: Ceres CLONE 1572706
  misc_feature: Encodes the peptide sequence at SEQ ID NO. 86277
  misc_feature (543)..(543): n is a, c, t, g, unknown, or other
  misc_feature (544)..(544): n is a, c, t, g, unknown, or other
  misc_feature (613)..(613): n is a, c, t, g, unknown, or other
cccgcggtggcggccgctctagactagtggatcccccgggctgcaggaattcgtctcacccctagaaaaaccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaacggcggcgtggagccgtcggggccctgacgcccgtctccgccgggctttctcgggtgcgccgtggggccggcccccctggccgggaaatttccggggagtccggggggaaacccccaaaagtaaagggggcgccccccgggggggacccccaattaaccccctttttttaagccccccgggggggggggggtaccccccgggggggcccaacaacaatattttccccccccggttttatttttcgggattttgggggggggggtgggggggggggcccgccccaaaaaaaagagggtggggggggggggccacccccnnccccctcccctctttttcctatacacacgaccccatgtgtgttgggggtggggattttttttttcttgnacacacaaaataaaaaaaaaaaaactactcttcttgtttctggggggcctcccccacaaaaac

SEQ ID NO: 86277 - protein, 71 aa, Zea mays
  misc_feature: Ceres CLONE 1572706
MAREEQALLSTEIVKRRRGAVGALTPVSAGLSRVRRGAGPPGREISGESGGKPPKVKGAPPGGDPQLTPFF

SEQ ID NO: 86278 - DNA, 949 bp, Zea mays
  misc_feature: Ceres CLONE 1572707
  misc_feature: Encodes the peptide sequence at SEQ ID NO. 86279
  misc_feature (397)..(397): n is a, c, t, g, unknown, or other
  misc_feature (930)..(930): n is a, c, t, g, unknown, or other
ctccccgcggtggcggccgctctagaactagtggatcccccgggctgcaagaattcgtctcacccctagaaaaacgctcacctctcactaccactgcactgttcccggatccatacaagatgcaggctgcatggcgcgcgagctagcttcggtcgagtcgatagatcgatggaatcgctgcaaccatcatggatgcgggaagagcacgcgctgctgtcaacggaatatcgggaacgtcgcactgcagccgacgagctccggacgtccggctcgccggccttctcggtgctcgtgcatccgccgcctggccgactatcctgcatgctgtgaaccttgggtacgtgcgcctcgggtacgactacctcatcagccaccgcctgtacctgaggaccatgcncctgcttcgtgtctgatgtgaggggccgaactaggcagtctcaaacgccaccatctgtggcgcaaagtgtggggggaggtcacgtacgacctcgccgacatgctctccttactcgcagacctcgccttaagcatctacgtctactgtacacgtccaagtgcacgcgcgtgtgcctattctacttcgcatagatacagccggcctgactagctctacgagtaccaaggggacttcatcatcctgatcctcaagtaccgcgagatcaaccatgacggactggcgttccatatcgcaggctgatgccatagccggctatctgcaacaagtcgttcatgctgcgctgcatgttatacccccacgccaactgcccaccatgctagaggtcacagcagagcgtcctggtcgtgatttcggcgacttgacagctgctaatttactaactcgtcgggagcacgaagtgagcgagctggtagtacactgtggcctctcatccgagcaacccctgccgccgtggaagtcacacgacacgagcngggcacgtcggtaactcat

SEQ ID NO: 86279 - protein, 36 aa, Zea mays
  misc_feature: Ceres CLONE 1572707
MLSLLADLALSIYVYCTRPSARACAYSTSHRYSRPD

SEQ ID NO: 86280 - DNA, 951 bp, Zea mays
  misc_feature: Ceres CLONE 1572709
  misc_feature: Encodes the peptide sequence at SEQ ID NO. 86281
  misc_feature (799)..(799): n is a, c, t, g, unknown, or other
  misc_feature (835)..(835): n is a, c, t, g, unknown, or other
acccgcggtggcggccgctctagaactagtggatcccccgggctgcaggaattcgtctcacccctagaaaaagagccgtgtccgcccgcgcgccatcctccccgcgccatgcccatgcgcacgcgcacgcgctccaccccttgagcacgcacgcacgtcgccgccgccacacgcatccgtctccgcctcccgtacgtgtccatggccgccgccacggcggccgggcggctgctcctggccgcggcggcgctcatcctcgcggcggcgtccagcggcgtccccctggcggcggctcaggccaagtcggaggccgatgtcctgagcgagttccgggcgacgctgcgggggccggacccggacggcggcccgccggcggagctgaaccagtgggcgacggggggcgcgccctgcgacggcaacgcgaccagctggcctcgagtgaggaggtgcgtcgatggccgagtggtggtcctgcagctggagggcctccggctgcagggcgccgcgccggacctggccctgctcgcgccgctccggagcctgcgctcgctcagcctgagcaacaacagcctcgcgggcgcgttcccggacgtgtcgccgctccccgcgctcaggttcctcttcctctggcagaacatgctcggcggggagatccccgacggcgcgttcgcggccctcatgtggctccagagggtcgacctctccgggtacgatgtctcctggccgataccatgtctcatcgcgtcctccgccaggctgctggtcgtcaacctcgccaactacacttctccggtccctncctgatgggctcctgagtttagcggcaatgtcagcntcaagggaacaaattctctgcgggacatggtcgcacccggtgccctcgggtcctcgtcgtcctcctcggttcgtcatcgggggcatgaagtactgatacatccccatcgtggtgaa

SEQ ID NO: 86281 - protein, 199 aa, Zea mays
  misc_feature: Ceres CLONE 1572709
MAAATAAGRLLLAAAALILAAASSGVPLAAAQAKSEADVLSEFRATLRGPDPDGGPPAELNQWATGGAPCDGNATSWPRVRRCVDGRVVVLQLEGLRLQGAAPDLALLAPLRSLRSLSLSNNSLAGAFPDVSPLPALRFLFLWQNMLGGEIPDGAFAALMWLQRVDLSGYDVSWPIPCLIASSARLLVVNLANYTSPVP

SEQ ID NO: 86282 - DNA, 909 bp, Zea mays
  misc_feature: Ceres CLONE 1572714
  misc_feature (266)..(266): n is a, c, t, g, unknown, or other
  misc_feature (267)..(267): n is a, c, t, g, unknown, or other
  misc_feature (561)..(561): n is a, c, t, g, unknown, or other
  misc_feature (568)..(568): n is a, c, t, g, unknown, or other
  misc_feature (588)..(588): n is a, c, t, g, unknown, or other
  misc_feature (589)..(589): n is a, c, t, g, unknown, or other
  misc_feature (630)..(630): n is a, c, t, g, unknown, or other
  misc_feature (657)..(657): n is a, c, t, g, unknown, or other
  misc_feature (754)..(754): n is a, c, t, g, unknown, or other
  misc_feature (764)..(764): n is a, c, t, g, unknown, or other
  misc_feature (765)..(765): n is a, c, t, g, unknown, or other
  misc_feature (789)..(789): n is a, c, t, g, unknown, or other
acccgcggtggcggccgctctagaactagtggatcccccgggctgcaggaattcgtctcacccctagaaaaaatcggtgtatcttcgcccccggcgaaggcgctatcctcccgaccacccggcggtgccggtacgccggtaaggcaggttgccagaccccgcgaccccgatcccgatcggtcgctggcgaggcggcgtgacctaccccggctcatcctctcaagccagacggtctggctgctgtgcatccccgttttggcggctannccttacctctgtgcaagggcaatccccccctctacccctggcaagcacgggagaacatggagagtgcttcagatgtacaaatgcacctcctgctgaaaattccaagaacccatttgggatccaaaataccagaaacttgggggtttccccaaaaaaaaaaaaaatttttggggggggggggaaaaaaaagggggggcccctccccccctgtttgaaaaaaaaaaaaatccccccccccgcaaccggggaaaatatttttttaaaaaaaacaacccacccccctttttttttttntctgggngggggaaaacttttgtgaannaaaaaaaaaaaaccccctccgccgcgcgttttttttttggngagaaaaaagaggggggggggggcccnccccccccgcgtggggtgtgggggggacaaaaaaaggggccgggggccctttttttttttttttttttgtttagaaaacccccccacccccccaacncaacaccacnnccttttttttttttttttttcggngtgtgttgggcggcgccccccccccccccggggaaggaaaaaaaaagaaaaaaccacccttttcctcggccgtgttgttgtttttttttgcagcgcgctcgggggggagagaatatatat

SEQ ID NO: 86283 - DNA, 954 bp, Zea mays
  misc_feature: Ceres CLONE 1572715
  misc_feature (517)..(517): n is a, c, t, g, unknown, or other
  misc_feature (789)..(789): n is a, c, t, g, unknown, or other
agctccccgcggtggcggccgctctagaactagtggatcccccgggctgcaggaattcgtctcacccctagaaaaaatcggtgtatcttcgcccccggcgaaggcgctatcctcccgaccacccggcggtgccggtacgccggtaaggcaggttgccagaccccgcgaccccgatcccgatcggtcgctggcgaggcggcgtgacctaccccggctcatcctctcaagccatactgtctggctgctgtgcatccccgttttggcggctaccttacctctggcaaggcaatcccccctcacccctggcaagcacgggagaacatggagagtgcttcagatgtgcaaatgcaacatcatgctgaagattcgaagactacatttgagatcaaaatcagacctggaatccccagacataaattttgccggggaataaaaggggggccgttcccacggttaaaaaaaaaatttggccctggaaacgggaaaattggcctaaaaaacaaccccttgtatttgnccgggggaaaatttttgaaggaaaaaaaaaaccctggggcgggcttaaatgggggaaaaagggggcactcctttaaaccttgtggtgtgaaaacccccggggcaaaaaaagtaatcttttgggaaattgggggggacccaaaattgcacccccctttaatttttgggccctcccccccgggggcccccacatgggggaaaaaaaggggtgtcctctttgggggggggtatatagggtggggccccccgggaaaagagtaaaccccccccccnttttttttgggcgccaataattcccccaaaagagggtggtggtagagaaaaaggcgggaagaatttgtgcgggggtttcaccaaaaatttttttttttgaaaagggggttattttttataattctttcctaacattctcctccccccaaaaaacaaaaattatta

SEQ ID NO: 86284 - DNA, 937 bp, Zea mays
  misc_feature: Ceres CLONE 1572718
  misc_feature: Encodes the peptide sequence at SEQ ID NO. 86285
  misc_feature (937)..(937): n is a, c, t, g, unknown, or other
ctcctcggtggcggccgctctagaactagtggatcccccgggctgcaggaattcgtctcacccctagaaaaaaacacacagtaccgcgacgaggcaatccttccgcctctcgtccacgacgacgctgcgaaggtggcgtccttggattcgggaaacgactttggcctgcagcagaccgccacggtgcttgcgtccctggggtccgacgagatgtcttcgtcgaccacgctcctcgccggctccatatccgaccgctacattccgccgctctacgacgacgactgctacaccatgccacagccgtttgtcgatactctcgccaaccccgacgatgacctcctccaggagctcgacgtgttggacgaggatgccgcgagcgccaacgcggctgaccaccattcaggcgttgtcctcgtctatgcgccgctcgactcgaacatcgacagcagcggatcaccgcgctacccgtgcctccccgagggcgcggtgttgttccatcgggacccgcacgagaaggtctcatcggcgggacggatttgtccggcgaattccgccgcctccctttctcccttgtcgtccccggaccagggggatgaaaccccggcttcgtccccaacaccgacgcaaaagaagaaggaggttctcacccttcacgccaacaaaggggttcgaaaatatacccccaacccgcggattttcttccgtccccaacccgggccctccatcgtggagcccctattccggggaatggaagggaaacaccgtctggaagcaaaggtgaaatcccttcccacctcccaattcgacaaagggccctcttccaaaaagaaccccggtttccccggaacccctcgggtttcgattcagaacttcccctagaagggggggtcccccttatggcggtcccgggtggggggaaactggaatttgtccaagn

SEQ ID NO: 86285 - protein, 292 aa, Zea mays
  misc_feature: Ceres CLONE 1572718
LLGGGRSRTSGSPGLQEFVSPLEKNTQYRDEAILPPLVHDDAAKVASLDSGNDFGLQQTATVLASLGSDEMSSSTTLLAGSISDRYIPPLYDDDCYTMPQPFVDTLANPDDDLLQELDVLDEDAASANAADHHSGVVLVYAPLDSNIDSSGSPRYPCLPEGAVLFHRDPHEKVSSAGRICPANSAASLSPLSSPDQGDETPASSPTPTQKKKEVLTLHANKGVRKYTPNPRIFFRPQPGPSIVEPLFRGMEGKHRLEAKVKSLPTSQFDKGPSSKKNPGFPGTPRVSIQNFP

SEQ ID NO: 86286 - DNA, 706 bp, Zea mays
  misc_feature: Ceres CLONE 1572721
  misc_feature: Encodes the peptide sequence at SEQ ID NO. 86287
tggagctccccgcggtggcggccgctctagaactagtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtctcgccgccccgccaccgttcgtgtaaacgtacggcggcagctgagagtcaacgagagagacgagagaagaaaggaggcatccacagccgccgccatataggggaagaaaaaaagccctataaaaagaggaaaaaaagaaaaaaaagggcggctgcccccggccttccgaaaaaaaaaggaagggcccacccaaaagaaaaaaacccttcccacaaaataaccccccacaccccggggaaccccccttttaaaaaaacaaaaaaacccccccccaaaaaattaaaaaaatttttcccaccccaaaggggtgtccccccccaggggggggtgggggcccccccccccccttaaaaaacccttttaaaaaaaaaggggttcccccaaaaaatatttaaaaacaccaggggtttttttaaaaaaaaaaaaccgggaaattgtgttttaaacaccccccaaatatgcgggcgcgaagaaccca

SEQ ID NO: 86287 - protein, 159 aa, Zea mays
  misc_feature: Ceres CLONE 1572721
MYTLPVRATTSSIVASLATPAPSSSSGSGSGRPRPRLIRNAPVSPPRHRSCKRTAAAESQRERREKKGGIHSRRHIGEEKKPYKKRKKRKKRAAAPGLPKKKGRAHPKEKNPSHKITPHTPGNPPFKKTKKPPPKKLKKFFPPQRGVPPQGGVGAPPPP

SEQ ID NO: 86288 - DNA, 963 bp, Zea mays
  misc_feature: Ceres CLONE 1572723
  misc_feature: Encodes the peptide sequence at SEQ ID NO. 86289
acccgcggtggcggccgctctagaactagtggatcccccgggctgcaggaattcgtctcacccctagaaaaaagctcgctcccctcccgccccactcgtcggctagtcgcctagtccccttcccttccacacgattcggagcagcacgtgcgcgtcaaaccttaccaccaccaccgccatcgtcttgcggctaaattgccttgagacgccgcagcactgcagcagcacagggggggagaaggggcgggcgctcgagtgaacctccactacactactccgcgtctccctcccctggctacgaggctataataacgagcgcggaagacggccggcggcgcacgcagccatgtccgcgcacctccgcctactctcggccgcccacgtctccgcgcccacacccacctccctccaccgcctccgtggccctcctccttctcctcccgcggcccgcctccggctgctgctgcgaccgccgcggctcggggggagccaggcgcgcttcgccggcgccgtccgctgctccggctcggcgtcggcgccggcggtcgcgcgggttggcgatgacagctacgcggcggcgggcatatgggagcaggtgcgggatatcgtcgtgttcgcgagccccgcgctagggctctggatctgcggtccgctcatgagcctcatcgacaccatggtcatcgggcagtacctccgcactccagctcggcggcgctaaggcctggggacagtgtcctgcgatttacctaagctacatattcatgttccctctcgggtcgcaaattccaaaatgggtgcccacctcctttagcccaaaaggatgaagaaccttacccaccttcaggggtcaatgggaacgtgttcttgccctggcctgggggaaaaggaaaggttttttttcacccagagggttgggaccccaagatttgaacggctctttccggactcgggagattttgaaaa

SEQ ID NO: 86289 - protein, 123 aa, Zea mays
  misc_feature: Ceres CLONE 1572723
MSAHLRLLSAAHVSAPTPTSLHRLRGPPPSPPAARLRLLLRPPRLGGSQARFAGAVRCSGSASAPAVARVGDDSYAAAGIWEQVRDIVVFASPALGLWICGPLMSLIDTMVIGQYLRTPARRR

SEQ ID NO: 86290 - DNA, 944 bp, Zea mays
  misc_feature: Ceres CLONE 1572724
  misc_feature: Encodes the peptide sequence at SEQ ID NO. 86291
  misc_feature (861)..(861): n is a, c, t, g, unknown, or other
ctggagctccccgcggtggcggccgctctagaactagtggatcccccgggctgcaggaattcgtctcacccctagaaaaaatcgggcaaaacaagcaaagtgaagaaagctgccggcctgccgctgcctgctcgcagttgccagcccccgccgccgcggaggacggaaggaagcgaatcaaccgcgactgtctccgacgggaataaagcaggcgaggccagccggtcgcggaacccccaattctcagctgcggccggcgatcgagtcggttccgtcccgcgccgatgcggatcccgcggcggaagggcggggccgggccgctcgctgtcggggtgcccagcaggcgggcgcaggtcgccgcggtcttcgcgctcgccgcactgctgggggtctccgtgctctacgacaacgcccacatcgccgcctcgctgcggaggcacggcggcccgaggacgtacgccaagctctcctccttcgaaggcgccaccgctgtccccagcatcgccaaggaagaggcggcggcggcggtggcgcgggcaacggagtcggtgccggtgcacggcgcggatcgggccgactcgcccccgcacgagcggcaggaggagatcgaggagcgcgcatcgaagcctggagcgacggccgggagctccctgcaggacgcgccgctaatcgaggaggtggtgcaaggaggaagcggaggccacgacggcgactgcggcgcgcatgcgcatgagcagcccccggccccgggggactgcgacctgtacatgggcgctgggtgtacgacgagtcccgcgcgccgctgtacaggagtccgactgcagcttcctcacggagcagggtcactgtatgcggcacggncgacgcgacgacgactatcataaatggcgcgtgcagcccgtacgctgccatctcccagatttgaagctagttgcctctggaga

SEQ ID NO: 86291 - protein, 199 aa, Zea mays
  misc_feature: Ceres CLONE 1572724
  misc_feature (193)..(193): Xaa is any aa, unknown, or other
MRIPRRKGGAGPLAVGVPSRRAQVAAVFALAALLGVSVLYDNAHIAASLRRHGGPRTYAKLSSFEGATAVPSIAKEEAAAAVARATESVPVHGADRADSPPHERQEEIEERASKPGATAGSSLQDAPLIEEVVQGGSGGHDGDCGAHAHEQPPAPGDCDLYMGAGCTTSPARRCTGVRLQLPHGAGSLYAARXTRRRLS

SEQ ID NO: 86292 - DNA, 945 bp, Zea mays
  misc_feature: Ceres CLONE 1572725
  misc_feature: Encodes the peptide sequence at SEQ ID NO. 86293
aaactggagctccccgcggtggcggccgctctagaactagtggatcccccgggctgcaggaattcgtctcacccctagaaaaaacttccaccccggaccgacaaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacggggagcgccaacgacctctacgagtcggcgcagctctacctcagcgcgcgctgcctcgccaccgcgcccgccgtgcgcctgcacaagccgcgccagtcgccgcgccccgtggcgtcgctcccggactcgcacaccaccgacgacaccttccgcggggtccgcgtcaagtggacctccaccacgcgcaccgtcgaccgcagcggcagcggcggcagcggtaacccgtacaacatattcggccgcggcagcgaccagcgcggcctcgagctccagttcccgcgccagcaccgggacctcgtccaccaccactacataccgcacctcatcgacgaggccacccggatgcggctcaagtcacgggagcgccgcctctacaccaaacgcgccacagggccctgcgacgaccaacaccgcctctggacgtctgacgcagtagcgcaacctgtcacgttcgacacgctggggctcgacctgcgcctgcgcgaacagtccacgactacctgatgcgcttcgcgcgcgccaggacactacctccgcgtctgcacgccttgtagccgggtacagt

SEQ ID NO: 86293 - protein, 230 aa, Zea mays
  misc_feature: Ceres CLONE 1572725
MEMVLDWRSLGSLLATVVVFRTALRNFLPPEAEMLLRRFLAWVAAAFRPPSDTILIDEADGPTGSANDLYESAQLYLSARCLATAPAVRLHKPRQSPRPVASLPDSHTTDDTFRGVRVKWTSTTRTVDRSGSGGSGNPYNIFGRGSDQRGLELQFPRQHRDLVHHHYIPHLIDEATRMRLKSRERRLYTKRATGPCDDQHRLWTSDAVAQPVTFDTLGLDLRLREQSTTT

SEQ ID NO: 86294 - DNA, 848 bp, Zea mays
  misc_feature: Ceres CLONE 1572726
  misc_feature: Encodes the peptide sequence at SEQ ID NO. 86295
  misc_feature (564)..(564): n is a, c, t, g, unknown, or other
ctccccgcggtggcggccgctctagaactagtggatcccccgggctgcaggaattcgtctcacccctagaaaaaaaaacgcaacccctctcgctctcaagcttgcaaaatcccactagcgaaaggaaaacgggagaagctaggaagcagcagccgcggcatttcttccttgagcgttcgccttcggctgctcaacgcgtgcttcgtttcaggagagccttggtggcatctctgtttcatggccgagatctgctgtgaggcggcagctgcagcggcggggtcagaccagaatggggagtgcgccggcagccgcgcagctcgactgcggaggatggagattcagcggctcatggtggtggccgaggaggcgtccgccaagaggcggaggctggaggcggatgacgaagacgcggttggtgggcgagcgccaaggtacggcgtgacgtctgtctgcgggcggcggagagacatggaggacgcggtgaccgcccgtacggagttcatcaacggccaccacttcatccgggtgttcgacggccacggctgctcacatgtggcgacctcntgcgggggagcgatgcacaaactggtggcctaggaggcacagctgccccagcttgtcgatttcgaacaaaccgccggtgggagggggtctggaaaagtcccagatttgtttttcccccccccggttttttccccccgtaaattccccgcccaggcgcttaaaaccgctgttgggcaaaaattttgggcaaaagggccccatttggggcttttcaaaaaaagggtttaaccggaaccgggggacccctccacgccgagggggccccccggtgggggggaaacccc

SEQ ID NO: 86295 - protein, 119 aa, Zea mays
  misc_feature: Ceres CLONE 1572726
  misc_feature: SWISSPROT Homolog: EC 3.1.3.16 Phosphoprotein phosphatase
MAEICCEAAAAAAGSDQNGECAGSRAARLRRMEIQRLMVVAEEASAKRRRLEADDEDAVGGRAPRYGVTSVCGRRRDMEDAVTARTEFINGHHFIRVFDGHGCSHVATSCGGAMHKLVA

SEQ ID NO: 86296 - DNA, 788 bp, Zea mays
  misc_feature: Ceres CLONE 1572727
gttttgtacttaatatttaaatagttagtcgccgcggcattttgtataaatttagtgatagttgtgtgggtctttctttttcaaagctggaactccccgcggggcggccgctctaaactagtggatcccccgggctgcaggaattcgtctcacccctagaaaaactctcgaaaccctagtcccctgctccattctcagccgccgccaatcccttcccgtgctccgcaaccgctgagtgagaagaagagatggcccggcaagggcgatggcccggctatcggcatcgatctcgggcacgacgtactcttgcgtccggcttgtggcaacaccaaccgccgtccaaaaatcattggccaacgaaccaggggggtaaacgggtaaccaaagccccctttggttaacgttccgcccttttcaacccgaaaattccccaaaagagggccccccctcaattccggggaaaaaaaaatgggcggggggccccccaaatgaaaaaaccccccttggggttttttatctccccccttttttgtgaaaacaacccccccccccatttttctcaaaaaaaaacaccccccgggggggcccctttttttttgaaaaaaaacccccccccaaagagggggggtgtttttctttaataacccccccccccccccccacaaaaaaaaggtttttcccccacatttttgtaaaaaattggccgctcttttttttggtttcccccccaaaaaaaagggggataatatttccccaccaatttttttttttggggccccccccctttt

SEQ ID NO: 86297 - DNA, 729 bp, Zea mays
  misc_feature: Ceres CLONE 1572728
  misc_feature: SWISSPROT Homolog: EC 2.7.7.6 DNA-directed RNA polymerase
  misc_feature (204)..(204): n is a, c, t, g, unknown, or other
ctccccgcggtggcggccgctctagaactagtggatcccccgggctgcaggaattcgtctccccctagaaaaaatcaggcccacgctttgttaacaaagaattccctcatagccgccgccgccgccgccgccgccgccgccgctcatctcgccgagaggtgacgggaccgaggaactcgccgagttctaagatagagaatcgcnttttcacagcctgtggtctgctgcgtagggtggtgttgaagggggagaagtttaagatctgttccacagatcacgccgtggcgccgctcccccaaattcggggggggttcccaaaaaaaaaaccctccgcccgggttttggaatttttggaggccccccaattggggggggctttttagggggggggggaaaaaaaaaatttctttcccccattttgtgccggcttcccccccgggggtgtttggaaaaaccccccccccctgggggggtctcaaaaattttttgtgggggaaatttttttatcccccccccggggggggggggggggacaaaaaaaaaaaattcctccccccccccgcggggtgggtgtttttttttttccccccccacctgtgggggggagaaaaaaaaaaaaaaaacccccccccccccgccggggggaaggaatcaaccccccctctttttttgtgggggggggggggcggcccccccccccccccctcgcttaaatcatggatgtgtagg

SEQ ID NO: 86298 - DNA, 874 bp, Zea mays
  misc_feature: Ceres CLONE 1572729
ccccgcggtggcggccgctctagaatagtggatcccccgggctgcaggaattcgtctcacccctagaaaaaaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaacaatgtaggcaagggaagtcggcaaaacggatccgtaacttcgggaaaaggattggctctgagggttgggctcgggggtcccggccccgaacccgtcggctgctggcggaatgctcgagctgctcgcgcggcgagagcgggccgccgcgtgccggccgggggacggaccgggaacggccccctcgggggccttccccgggcgtcgaacaaccgactcagaactggtacggacaaggggaatccgactgtttaattaaaacaaagcattgcgacggtcctcgaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaacacaggccaaggaacgggctttggcggatcagccggggaaaaagaacctgtggagctgaacctagtccgaatttggaaatgacttgaaaagggtaggaataagggggaacccccgggcccaggaaaaaccccccctttttacgtttttttctttttccccgggggaaaaaaggggcacccccccccttttttttt

SEQ ID NO: 86299 - DNA, 952 bp, Zea mays
  misc_feature: Ceres CLONE 1572730
  misc_feature: Encodes the peptide sequence at SEQ ID NO. 86300
  misc_feature (551)..(551): n is a, c, t, g, unknown, or other
ggcggccgctctagaactagtggatcccccgggctgcaggaattcgtctcacccctagaaaaatagtgcgcgcctcgtgctcgtgctcccccgagcagactagaccagcgcgctagcgccagcaaggccaaggcgagggaggggcgatgctcgcccgatctgctacagccgccgccgccgccgggatctgactgtgattaaggatgtcggcgtcgcggagcgggaggatcaggcgggccgggagcgtggcgctcggggactttctgcggcgggaggcgtcggcggagcgggccgcgttgggaggcggcgagcggccctcggtcgcggcggggcaggcctgccgggcgaagaagggcgaggacttcgcgctgctcaagcccgcctgcgagcgacgccccggcgcgccgtccacctccttctccgccttcgccctgttcgatgggcataacgggagcgccgcagcggtgtacgccgaggagcaccctcctcgcaacgtgctcggctgcgtcccggccgatctgagcaaggacgactggctcgccgcgctcccnagggcgctcgtcgccggggttcgtcaagaccgaccaaggatttccaaactaaagctcattccctcggggacaaccgtgacacttggccatatttgatggctcccttggaaccgttggcgccccgtggggaattcccgttggggccttgaagcccgcgggacccttctaccattttgtcggggaaccccccttttgaccctataaaaaaggaggtggaacttgtaacccaatgccgaagggaaaatgaaaggccaaaattttcccgggggggcaaaaatgcccccccttatatttggcccagggggctatcccccccaaacatttggggcccccaccgcgggggatttttcctcccgggccctttgggagaaataaaggctcacccggggagcgcctttttt

SEQ ID NO: 86300 - protein, 147 aa, Zea mays
  misc_feature: Ceres CLONE 1572730
MSASRSGRIRRAGSVALGDFLRREASAERAALGGGERPSVAAGQACRAKKGEDFALLKPACERRPGAPSTSFSAFALFDGHNGSAAAVYAEEHPPRNVLGCVPADLSKDDWLAALPRALVAGVRQDRPRISKLKLIPSGTTVTLGHI

SEQ ID NO: 86301 - DNA, 971 bp, Zea mays
  misc_feature: Ceres CLONE 1572732
  misc_feature: Encodes the peptide sequence at SEQ ID NO. 86302
ctccccgcggtggcggccgctctagaactagtggatcccccgggctgcaggaattcgtctcacccctagaaaaagtccgcagacccctctcgatcgacgcacgcagccgcgagccatcgcgacctgacccgaccctcccgaggccgccagccttatcctctccgcctccgcctcccgccgtcccccgcgacccatcgcaagcgcgagtagaagacatggcctcgacgttcggggccacttctacagttggccttatggctgctccaacggggaagaatgtgcgccttcagaggagggctgacttcagagtaaaagcggctaaggagctgtacttcaacaaggatgggtcagctatcaagaagctgcagactggagtcaataagcttgcagacctacacggagttacactcggtacgaagggaacgaatcgtcgtttcgtagagcaagtacggctctcccaagattgataacgatggccgtaacagtgacaagatacggttgagctggaagaccccgggaaaaaaaaatggaacctaactgggccaaggaaaggtgcaacttaaaccaaaggattcttgcctggaaagggggacacccacccccggtgggggccctgcgccagggggcggatttgggtaagggtgtttaagggggcaaaaaagttgggggggaaaaaacattccaaaaaaacaccgggggtttggaaaaaaagggtaaaacacaatggttgaaaaaaacccgggaatttgtcttcgggggggggaaaaaaaaggacctctgcaaaatttctctcgagttttggggcggggaacccccaaaaaattggtacactctagccccacccccataaacccgcgggtggaaagggcgtcttccccccctcaagagagagaaaaatctcaagaaaattcctctttgggggagggaggaaaaataatccccggggactccccccccttttttataagaaa

SEQ ID NO: 86302 - protein, 83 aa, Zea mays
  misc_feature: Ceres CLONE 1572732
MASTFGATSTVGLMAAPTGKNVRLQRRADFRVKAAKELYFNKDGSAIKKLQTGVNKLADLHGVTLGTKGTNRRFVEQVRLSQD

SEQ ID NO: 86303 - DNA, 900 bp, Zea mays
  misc_feature: Ceres CLONE 1572734
  misc_feature: Encodes the peptide sequence at SEQ ID NO. 86304
  misc_feature (900)..(900): n is a, c, t, g, unknown, or other
ctcagaactagtggatcccccgggctgcaggaattcgtctcacccctagaaaaaactcctccctcccctcctctgctttccccccatttcgcgtctcggggtttggaccagccacccggcggaggcggccgggcagactgggccgagcgaccggagcgccgccgccatcggcaaagccacgggacggcccatggagtcgcgagcgctcctgcacgcccggcccgccgccctccctcaccgcgccggcctgcgcctccatctcccgctcctgcgcccgcgggcagtctcccgctcccactccgccaagcccgcgctccagtccccgctcctcgcgtcgaggggccccttccttcaacggcacgatgcggttctggccaacgggttcgtgaaacggagagcggccagcgctggcggtgatgtgtccttccgcgcccaggcggcggcctcggcggcggtgccggcgccgcagccggaggagtccacaaaaaagctccttggcatcgacgtgaagacgctcaagaagatcgtgccgttggggctcatgttcttctgcatcctcttcaactacaccatcctgcgggacaccaaggacgtgctggtggtcactgccaaggtgagcagcgccgagatcatcccttttctccagacctgggtttacctgccatgggcatcggtttcatgctcctgtacaccaagtttccaacggtctctcacgggatgcgctccttcaaacgtcatcttcccggtcatcgccttcttgggggccttccccttttggcttacccgttaagggaggtcttcctcctacggggtccgggataaactctcgccggctcggtccgagcttctgggtccgggggaaacggaggattgaacctccgctgtccatgtaaggcgacn

SEQ ID NO: 86304 - protein, 199 aa, Zea mays
  misc_feature: Ceres CLONE 1572734
MESRALLHARPAALPHRAGLRLHLPLLRPRAVSRSHSAKPALQSPLLASRGPFLQRHDAVLANGFVKRRAASAGGDVSFRAQAAASAAVPAPQPEESTKKLLGIDVKTLKKIVPLGLMFFCILFNYTILRDTKDVLVVTAKVSSAEIIPFLQTWVYLPWASVSCSCTPSFQRSLTGCAPSNVIFPVIAFLGAFPFWLTR

SEQ ID NO: 86305 - DNA, 945 bp, Zea mays
  misc_feature: Ceres CLONE 1572735
  misc_feature: Encodes the peptide sequence at SEQ ID NO. 86306
ctggagctccccgcggtggcggccgctctaaaattagtggatgcctctggctgcatgaatttgtctcacctctagaaaaaagtcctccttccgctcctctgcttttccctcatttcgcgtctcgtggtttggaccgaccatgccgtcgaatccgtcggggagactggggctagccacaggaacgccgccgccttccgcaaagccacgtgacggaccatggagtggtgagcgctcctggacgtccgggccgccgccctccactgatcgcgccggcctgatcctccatctctctctcctgcgccggagggctgtctcccatctcccacttctacaagcccaaggtcctgtccccgctcctctagtcgaggggccccttccttctatggctggatgcgggtcccgccaacatgctcgtgtaatggacagcggccatcgctgacggtgatgtgtccttcctcgactagtgggaggccttcgctgcggtgccagtcgcgcacccagtagagtcatgaaagagatccttggcatggacatggagacgctcgagaatatcgcgcctttggagatcatgttcttctgcattctcttgattacaccctgctgcttgacaccaaagacctgctgggtggcagtgtaatggtgaccactccgatattctgcctttgctcaataactgggttaacctgaccataggcctacatggtttgattcctgggggcaatgttttcaaaactttgctttcgggattcggtacttctttcccgcataatgggaatttaaggccatttcttggagccgtatgaaattgtggccctcccccttcgggaaggtgcttgggttaacccccgcccggtaaaatttttatggagggccccaaaagattttcctttgggccggggaaaaacggggggattagagcctcccccttttcttatgtaaaagaca

SEQ ID NO: 86306 - protein, 42 aa, Zea mays
  misc_feature: Ceres CLONE 1572735
MKEILGMDMETLENIAPLEIMFFCILLITPCCLTPKTCWVAV

SEQ ID NO: 86307 - DNA, 978 bp, Zea mays
  misc_feature: Ceres CLONE 1572736
  misc_feature: Translation starting site: 765
tccccgcggtggcggccgctctagaactagtggatcccccgggctgcaggaattcgtctcacccctagaaaaaacctgtcgttgctctccgccgccaccagtgcccgtagcgctcgccgccgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccggcctcgccgtccgcttcctcgtgccgcggccggccgaagtacccccagaagcctggcagctcctctccatcttcctctccaccatcgcgggggctcgtcctcgggccgctcccccgtcgggggcgggggcgttccttggggctcacagccaccggtggccacccggacggtcccccttaacgccggcgttcgggggcgttccctaacgaaaggcatctgggctcatcgttaatatccttctttcttcgcgcccgggttttgtcaaaaacgagaatcggggaacccggtggcccacctaacttggttaaaagggcgggggcggcaacactttggggcccttccctatgggtgtgcgccttcgggaaggttttattccccccggcgtaggcccaaaaccacgggcgaggggggggagggtgttttccttccccttcgaaaagcgcattcgcctcctccccggagaaaaaccacccaatcccccgggaaagaaaccggcgcctttttggtggaaacccagttaagggggggtggaaaccaaggtgtctttttatgaagaag

SEQ ID NO: 86308 - DNA, 947 bp, Zea mays
  misc_feature: Ceres CLONE 1572740
  misc_feature: Encodes the peptide sequence at SEQ ID NO. 86309
  misc_feature (660)..(660): n is a, c, t, g, unknown, or other
  misc_feature (674)..(674): n is a, c, t, g, unknown, or other
  misc_feature (675)..(675): n is a, c, t, g, unknown, or other
ctccccgcggtggcggccgctctagaactagtggatcccccgggctgcaggaattcgtctcacccctagaaaaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaaggaggggagaagatgtagttcacccacttaaagtttctctggaagatctttacaatggcacctcaaagaagctctctctttcgcgcaatgtcatctgctccaagtgcaagggcaagggctcgaagtctggtgcctcaatgaggtgccctggttgccagggctcaggcatgaaagtcactattcgtcagctgggcccttccatgatacagcagatgcagcagcctttgcatgagtgcaaggggactggagagagcatcaatgagaaggaccgctgtccagggtgcaagggtgagaaggtcatttcaagagagaaggtcttgaggttcatngtgagaaggggatnngcacacacccgaagatcaccttccctggtgaagctgatgaagcgcctgatactgccacgggaaacatgggattcggtcctccgccgaaggatcccccaaaattcaaagaaaggggaagatcccttctttgaacccccctgtctttaacgaaagccattgggggtccaatttgtttttacacattggaaaaaggaggtttccttaaaaaaaacctgggaaggtttttacccgcccattcaggcattttatgggggggggccatttccagaggc

SEQ ID NO: 86309 - protein, 197 aa, Zea mays
  misc_feature: Ceres CLONE 1572740
  misc_feature (54)..(140): Pfam Name: DnaJ_CXXCXGXG Pfam Description: DnaJ central domain (4 repeats)
  misc_feature (144)..(144): Xaa is any aa, unknown, or other
  misc_feature (149)..(149): Xaa is any aa, unknown, or other
MGGGGSHVDPFDIFSSFFGPSFGGGGGSSRGRRQRRGEDVVHPLKVSLEDLYNGTSKKLSLSRNVICSKCKGKGSKSGASMRCPGCQGSGMKVTIRQLGPSMIQQMQQPLHECKGTGESINEKDRCPGCKGEKVISREKVLRFXVRRGXAHTRRSPSLVKLMKRLILPRETWDSVLRRRIPQNSKKGEDPFFEPPCL

SEQ ID NO: 86310 - DNA, 944 bp, Zea mays
  misc_feature: Ceres CLONE 1572741
  misc_feature: Encodes the peptide sequence at SEQ ID NO. 86311
  misc_feature (384)..(384): n is a, c, t, g, unknown, or other
  misc_feature (760)..(760): n is a, c, t, g, unknown, or other
  misc_feature (868)..(868): n is a, c, t, g, unknown, or other
ctggagctccaccgcggtggcggccgctctagaactagtggatcccccgggctgcaggaattcgtctcacccctagaaaaaggacgtctgcctgtccatttcggcgtctgttcttagcggccgacaagcggaatctggatcaagtcccctgcttcaacccatcccctctcatcgattcattgccacaaggcagctgattgctcacagcgttggatgtgagaattggattcggacccaccgatcgatatgccgttcggccacacgcggctcgatgtccggcgtccgccgcagtcgtcctacctctgctgctccacaaccaccgtcgccgtattcgtcgcgctctgcctggtggctgtgtggatggcgtcgtccatgctcgtcacncctgccgagttccctccatttcagtccaaagtgcgtccactgaggcctcatgactctcctcctgccaccggaagcttaaccagtgctgatcagggcgatggcatcaccacgcatgatgatccaccacctgctacacaacaattgcctcctgtaacagacagcatggatggtgaaaatcagcaacaagaacttttcactacagagcgcggaccatggtgcaacaaggctgaaacatctaacaaggacgctaaagagcaaaccttgacgtccagtagcccactgagctcccgttgggcgttatgcaacgtcgatgctggagcagaatatattccatgcctcgacaacgtagcagctatcaagaagctccgttccaccnagcactacgaacacccgagaaagcatttgcccgagaaatctcctacctgccttggtcctctaccaaaagggtacagaaatcaatttaggtggccaaagagcaagatcngaaatgggacaataacgtccctcatactaagctggttgaatcaaggaaacacaaaactgggtaaagtttccggaaa

SEQ ID NO: 86311 - protein, 232 aa, Zea mays
  misc_feature: Ceres CLONE 1572741
  misc_feature (172)..(172): Xaa is any aa, unknown, or other
  misc_feature (208)..(208): Xaa is any aa, unknown, or other
MPFGHTRLDVRRPPQSSYLCCSTTTVAVFVALCLVAVWMASSMLVTPAEFPPFQSKVRPLRPHDSPPATGSLTSADQGDGITTHDDPPPATQQLPPVTDSMDGENQQQELFTTERGPWCNKAETSNKDAKEQTLTSSSPLSSRWALCNVDAGAEYIPCLDNVAAIKKLRSTXHYEHPRKHLPEKSPTCLGPLPKGYRNQFRWPKSKIXNGTITSLILSWLNQGNTKLGKVSG

SEQ ID NO: 86312 - DNA, 936 bp, Zea mays
  misc_feature: Ceres CLONE 1572742
  misc_feature: Encodes the peptide sequence at SEQ ID NO. 86313
  misc_feature (622)..(622): n is a, c, t, g, unknown, or other
  misc_feature (760)..(760): n is a, c, t, g, unknown, or other
ctccccgcggtggcggccgctctagaactagtggatcccccgggctgcaggaattcgtctcacccctagaaaaaaaccaacctcctctgcctgccgcttctcctgctgcgggcgggcactgctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgccgcgcaggacagtgcctgcagatgggatgcacaggctgttgccaggtgtccttcagaggttcagcactgcagcagcagtagaggagcccatcacgccgtcagtccatgtgaactacacaaagctcctcattaatgggaactttgttgattccgcatccggcaagaccttcccaactctggaccctcgtacaggggaggtgattgctcatgtggctgagggtgacgcagaggacattaaccgtgcagtagctgcggctcgcaaagcttttgatgaagggccatggccgaagatgactgcctatgagnagtcccgtatcctactgcggtttgctgatttgatagagaaagcacatgacgagcttgctgctttggaaacatggggacacgggaagccatatgaggcagcagcccagatgaagtacccatgggtggccgtcttatgcntaactattgctggtgggcctgataaatacctggctcattgtgccggcggatgccccaaccatgtacgatcttgctgaaccaattggggttcaggtcaaaatcccctggacctcccccttccaatttgccggaaaatggccctgcctggctgtggaataccccgggccaaatgggga

SEQ ID NO: 86313 - protein, 202 aa, Zea mays
  misc_feature: Ceres CLONE 1572742
  misc_feature: SWISSPROT Homolog: EC 1.2.1.3 Aldehyde dehydrogenase (NAD(+))
  misc_feature (132)..(132): Xaa is any aa, unknown, or other
  misc_feature (178)..(178): Xaa is any aa, unknown, or other
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYEXSRILLRFADLIEKAHDELAALETWGHGKPYEAAAQMKYPWVAVLCXTIAGGPDKYLAHCAGGCPNHVRSC

SEQ ID NO: 86314 - DNA, 961 bp, Zea mays
  misc_feature: Ceres CLONE 1572743
  misc_feature: Encodes the peptide sequence at SEQ ID NO. 86315
  misc_feature (961)..(961): n is a, c, t, g, unknown, or other
ctccccgcggtggcggccgctctagaactagtggatcccccgggctgcaggaattcgtctcacccctagaaaaagtgccacacatccatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcacgaccccgacagcaaggtggcctgcgagacctgcaccaagacaaacatggtgatggtgttcggcgagatcaccaccaaggcgagcgtggactacgagaagatcgtgcgcgacacctgccgcgagatcgggttcacctccgacgacgtggggctcgacgccgaccgctgcaaggtgctggtgaacatcgagcagcagtcccccgacatctctcaaggcgtgcacaggcacttcaataagcggcccgaggagatcggcgccggcgaccagggccacatgttcaggtacgccaccgacgagaccccccgagctgatgccgctgagccacgtgctggccaccaagcgtcgcgcgcgcctgacggaggtccgcaaagacggcacctgcgcctggctaaggcccgactgcaagaaccatgtgaccggggagtacatgaaacaagggcggccgccttggtgcccgtccggggtgggacaccgtgtttctcttcccccggcgggaggagatcgtcaccaacgaacgagttcgccgcccaacctctaagaacccgttcattaaaccccttatccccggaaaagttactgggacaaaaaaaacattttcccccggaaacccgccggggggctttttccatcggagggccccaccgggaaccccggcctcaccagcccccaaattctn

SEQ ID NO: 86315 - protein, 261 aa, Zea mays
  misc_feature: Ceres CLONE 1572743
  misc_feature (4)..(103): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
MAAESFLFTSESVNEGHPDKLCDQVSDAVLDACLAHDPDSKVACETCTKTNMVMVFGEITTKASVDYEKIVRDTCREIGFTSDDVGLDADRCKVLVNIEQQSPDISQGVHRHFNKRPEEIGAGDQGHMFRYATDETPRADAAEPRAGHQASRAPDGGPQRRHLRLAKARLQEPCDRGVHETRAAALVPVRGGTPCFSSPGGRRSSPTNEFAAQPLRTRSLNPLSPEKLLGQKKHFPPETRRGAFSIGGPHREPRPHQPPNS

SEQ ID NO: 86316 - DNA, 922 bp, Zea mays
  misc_feature: Ceres CLONE 1572744
  misc_feature: Encodes the peptide sequence at SEQ ID NO. 86317
aaaagctggagctccccgcggtggcggccgctctagaactagtggatcccccgggctgcaggaattcgtctcacccctagaaaaaacattcccatcggcgcagacggccgggaggaggatgtccatgccggagacgttcaccctgaaggtgggggaggcgacgccggccgccgccggcaggccgtcggccgggcccgtgtaccggagcatctacgccaaggacggcctcatggacctcccacaggacatccagtccccttgggacttgttcagtggggcagtcaagaagtaccccacgaacaggatggtcgggcagcgtcaggttacagatggcaaggccggtgagtatgtgtggcaaacgtacgaggaagtgtgccagaaggtcatgaggattggatcagcgatcagaagcctgggcgtagagccgggagctcactgtggcatatatggatccaactgcccggaatgggttatggccatgcaggcatgtaacagtcaagggatatgttatgtgccactgtatgacaccctcggagctaaagctgttgaattcatcatgtaccatgctgagatatccattgcctttgtccaggagagcaagatcaaatcaatactagcagttctccctaagtgcacagcgcaccttagagccattgttagtttcggagatttttgcagcgagatgaaagcggaagctgagagattgggcgtctcctgcttttcttgggaagagttttcttccatgggaaaacaagactacccacttcccaataaacgtaaggaagatatctgtacaatcatgtttaccagcgggacaactggagatcccacaagggtgataatcccaaacaaagctttcgttgctgggtatgaccacagacacctctcaaagggacgataaagtgtcccagaaaggattcta

SEQ ID NO: 86317 - protein, 258 aa, Zea mays
  misc_feature: Ceres CLONE 1572744
  misc_feature: SWISSPROT Homolog: EC 6.2.1.3 Long-chain-fatty-acid--CoA ligase
MPETFTLKVGEATPAAAGRPSAGPVYRSIYAKDGLMDLPQDIQSPWDLFSGAVKKYPTNRMVGQRQVTDGKAGEYVWQTYEEVCQKVMRIGSAIRSLGVEPGAHCGIYGSNCPEWVMAMQACNSQGICYVPLYDTLGAKAVEFIMYHAEISIAFVQESKIKSILAVLPKCTAHLRAIVSFGDFCSEMKAEAERLGVSCFSWEEFSSMGKQDYPLPNKRKEDICTIMFTSGTTGDPTRVIIPNKAFVAGYDHRHLSKGR

SEQ ID NO: 86318 - DNA, 977 bp, Zea mays
  misc_feature: Ceres CLONE 1572746
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaaaaaaggaggaaggaaattttgcttcaattgggcgtcgttgagctaggcccctcctccagctcttgatccggtccatggggctctgccttggcaagccgacgcaaatcccggaggctgaggcggaggaggatcccctcgtagcctccggcgcgggcgacggcggggacggggcgacctcgccgtcggcagcggcgcccgctgcgaagccaggcacgcctaaacagcccaagttcccgttctacctgccgagcccgctcccgccgtccagctacaagggctcgtcggcaaactcgagcgtctcgtccaccccggcgcgcggccggctcaagcgcccgttcccgccgccgtcgcctgccaagcacatccgcgctctactcgcgcggcggcacggctcggtctagcccaacgaggtgcccattcccgagggctgcgagccggagctcggcctggacaagagcttcggcttctcctagcacttcttcaccaagtacgacctcggccaggagatcggccgcggccacttcggctacaccgtgctccgcccaggccaagaagggcgagcactatggccaggacttctccgtcaaaagttacccccaaggccaagatgaacaacgccttcgcccattaaaaagttgaaaacagaagtgaaaataccgagttcccggggaggccacagttacccaatggccgttctacaatgccttttaggaatgagaatacccggttattagttatggaattatgttaagggaggcaaacgctgagaccggaaattggccaaggggttggaaaatccccgaaggaaaacgcaaaggtgttaatgggaaaaaatttggggggcggaatcctttgacaccctccaggtttcggtttcggggattcgtacccaaagatatccct

SEQ ID NO: 86319 - DNA, 929 bp, Zea mays
  misc_feature: Ceres CLONE 1572748
  misc_feature: Encodes the peptide sequence at SEQ ID NO. 86320
cccgcggtggcggccgctctagaactagtggatcccccgggctgcaggaattcgtctcacccctagaaaaagcctctcgccatttttactcgtcggctggtccggccccagcgattcggtttggtgcgcctcgtggtccacgtgcgcgggctttgtgctctctcttccctctgtgtgtgtgtcagttcgtcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctttcgcggaagcacgtgcgggcgccgctctgcgcagggtgcgccgcgcgcccggccgccgcgcgcgtctccctcggcgccgacccggcgttcctctgcgcggactgctgcgagggctgcgccgccgcttccgcggcgcgcgtgtcggttgagggcttctcggggtgcccctcggcggccgagctcgccgcgtcatgggggctcgacctccgccgcgcggccgtggccgtgggcgacgacggcgacggcggcgacgacgacgaccccttcctctcggtgctcgactactccgtgctgggggtgggggtggccgacacggacctgcgcgacctctacgtgccgtgcgacccaccgcgggtgcccgtccccgacgccggcgcgcgcccgctcatgggcgaagcgctgtgcgaccagctcgcggagatggcgcggcgcgaccaagcggacacgtcccacgcgcacccgcactctgatttgagccgcggaagccttgccgcacctccgcggtttccagacgaagcctgccgtcgggcaagaagcgccccccgcggcgcttgcggttgccgcta

SEQ ID NO: 86320 - protein, 237 aa, Zea mays
  misc_feature: Ceres CLONE 1572748
  misc_feature (11)..(58): Pfam Name: zf-B_box Pfam Description: B-box zinc finger
MKSCGGGGADGQQCPCDYCGEAAAALHCRADAARLCVACDRHVHAANALSRKHVRAPLCAGCAARPAAARVSLGADPAFLCADCCEGCAAASAARVSVEGFSGCPSAAELAASWGLDLRRAAVAVGDDGDGGDDDDPFLSVLDYSVLGVGVADTDLRDLYVPCDPPRVPVPDAGARPLMGEALCDQLAEMARRDQADTSHAHPHSDLSRGSLAAPPRFPDEACRRARSAPRGACGCR

SEQ ID NO: 86321 - DNA, 913 bp, Zea mays
  misc_feature: Ceres CLONE 1572750
  misc_feature: Encodes the peptide sequence at SEQ ID NO. 86322
tggcggccgctctagaactagtggatcccccgggctgcaggaattcgtctcacccctagaaaaagtttcgtcgtgtcttgtgtcccgcacgggctctcgtcggtctcggaccggaacgcaacaaacggggggagcacccgactccacgtcctcttccaccaccaccaccaccgcctcatcccccaccacggcaccaccgagcagcacagcacagggcactgcccgattccacccctgcagcctctcgctgcccactttccatgtcactgcaccactgccgcgctgccacgacgcccgccatgcccgccaccggcctctcgtccgcgggcgcttccccgttccgcctgcccgcctccagctcctccgcccagggccacctccgtctctccccccctgctgccactgccagtgccaccgcctgccgccgccgcttgcttctccgctgcgccgcctcttctggcgggggcggcggcagcggctccgacccggtcctagaggagcagcggcgccgccaggccgagctcgccgcgcgcattgcgtcccgcggagttcaccgtgcaaagccccgagtggattgcgccctctctgggggaggctctccaagctgggccccgccggggaaactcgccgccccgctgctcaccatggttagcgggccgctggcggcccggaaatcccccaaggcaaggggggcgaacaaacccggccggggggcaagccctcctcgtgcccccggtagaactctctccccaccaacggggggatcttttccccccaaacttgggccgaaaatccttttcttttggtccccgaaccgggtttatcttaaaaaactcctgagggaaaaatctccaaacttattcccaagggaaatctggccgaaaaaatgggaattttgtgaaggagaaacatc

SEQ ID NO: 86322 - protein, 217 aa, Zea mays
  misc_feature: Ceres CLONE 1572750
MSLHHCRAATTPAMPATGLSSAGASPFRLPASSSSAQGHLRLSPPAATASATACRRRLLLRCAASSGGGGGSGSDPVLEEQRRRQAELAARIASRGVHRAKPRVDCALSGGGSPSWAPPGKLAAPLLTMVSGPLAARKSPKARGANKPGRGASPPRAPGRTLSPPTGGSFPPKLGPKILFFWSPNRVYLKKLLREKSPNLFPREIWPKKWEFCEGET

SEQ ID NO: 86323 - DNA, 886 bp, Zea mays
  misc_feature: Ceres CLONE 1572756
  misc_feature: Encodes the peptide sequence at SEQ ID NO. 86324
  misc_feature (815)..(815): n is a, c, t, g, unknown, or other
ccgctctagaactagtggatcccccgggctgcaggaattcgtctcacccctagaaaaaagcagtcagccagccagccagccatggagacggcctccttcctctcagtggcgctggccctggcggccctcgtccccgtctcgctgctccttgtgaaccggctcctctacggcaaactgcccccggggccgcggcggcgtcccgtggtgggtaacctgttcgacgtgcagcccgtgcggtgccggtgctaccaggagtgggcgcgccggtacgggcccatcatgacggtgtggctgggcacgtcgcccacggtggtggtgtccacgtcggagctggccaaggaggtgctcaagacccacgaccagcagctcgccgaccgctgccgggaccgctccaccgagagcttcagccgaggcggccaggacctcatctgggccgactacggcccccactacatcaaggtgcgcaagctctgcaacctcgagctcttcacgcagcgccgcctcgaggcgctcaggcccatccgcgaggacgaggtcaccgccatggtcgagtccgtctacaaagccgtcaccgcgcctggcagtgcagggaagccgttggttgtaaagaaccacctctcgatggtgggcttcaacacatcacgcggctggccttcgggtagcggttcgtggacgcggccggcgagctggacgagcaaaggcgcgagtttcaggggatcgtccacacggcatcaagatcggtgcggtccctctcatcgcggagaaatcccgtggctaccctggctgggcccggtcaaatacaaggcttcaaagcnacggggtaaggcccgaccgcttcaccgtgaaatcatggaggaagccgccagggcttcaagaagggggggcc

SEQ ID NO: 86324 - protein, 268 aa, Zea mays
  misc_feature: Ceres CLONE 1572756
  misc_feature: SWISSPROT Homolog: EC 1.14.13.21 Flavonoid 3'-monooxygenase
  misc_feature: The sequence is a functional homolog of SEQ ID NO 6 in US patent 7071376
  misc_feature: The sequence is a functional homolog of SEQ ID NO 4 in US patent 7071376
  misc_feature (245)..(245): Xaa is any aa, unknown, or other
METASFLSVALALAALVPVSLLLVNRLLYGKLPPGPRRRPVVGNLFDVQPVRCRCYQEWARRYGPIMTVWLGTSPTVVVSTSELAKEVLKTHDQQLADRCRDRSTESFSRGGQDLIWADYGPHYIKVRKLCNLELFTQRRLEALRPIREDEVTAMVESVYKAVTAPGSAGKPLVVKNHLSMVGFNTSRGWPSGSGSWTRPASWTSKGASFRGSSTRHQDRCGPSHRGEIPWLPWLGPVKYKASKXRGKARPLHREIMEEAARASRRGG

SEQ ID NO: 86325 - DNA, 1187 bp, Zea mays
  misc_feature: Ceres CLONE 1572758
  misc_feature: Encodes the peptide sequence at SEQ ID NO. 86326
ggcggccgctctagaactagtggatcccccgggctgcaggaattcgtctcacccctagaaaaaacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagtagggcgtcgcgcaggtgaagctgtacgacgccgaccccacggtgctgcgcgccctcgcgaaccccgggatgggggtggtggtggcgctgcccaacgagcaggtcgcgacccccccttcccgcgcttccttacccctttttgtgggttgcgcccgaacgtgggcgtgctaccaccccggcgcccgcggatcccgggggttgcccgcggggggcaccagggctgttcctcgtccgggccaataatcgttgaccggcttttctgggttcccggggtccggggtctcagtggcgttgcaccgccccgtggatatgttgtccgtcccccttatggggggtccccccccagtttgttttgtatgccccctcagccggttcctcggtttgtgcctgtctgtcggcctcctgccatctttctcctgcctgggcgtgttttccatcacctcctgtttttgaccctccgcttgtacgccgtgctctttcctcggcggacgttgcgtgtgatgttcgcatcctggtccgttaggtgttcgatatcgtctggggctcgatcacccaaacacgcgtgtgcaatgcgggcgctccggtggtagttagctactctgcatgacgtgatgttgttgtttctggtcgcgttatcctctttttcttcgcccgcgggtgctcggagtctcccgcgtggcgctgtcgcgggtgttggggttcttcaacagggcacgcgttgggcacgtccatcctctagatcgcttgagtatgtctgcactgctctacttatgagtacacactccttgcatactcgttcgctatgctacccgcttctctgtcatctacgtttagctcactccgtccatcacttcttctgcatgccgctgcttatcgcctctgcgcctgcctcttctctgactgtctctacgtt

SEQ ID NO: 86326 - protein, 52 aa, Zea mays
  misc_feature: Ceres CLONE 1572758
MAPPRPLLAAVFLAAAVLLLLSPAEAGTVGVNYGRVANNLPNPAAVVQLLKQ

SEQ ID NO: 86327 - DNA, 994 bp, Zea mays
  misc_feature: Ceres CLONE 1572759
  misc_feature: Encodes the peptide sequence at SEQ ID NO. 86328
  misc_feature (404)..(404): n is a, c, t, g, unknown, or other
acccgcggtggcggccgctctagaactagtggatcccccgggctgcaggaattcgtctcacccctagaaaaacacactcgtccactcaccccctctttgctctgcctcgccgcgccgcagagcagagcatggcgcccccacgccctctcctcgccgccgtcttcctcgccgcggcggttctgctcctcctttctccggcagaggcggggacggtgggcgtgaactacggccgcgtggcgaacaacctgcccaacccagcggcggttgtgcagctgctcaagcagcagggcgtcgcgcaggtgaagctgtacgacgccgaccccaccgtgctgcgcgccctcgcgaacaccggcatcaaggtggtggtggcgctgcccaacgagcaagtcgcggcggcggcgtcncgcgcgtcctacgcgctgctgtgggtgcgccggaacgtggcggcgtaccaccccgggcacgcagattccagggcatcgccgtggggcaacgaggtggtcccgtccggccagaacgtgaacgggccagcctgggccccgggccttgggccaaacgtggacccccccggctgggccaggttccgcccctctaagggggccgtacaagggggttcgttccgccccattggggctcacaggggggctcggggttggttccctaccccggtcccttgggggggggggcttttcccggggaggaacctcccccccagggcccctctttaaaaaccccatgtgcccaaatttctctggggaaaaaccgggggtggtccccccgggtgggaaaagcgttcccccggttttttccttttctcccggggaagggggggaaaaattccccccaaaaaaaccccttgttttcccccaaacaccgggggtttcaaccccggggaaaggccccaaaaaaaaaggccgcccccacacaattttgggccccttgttctccccgcgtaaagagggtgggagggaggaacaaaccccgcgggtgggtg

SEQ ID NO: 86328 - protein, 199 aa, Zea mays
  misc_feature: Ceres CLONE 1572759
  misc_feature (29)..(197): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MAPPRPLLAAVFLAAAVLLLLSPAEAGTVGVNYGRVANNLPNPAAVVQLLKQQGVAQVKLYDADPTVLRALANTGIKVVVALPNEQVAAAASRASYALLWVRRNVAAYHPGHADSRASPWGNEVVPSGQNVNGPAWAPGLGPNVDPPGWARFRPSKGAVQGGSFRPIGAHRGARGWFPTPVPWGGGLFPGRNLPPRAPL

SEQ ID NO: 86329 - DNA, 945 bp, Zea mays
  misc_feature: Ceres CLONE 1572760
  misc_feature: Translation starting site: 254
ccgcggtggcggccgctctagaactagtggatcccccgggctgcaggaattcgtctcacccctagaaaaaacttctgcccaaccccaaccccaacccccctccatccatccaaacagctttgcctagcttattccttaccgacaaacaaaactgacacggatccgcacaggccacagctagcgcaacgaactcgcccagtccggctgctgctgcacaacggactcgatctcacgggcccgccggctcgcagccatgcagacacagtcccgcctggccatgagcggcggcggcagcagcagcagcagctcggcctcggaggacgagcacgaggcggtgatccgcgagctgacgcgggggcacgagctgacggcgcagctgcgggccgaggccctgcgcgcgctgcgcgggcagggccaggccgaggccaccgcggcattcatcctgcaggaggtgtcccgcgccttcaccgtctgcctctccatcatgagctcgcccgcccgcgccccgccgccgaagatgggaaatggccgcgcctgccctggccccgcgacgggggccggacgacagcatccccagagagcaacggaggacgtcctcgccgcacagcgacgggtaccagtggaggaaagacggcccagagaggatcactaagtccccgtttcccgagtggctactacaagtgcagcttcccccgcgagcgcagctggcgggccacccaacaagttgcagcaatgcaccgacagcgaacgccaccccccccagtacgtcggtctggacttcaacgagacacgtgcgaacggcgctgggggaaagacccccccgcggggcggcggggggggtttcccctgggggggcctctgagagaacagtcccagtcccaagttgtggagggtatagggcaggggccaacaggggccctcccccccgctctcgtgataaaaact

SEQ ID NO: 86330 - DNA, 881 bp, Zea mays
  misc_feature: Ceres CLONE 1572762
  misc_feature: Encodes the peptide sequence at SEQ ID NO. 86331
  misc_feature (575)..(575): n is a, c, t, g, unknown, or other
  misc_feature (576)..(576): n is a, c, t, g, unknown, or other
gcggtggcggccgctctagaactagtggatcccccgggctgcaggaattcgtctcacccctagaaaaagctttccccctcctctcattccattccacccacgccgcctgcctgccccctcgcctcgggggcgaaccacgagaaggggattccggctagggtttcgcggatcgagaagagtcagggaagaagcggggggagagaagagggcggcacctagggtttccgcgggcggcccccccgcatggcctcgccagctgcagcggcggcggcggcgccaccgccggccgccaaggagaaggagaaggacgcggaggaggcaccggtcacgggggacatggtcagcgccggcttcgcagagctcgagcgccagcagcagctgctggccacctgcacgcgcctctaccagcagctgtccgaccacttcggctcgctcgagcgggggctcgcggcgcgctccgacgcgctccgcgtccgccgcagggccttcgacgcgcgcacccaccgcgcgctcgactcgctccaccgccgggaggcctccatcgacgcctccgtctcgcgcgcgctcgaacaccnntcactcatctccgcctccgcctccgccgccgccgccgctttcctcaaggcccccgccacctccgactccgactccgagggcctcgccgatagcttgcgcgcgctgtgcccgcggatggactccgcgcgttcctggggcttcgtggtggccgccccaagaagccgacccctgcgggcgaaatgcggccgcgctcaactctgcggggatcgggcaattccgtaggaacccgttcccaaatcttcccgtgacgccgcgaggccggaacccgcgaccggccggggctgggtgtctcccttaggccctgg

SEQ ID NO: 86331 - protein, 184 aa, Zea mays
  misc_feature: Ceres CLONE 1572762
  misc_feature (111)..(111): Xaa is any aa, unknown, or other
MASPAAAAAAAPPPAAKEKEKDAEEAPVTGDMVSAGFAELERQQQLLATCTRLYQQLSDHFGSLERGLAARSDALRVRRRAFDARTHRALDSLHRREASIDASVSRALEHXSLISASASAAAAAFLKAPATSDSDSEGLADSLRALCPRMDSARSWGFVVAAPRSRPLRAKCGRAQLCGDRAIP

SEQ ID NO: 86332 - DNA, 883 bp, Zea mays
  misc_feature: Ceres CLONE 1572763
  misc_feature: Translation starting site: 343
ctccccgcggtggcggccgctctagaactagtggatcccccgggctgcaggaattcgtctcacccctagaaaaagctttccccctcctctcattccattccacccacgccgcctgcctgccccctcgcctcgggggcgaaccacgagaaggggattccggctagggtttcgcggatcgagaagagtcagggaagaagcggggggagagaagagggcggcacctagggtttccgcgggcggcccccccgcatggcctcgccagctgcagcggcggcggcggcgccaccgccggccgcctaggagaaggagaaggacgcggaggaggcaccggtcacgggggacatggtcagcgccggcttcgcagagctcgagcgccagcagcagctgctggccacctgcacgcgcctctaccagcagctgtccgaccacttcggctcgctcgagcgggggctcgcggcgcgctccgacgcgctccgcgtccgccgcatggccttcgacgcgcgcacccaccgcgcgctcgactcgctccaccgccgggaggcctccatcgacgcctccgtctcgcgcgcgctcgaccacctccactccatctccgcctccgcctccgccgccgccgccgcttcctccaatgtccccgccacctccgactccgactccgagggcctccccgagagcctgcgcgcgctgtgcgcgcggatggactccgccgcgtttcttgggcttcgtggtgccccgccgcaaagaggctgacgcgctgcgtggcctaatgccgccggcgctcaagctctgcgtggatccggcctagttcttcatggacgccggtctccatagtcttccccgttcaaccggcgggtaggtccggtatccccgcctaactggttct

SEQ ID NO: 86333 - DNA, 987 bp, Zea mays
  misc_feature: Ceres CLONE 1572766
  misc_feature: Encodes the peptide sequence at SEQ ID NO. 86334
ccgctctagaactagtggatcccccgggctgcaggaattcgtctcacccctagaaaaaaccgccgtctcctaccgcagcaacacagcctccgccagtcaccgagctagctagacccacgcgccgcgccatgacgtggaacaggtccgcggccgacggcggcggcagcagcgccgggacgaccgccggcgacgacaccggcctggcgcgactgcgggagctcgggtacaagcaggagctgaagcgcgacctctcggtgctgtccaacttcgccttctccttctccatcatctcggtgctgacggggatcacgacgctctacaacacggggctccacttcggcggggccgccaccatgaccttcggctgggtcgtggtcccccccttcaccatggccgtcggcgcctcccatggccagatttggctccttcttccccaccttcggggggcctctactaatgggagcgcggcccctctccgggaaagcgctggggcgcccttccgcctccttgaatcccccggaggggtcaaatgtttgtcgggacaatgggggcgggggaccccccccccgggggaataactcccccggggggcaactgaatcccaggggtatttaatccctgggtctccccccccgggggggcaaataaaaaggggggcgggggttcccttgggcggtccccaagtaaacatgggtgggatttggggtttctaaggcccggccatttctggtttatacccaacctgtgttttttaaaagggcgcctcccattaaccctttccttccccttttttttgggcacattccccccgccgccccggaaaaacagctaggtggtgtttgtcccctaaggttggccgggtccaccctttcccccccaagagggccgcccccaaattctgtttccccctttttaccccgaaaggggccggtttcccgcaaaaattgtaatttttggctgggcggcccaagaacaaaatcctcctgg

SEQ ID NO: 86334 - protein, 149 aa, Zea mays
  misc_feature: Ceres CLONE 1572766
MTWNRSAADGGGSSAGTTAGDDTGLARLRELGYKQELKRDLSVLSNFAFSFSIISVLTGITTLYNTGLHFGGAATMTFGWVVVPPFTMAVGASHGQIWLLLPHLRGASTNGSAAPLRESAGAPFRLLESPGGVKCLSGQWGRGTPPPGE

SEQ ID NO: 86335 - DNA, 952 bp, Zea mays
  misc_feature: Ceres CLONE 1572767
  misc_feature: Encodes the peptide sequence at SEQ ID NO. 86336
  misc_feature (830)..(830): n is a, c, t, g, unknown, or other
  misc_feature (952)..(952): n is a, c, t, g, unknown, or other
ctccccgcggtggcggccgctctagaactagtggatcccccgggctgcaggaattcgtctcacccctagaaaaaaccgccgtctcctaccgcagcaacacagtctccgccagtcaccgagctagctagacccacgcgccgcgccatgacgtggaacaggtccgcggccgacggcggcggctgcagcgccgggacgaccgccggcgacgacaccggcctggagcgactgcgggagctcgggtacaagcaggagctgaagcgcgacctctcagtgctgtcaaacttcgccttctccttctccatcatctcggtgctgacggggatcacgacgctctacaacacggggctcaacttcggcgggcccgccaccatgaccttcggctggttcgtggccggcgccttcaccatggccgtcggcgcctccatggccgagatatgctcctccttccccacctccggcggactctactactggagcgcgcgcctctccggcaagcgctgggcgcccttcgcctcctggatcaccggatggttcaatgttgtcggacagtgggcggtgaccaccagcgtggactactccctggcgcagctgatccaggtcatcattctgctagcccccggcggcaaaaacggcggcggctacctggcgtccaagtacatggagatcggcttacacgccgcccatcatgctcagccacgctgtcatggacagcctcccccatcacttttctctactttttcggcaagttcgccgcggacgtggaacatgtaaggtgtgtttctcccgaatggttgcatggccgaacgttgacacccagaaggcaggaaccnagttccttgttccccagattaataacgaaaacggggccggattccaaggaacctgtaaactatttgtcgtgggcttgctcttgaaccattaccccctccaggttttagagcctggggttctn

SEQ ID NO: 86336 - protein, 208 aa, Zea mays
  misc_feature: Ceres CLONE 1572767
MTWNRSAADGGGCSAGTTAGDDTGLERLRELGYKQELKRDLSVLSNFAFSFSIISVLTGITTLYNTGLNFGGPATMTFGWFVAGAFTMAVGASMAEICSSFPTSGGLYYWSARLSGKRWAPFASWITGWFNVVGQWAVTTSVDYSLAQLIQVIILLAPGGKNGGGYLASKYMEIGLHAAHHAQPRCHGQPPPSLFSTFSASSPRTWNM

SEQ ID NO: 86337 - DNA, 919 bp, Zea mays
  misc_feature: Ceres CLONE 1572768
  misc_feature: Encodes the peptide sequence at SEQ ID NO. 86338
  misc_feature (756)..(756): n is a, c, t, g, unknown, or other
  misc_feature (853)..(853): n is a, c, t, g, unknown, or other
  misc_feature (861)..(861): n is a, c, t, g, unknown, or other
caaagctggagctccccgcggtggcggccgctctagaactagtggatcccccgggctgcaggaattcgtctcacccctagaaaaaatcggtcagcacgatgtcattgacccgatgagaggtcgaagaagggcggatgcttcaagctttctctgctcggttaggttgctgtcgctcgctctgagtctgaggcctcgacgcgctgctagctgagagccgaaagaaggaatcctcggccggcagcaggagaggagagccaccgtttgatcagcgaccgggcaagagcaggccgcggccggccaccccgcccgtctctgtccgaccccgcaccagcgactcgccgagcgcaggcacaagaggggggctccatccatgaggcagccatgctggtgctcatcaacaggtatttcaggagcaggaacagcagcccggccggaggaggcggcgaagagatggcgccggcggcggtctccagcgaccacctctgtttgccgggctgcgtgcccgtgcgcgccaagcgggcctcctcctccgccgccgccgcggccacgggcaccacggcgcgggcgtcgcggcacaacttcgtcagggccgcggcgtcgggcctgctggcgggggcgcacttcaccaaccacgagtcgctgccgccgcttccccacgcgtacgccgagttcgtcgcggcgttcccgcagtacgcccacagcgcgctggcgcgggcggacgcgatccggggcgatgagtaccagcacctggaacgncacgtgtgcctggactacaccggcatcaacctcttctcgcacgcgcagatgagcgcctccctgtcggtccacatcatgcgatgcgcccggcctgggnagctgccntcctcgacatcgcgtacaagtccactagcatgcagcgcgcaagtggcatgcggggaac

SEQ ID NO: 86338 - protein, 179 aa, Zea mays
  misc_feature: Ceres CLONE 1572768
  misc_feature (158)..(158): Xaa is any aa, unknown, or other
MLVLINRYFRSRNSSPAGGGGEEMAPAAVSSDHLCLPGCVPVRAKRASSSAAAAATGTTARASRHNFVRAAASGLLAGAHFTNHESLPPLPHAYAEFVAAFPQYAHSALARADAIRGDEYQHLERHVCLDYTGINLFSHAQMSASLSVHIMRCARPGXLPSSTSRTSPLACSAQVACGE

SEQ ID NO: 86339 - DNA, 948 bp, Zea mays
  misc_feature: Ceres CLONE 1572769
  misc_feature: Encodes the peptide sequence at SEQ ID NO. 86340
  misc_feature (734)..(734): n is a, c, t, g, unknown, or other
ctccccgcggtggcggccgctctagaactagtggatcccccgggctgcaggaattcgtctcacccctagaaaaagaatgaaacccgattcacaaaaccctagcgacctcgattcctcagcagcatggccgtcggcctctactctctcggactctctccgccgccgcggcttgataccatcctcttcccacagctgcggcctcacctaaacagccacttgcccgctcgggttgctagcagccgagcaccagctgtgtctcccgccgccggtgaatccgaagacggggtcggcggctggcggtttcccgagtacgacaaatcgatgaaacacgcaacggggaggattgagtttaacacagctgtcgaggcagggttgggagcttctgcggcgatcaccttggctgggctggcgtggcgcttcccatcttcacagaagcatatacatgcaactcattgttgctccattacaccatgttcaagagaaattgccaacaatacattcaacagagacaaccaaggaggatgcaagtgacagggaatccgatgaaattgaagtttctagtcgcaacacatgataagaaggctgaagcaataactgatgattcaaggcaaaactactgaacaacaattgccagcccttctccatttggagttcgtacagatactgtgcatgaggaggctttatctgtactgaaaaactacagatcagtgagaagatgtcagctccaatgattnctgtacactgaagcgattcgcaagatggttagttaacgtgtgctcaagttcgagaagaaaagatgaaagcattcgtgctaatcaaataactgctgcacaggccatgagccgttgatgatgttatatcgacaaacagaacttctgtaaccaatctttaagagaactagaatacaccagcaagtagcaactcctggcaacatacaacgggtctcgt

SEQ ID NO: 86340 - protein, 135 aa, Zea mays
  misc_feature: Ceres CLONE 1572769
MAVGLYSLGLSPPPRLDTILFPQLRPHLNSHLPARVASSRAPAVSPAAGESEDGVGGWRFPEYDKSMKHATGRIEFNTAVEAGLGASAAITLAGLAWRFPSSQKHIHATHCCSITPCSREIANNTFNRDNQGGCK

SEQ ID NO: 86341 - DNA, 927 bp, Zea mays
  misc_feature: Ceres CLONE 1572770
  misc_feature: Encodes the peptide sequence at SEQ ID NO. 86342
  misc_feature (787)..(787): n is a, c, t, g, unknown, or other
ctccccgcggtggcggccgctctggaatagtggatcccccgggctgcaggaattcgtctctcccctagaaagacgaccgcttggcgcttcatcactcgttccctttcttaagcccgcgctcgcacgtcggtcgtcccgagcaggacctcgatcggccgagatggcgacgccgaacgggcttgcgcggatcgagacgaccgggaagaagatgcaccgacaacggcgtgtggtacgacgacagctcggcgccggtgcgcgcgcaaaccatcgacgagctgctctcgctgcaactgaagcggtcagcgcccagcacgcccatatgcggtctgcgcccaccacgcccatcatgggcggtgcccactcgcccttcggcgtctcgatctccgaggaggagcgccacacgcatcatatgcagtccatcagtgcgtcggtggagtctctgacgcgtgaaaccgggccgaaagtggtctagggcgaccctgccgcgaagggcgaggccgccgcgcagggcgcgccatctacgccgagggcgcaccatcagcacctcctcccctcctcccccgccatctgcgtcagcgacagctccctcaagttcactcatgtgctcaactacctctcgcctgctgagctgtacgagcaggccatctagtacgagaaggggtcgttcatcacatccaccggcgctctggcgacgctgtccggtgtccagatcggtcgctctcccagtgaccagcgcgtcatcaaggacgatgtctccgcgcacgacctgtggtggggcaagggctcnccaaactctagatgtacgaatagacctgcctgatcacatggagagggcggcgactacctcactccctggtagaagggtcgtctacgacagtccccacgtggaccccagaacgtatgaggttcgcttttcttgccctgccg

SEQ ID NO: 86342 - protein, 103 aa, Zea mays
  misc_feature: Ceres CLONE 1572770
  misc_feature: SWISSPROT Homolog: EC 4.1.1.49 Phosphoenolpyruvate carboxykinase (ATP)
MATPNGLARIETTGKKMHRQRRVVRRQLGAGARANHRRAALAATEAVSAQHAHMRSAPTTPIMGGAHSPFGVSISEEERHTHHMQSISASVESLTRETGPKVV

SEQ ID NO: 86343 - DNA, 952 bp, Zea mays
  misc_feature: Ceres CLONE 1572773
  misc_feature: Encodes the peptide sequence at SEQ ID NO. 86344
ctccccgcggtggcggccgctctagaactagtggatcccccgggctgcaggaattcgtctcacccctagaaaaaatccgcggttcataagcctcgccagatacgagcgtccagcaaaaggtcgaattctcaactctcaagcaccagcaggaatccagcgagcgagcgagcagtgtccgccccccatggccatggtcgcgtccacctccttcgcgtaccacaagccgagtttcgcggtggtgtgcaggaacaacaaggacggccgggacaagatagcgggacggcaaggagcacaagcaccccttcgaggtcgtcgagatcacgccgcctccgcggtgcctcggcgtccgctgcttccccaccgacatccactgtcagcgagagcgtgacgatccatgggcaggcgcacaccgtgtccgcggtgacacgccggtaccagctgcacgaggagcagaacaagacgagcgagaagctgcctcgacgtcctctccaccggatggaacgtccccaacctctacctccagaacctagccgaccaggcacggctgacatatctgtatctgtactgtacatcagcatctcttcactctgcgtagatatacatacatagatatgacacccaagcgcatcgtacacttgaccctgcgggagggttaccgaaatgccgtcaaatgtgtcacgaaacttttgccccatctgccccaggctcaatcagaggacagttggacaagatctcgctgacgaacttgctaggcccttcggactcccgaacgcgcactacaaaggacgagtgggcccagtatccacttaatgtatcctctaggcacatgtcaacggagattgtgcaaagggttgaaactcgggagaagaaggagttcttcatcaacttttttccggcctctgttaccgcagagagcaagaggtctttactacaagaggggtcccggcatggg

SEQ ID NO: 86344 - protein, 94 aa, Zea mays
  misc_feature: Ceres CLONE 1572773
MCHETFAPSAPGSIRGQLDKISLTNLLGPSDSRTRTTKDEWAQYPLNVSSRHMSTEIVQRVETREKKEFFINFFPASVTAESKRSLLQEGSRHG

SEQ ID NO: 86345 - DNA, 880 bp, Zea mays
  misc_feature: Ceres CLONE 1572774
  misc_feature (729)..(729): n is a, c, t, g, unknown, or other
acccgcggtggcggccgctctagaactagtggatcccccgggctgcaggaattcgtctcacccctagaaaaagtgattttctgggtgaatttttcccggcctccgctccggccagatcggcgcgggtgaaccccggcccctaccgatccggatccgtccccatcgcctcgtgtgttttccgtcgagtattttagcgtgtgtgtctccccttcttcgcttcggttggtgcgtgcggctgtctcgggtagatctggtggtttagttcgccttgaaggcgcgcggcggcggtgtcgcggcttgtagcttgcgatttcacggtggagcttgtcggctgttggggtcggatttggtgcgtggctgcttcggcgctaggcgatccttgtgctgtttccgtgggatatttgtcgttgaatagataggtgaagttgctgtaaacattgcttaccgtgtaggggactgtaaagaatcgttcacgctcgtgcaggctgtgacgaattcgctcgatggttcgggctgatctctgagatgaccccgagctgacgtacccatttcacaacggcaccgaccgtgaagcgactcatcatgggcaggcttagcttgttctgttgttagctgttggtgcttacgtcgtgcatatttctgaaacatgatcggttaagagtatttggctatctgcatgggtgttggggcacttcatcatctgtctgcatacgggggtggagatttacntaaacccaacttgggactgtcgagcattatgtctgtttttacacaaaatagggtatctgctacctaaagttgctagatttgctgctaaatctcacatccctagcttaagatccaaggtatgtaaaccatcttgaggttgtgattgaaatgt

SEQ ID NO: 86346 - DNA, 948 bp, Zea mays
  misc_feature: Ceres CLONE 1572776
  misc_feature: Pfam Name: DUF212 Pfam Description: Divergent PAP2 family
  misc_feature (948)..(948): n is a, c, t, g, unknown, or other
ctccccgcggtggcggccgctctagaactagtggatcccccgggctgcaggaattcgtctcacccctagaaaaaggtgggctccggtgggatgccgtcctcgcactcagccaccgtctcagcgctcgccgtcgccgtcggcctgtaagaggggctcgccagctcgctgttcgccaccgtcgtcgtctttgtcttcgtgattggttccccttcccactccccctctccctttcgacaccaaaaaaacgcgctgaccatctttggcaagctgtcgcccaccccaccccaaaaccctagctctattccatcgctcccgtactccctattgcggcggttgagaacagtggcgacaagatctcatggagagaagctatgcggaccccaggaaaggtgaaatcgtcgtgcgatggtggagatggccgatgggaggctccaccagccctagggtgtggccaacaagacgctactcgccactgcgtgggtcggcagtgagatctcagggagagaagccatgcaaccccatgaaaggcgaaactgtcgcacgatggtggagacgacccggcgtaggatgcaaagttgagcatttgggaaagagagtattcctccccatgttcccggtcccttcttggacccaagcttggccgaagagccgctcgaattcttcgcaacttgtccaaccatcttgcgccccggggcgggggtaaaatcaatcaccgccgtaaatcgcggggttggccctacccccagggcttgagtccctccaacttggggggggggggagaaccgttttaccccaggggctttcccgggagttgagaaaacaaccccaagggggagccccaattttccggtgtggtttttctccgtgaaaaaaaagggggggttttttttcgcccaacaccccatataggggtgggaaccctgccccccacgtggcaaatttgccccn

SEQ ID NO: 86347 - DNA, 1029 bp, Zea mays
  misc_feature: Ceres CLONE 1572778
  misc_feature: Encodes the peptide sequence at SEQ ID NO. 86348
acccgcggtggcggccgctctagaactagtggatcccccgggctgcaggaattcgtctcacccctagaaaaactccctccattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggctcgagtgcggggaggaccgtgctggtcacgggcggggcgggctacatcggtagccacgccgtgctgcagctcctcctcgcgggcttccgcgccgtcgtcatcgacaacctcaaacactcctccgagctgggcgtccgccgcgtcgcccgcgcttcgcggggaccactcccgcaacctctcttttcaaaaaattggtcttccgggaccaggggagcccggaaaaagggtttttgcttcctacaagatttgaaacctggcctttcccttccccttgaattgaaaacctgggggggggaaaagccgcaccgaaaaccctttttctttttttttgaaacaacaccctgtctttggcgccccataaaaaatccttctaaaaaagtttttgccctcgtcccccggtttcgcaagaagtgggggggctccccccccccccgccgccgttttttggggcccccccaaaatccccccccgggaaagaaaattttctcctttttcccgcaaaaatccttgtgggaaaaaaaagcccggggggtgaaaaattttgcggggggtatctccccgcgcaatctccggaggggagaaatcttttctttggggccctccccccggtggcgcgccccctggagagtgttgggggagacccccacggatacccccaccttcctcccccttctacagaaagggggtgggagggagcgcactctctc

SEQ ID NO: 86348 - protein, 244 aa, Zea mays
  misc_feature: Ceres CLONE 1572778
  misc_feature: SWISSPROT Homolog: EC 5.1.3.2 UDP-glucose 4-epimerase
MAVEKTLPGSSAGRTVLVTGGAGYIGSHAVLQLLLAGFRAVVIDNLKHSSELGVRRVARASRGPLPQPLFSKNWSSGTRGARKKGFCFLQDLKPGLSLPLELKTWGGEKPHRKPFFFFFETTPCLWRPIKNPSKKVFALVPRFRKKWGGSPPPRRRFLGPPQNPPPGKKIFSFFPQKSLWEKKARGVKNFAGGISPRNLRRGEIFSLGPSPRWRAPWRVLGETPTDTPTFLPLLQKGGGRERTL

SEQ ID NO: 86349 - DNA, 838 bp, Zea mays
  misc_feature: Ceres CLONE 1572779
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (705)..(705): n is a, c, t, g, unknown, or other
  misc_feature (741)..(741): n is a, c, t, g, unknown, or other
  misc_feature (743)..(743): n is a, c, t, g, unknown, or other
  misc_feature (744)..(744): n is a, c, t, g, unknown, or other
  misc_feature (746)..(746): n is a, c, t, g, unknown, or other
  misc_feature (747)..(747): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (788)..(788): n is a, c, t, g, unknown, or other
  misc_feature (790)..(790): n is a, c, t, g, unknown, or other
  misc_feature (812)..(812): n is a, c, t, g, unknown, or other
  misc_feature (814)..(814): n is a, c, t, g, unknown, or other
ctccccgcggtggcggccgctctagaactagtggatcccccgggctgcaggaattcgtctcacccctagaaaaagcattgacgtgtcaaataaagctagctagctttctacttgtaggattaggactggaagatgtcaagatgcaccgctagcgcgctgcaggtgccaaaatggcgcacgtctgccagcagaagctgaagctgaccctagctagctagcggtcatggaaatccttcgtcgtcgcctccgcgcgcgccgtgtctctcttgtcacgttcggcagcgaccagcgaccgcgccgccctgtccctgtgcaacgactcgatcgtctctctgggcaagtccttataaagttggcccgacgcgagagtgagacagatgccggccacaacgacgtactagctagcttagctagctcgttcgatcgcgtgcgtcgttccacaccgacgagcggcatggaggcctcccgcaaactgccccgtcgtcgtccccgagggcgtccggggcatggaacaacgacaacttccccggggggggggggggaaaaaaaaaaaccgccgccccgccacaagggggggggtttttcaaaaatttttttttttttttgggcgccccaccccaccttttttttttgggggggggggggggtccaaaaaaaaacacaaacacaaatttcttctttttttttttttttttnnnnctccgnggggggggggggggggaaaaaaaaaaacaaacaaancnnannctnnnnttttttttttttttttttgttttgtaccccccccncncaaacaccacaaaaaaaaaggnantttgttttggtgggctgtttgccc

SEQ ID NO: 86350 - DNA, 892 bp, Zea mays
  misc_feature: Ceres CLONE 1572780
  misc_feature: SWISSPROT Homolog: EC 2.7.11.1 Non-specific serine/threonine protein kinase
tccccgcggtggcggccgctctataactagtggatcccccgggctgcaggagttcgtctcacgcctagaaaaaaccaaagggcacagcgaagacgacgacgtcgccgccacacagtcctgcatcgcgaacgggcacacgacgacctgcctctacagaagcagcgctgctccggcgaacaagcatagggccgcatatcccgcggattccccgcgaagctagagctcgggaacgtacagaactggcctcctgccagaacaagcccgtcctagtcgctgctggagacgtagaaggatgagagaaagtggaggctctccagcgccctggggatctcggccgtcaggcggatgctggacaggtccagcacctccaggttcgtgaggttgccgacggcctgcataacctccccgagcagggtgctgaagctcaagttgagctgcgtgagtcccttcaggaggacgatctccggtggcaccgcgccggtgagcaccgtggtcacagaggtgcaacatcttgaggcatatgttctgcctgtgatactggagcgacacgtacatgtagacgggcagctcgtagccggcctgactgcgataaccaccgtcgtcgtcgtgatcgtgcacgaacttctcagacggcaacatcggtagatacaccagcgacgtcgggatctcccccaagaggctgttgtctgacaccctcagaacaaccaggtagatcagccccctaacccagacgggatcggacccctgaactggttgattgaaaagtacaagtcccgcagggtattcaaggctgaaccccagggaggtaatattcttgaaagcgagccttccgaaagaaggggacatggagggctccggaacccggggaaagaggaagcgcgcgaataccctt

SEQ ID NO: 86351 - DNA, 956 bp, Zea mays
  misc_feature: Ceres CLONE 1572782
  misc_feature: Encodes the peptide sequence at SEQ ID NO. 86352
  misc_feature (364)..(364): n is a, c, t, g, unknown, or other
acccgcggtggcggccgctctagaactagtggatcccccgggctgcaggaattcgtctcacccctagaaaaatgctcgtgggcggaattcggtgttcttgcttgcgcggtccacgtccccgtccccgtccccatcccttggcgcgattgcggttgcggacgctcgctgcagatcttcgcgcgactccgggagcgccgccggagatggactgcgggccgcccgaccagctgccgccgtcgtcggcgccggcgtgcttcctcaacctctactgggaccagtccatggccgccgccacggccggcgaccacctcgacctggtctcctccccggcgtccaactcgacggcggctgacggcctcgctcntcacgggatctcgccgcagccgcagtacggtagcactccgctcagctcgcccccgcaagctgaacctctcgatgatgggccagtttcccccactaccccgcgatgggccatctagacaagttcctcgccgacccaggcttccccccgcgcgcggggaggctctccggtttcgacgggcgccccgggtgggagtgggctccggggggccctccccgggaacgtttggcctccccagatgccgggccctttggggggggcatttgagggggaccggaaccccggaacggggagggacaatcccttcggggtgccgtatccggggttcccccaaggcccaaaatgggggccttcaaggggccccccccagcggaagtggaaaataaccagaagggcttccggggaaggggaaagggaaaggagggcccctggtccccccccccccccacagggggaaacccggggggaaaagggggcaattcccgggggaagaaaattggcggcggaggagaacccccccgcggggagagggcgccccctcataaacaaccccaaacacgggggataaataggggggagagcgcggccacccccc

SEQ ID NO: 86352 - protein, 91 aa, Zea mays
  misc_feature: Ceres CLONE 1572782
  misc_feature (54)..(54): Xaa is any aa, unknown, or other
MDCGPPDQLPPSSAPACFLNLYWDQSMAAATAGDHLDLVSSPASNSTAADGLAXHGISPQPQYGSTPLSSPPQAEPLDDGPVSPTTPRWAI

SEQ ID NO: 86353 - DNA, 958 bp, Zea mays
  misc_feature: Ceres CLONE 1572783
  misc_feature: Encodes the peptide sequence at SEQ ID NO. 86354
  misc_feature (724)..(724): n is a, c, t, g, unknown, or other
ccgcggtggcggccgctctagaactagtggatcccccgggctgcaggaattcgtctcacccctagaaaaaactgccagtgccatcccattcccatccgagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacgacggccaggctcggccggcactggcgtccacggccgccgtggcgttccccgagtgccccgccgactaccaggactacaccccctgcaccgaccccaagcgctggcggaggtacggcaactaccgcctcagcttcatggagcggcactgcccgccgccgcccgaccggcagcagtgcctggtgccgccgcccaatgggtacaagccgcccatccggtggcccaagagcaaggaccagtgctggtaccggtacgtcccctacgactggatcaacagccagaagtccaaccagcactggctcgtcaaggagggcgaccagcttccggttccccggcggcggcaccatgttcccccaacggncgtcggcgcgtacgtggtacctgatgcaggtcctgtgtcccggtcatgcgcgtacagcaccgttcgcaccgcgctcgacaacgggttagcgcgtcaacagcttggagcggcaacttgctgggggcggagcatcttcaccgtgttgctgtgcgcccaggtacaccacaaggcccacggtgcatttcgcgcttgaaggcgggatcccggacattcctcggatcattctcacccaag

SEQ ID NO: 86354 - protein, 256 aa, Zea mays
  misc_feature: Ceres CLONE 1572783
  misc_feature (98)..(254): Pfam Name: DUF248 Pfam Description: Putative methyltransferase
  misc_feature (193)..(193): Xaa is any aa, unknown, or other
MKYSKEDKPERAGGAGAGSRAVPVALVVVVLCAFSFYLGGIYSTGRSLLDSIQPAPTALLALGAATTTRRPSDDGQARPALASTAAVAFPECPADYQDYTPCTDPKRWRRYGNYRLSFMERHCPPPPDRQQCLVPPPNGYKPPIRWPKSKDQCWYRYVPYDWINSQKSNQHWLVKEGDQLPVPRRRHHVPPTXVGAYVVPDAGPVSRSCAYSTVRTALDNGLARQQLGAATCWGRSIFTVLLCAQVHHKAHGAFRA

SEQ ID NO: 86355 - DNA, 959 bp, Zea mays
  misc_feature: Ceres CLONE 1572785
  misc_feature: Translation starting site: 222
  misc_feature: SWISSPROT Homolog: EC 2.7.11.22 Cyclin-dependent kinase
  misc_feature: SWISSPROT Homolog: EC 2.7.11.1 Non-specific serine/threonine protein kinase
  misc_feature (832)..(832): n is a, c, t, g, unknown, or other
  misc_feature (856)..(856): n is a, c, t, g, unknown, or other
  misc_feature (857)..(857): n is a, c, t, g, unknown, or other
  misc_feature (872)..(872): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (959)..(959): n is a, c, t, g, unknown, or other
ctccccgcggtggcggccgctctagaactagtggatcccccgggctgcaggaattcgtctcacccctagaaaaacagcccagcaggccagcaccaccatccggcagccgccgcgcaacgcaccacactaggctcctcgacagtcgagactcgagagcccaatcgtacccgacctgattcggaaggagggttgtagccccaccccctctggttccggcgcccatggcggtggcggtacctggccagctcaacctagacgaggccccgtcatggggctcccgcagcgtcgactgcttcgagaagctcgagcagatcggcgagggcacttacgggcaagtgtacatggcgaaggagacgggcaccaacgagatcgtcgcgctcaagaagatccgcatggacaacgagcgggaagggttcccgatcaccgccatacgcgagatcaagatcctgaagaagcttcaccaccagaacgttatcaagctaaaggagatcgtcacctccccaggtggttacaaccacaaataaaaatgaattagatgtgcgtatgtctacttgttttttgtccactggcgtgctgatgattggattcggggttgttgttgcaggcccagagcgggacgagcaagggaggccaattgacggcaacaagtacaaggggagcatttacatggttttcgagtatatggatcatgacctcactgggcttgctgatagaccaggaatgcggttcactgtgccacagatgaagtgttacatgaagcagctgcttacagggctacactattgtcacgtcaaccaagtcctgcatcgagacatccaaggatctaacctcntgatagataacgaggggtaactannagctgctgatttggncnnntgcagatcatcttcagcgatcacatggaaaccttacccacgtgtgatcacttgtggtatagacctcacgagtgctacttgaan

SEQ ID NO: 86356 - DNA, 883 bp, Zea mays
  misc_feature: Ceres CLONE 1572786
  misc_feature (584)..(584): n is a, c, t, g, unknown, or other
  misc_feature (595)..(595): n is a, c, t, g, unknown, or other
ctccccgcggtggcggccgctctagaactagtggatcccccgggctgcaggaattcgtctcacccctagaaaaagtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctcttngctgtctcaantttttttttactgtcaagggataagcagtgacctctgtgtgcataccaccaccaccatacgtagcatacacaggcacagatggcagagcataaagggaacgttctctttgcacaagtatgagatgggaaaatttgctgggcaaagaacctttggcaaaggtttaccatgcccgtaaaaccgggaacttcgaaaaagtcccgatcaaaggattttaaaaggaaaaggtttttaaagggtggcccctttggacaaaacccccaaaaaatttcctggaataaacactttta

SEQ ID NO: 86357 - DNA, 943 bp, Zea mays
  misc_feature: Ceres CLONE 1572787
  misc_feature: Encodes the peptide sequence at SEQ ID NO. 86358
  misc_feature (743)..(743): n is a, c, t, g, unknown, or other
  misc_feature (749)..(749): n is a, c, t, g, unknown, or other
  misc_feature (750)..(750): n is a, c, t, g, unknown, or other
  misc_feature (763)..(763): n is a, c, t, g, unknown, or other
  misc_feature (766)..(766): n is a, c, t, g, unknown, or other
ggagctccccgcggtggcggccgctctagaactagtggatcccccgggctgcaggaattcgtctcacccctagaaaaaaaacatgtgtcactcaccagcgctttccgtcccgtactcccgtgtaccctgtcccgtcctcctagctcgcattccgatttccgagttccagccagcgagcgagccaaccaactgaaccaaccaaccaccgctccttcttccttccttccttccttccccagttcccctcgtctcaccagtcaccaaggttccgagagcagaccgagataaaaaaaaggtaatccgacggaaacgacaagggcgcggcgagggcggggacagggtcggggaggccctgggcgcgggggcgccaagcgcatggcatcgtcgagggtgatgccgtcgtcctcgccgtcgcacacggcctctgatctcgcgcgcctagcgcatgccgccagcatgcccggcggcgggggcagcaggctgggctccatgaacgtggaggagctcctccgcggcatctacagcgacatgcccaccccggcgcctcccgcgtcagagcccgaacgcccgaggtcgccggccccggcgcctgatgtcgccacgcggaggacggccgaagaggtgtgtaaggagatcaccggcggaggtggcagtggggaacccgtgccacccgtggaggctcatgctgccgtccccgctggtggtggtggcgccagctgcccagatatgacgctggacgactncatggnncaggaggatggcncgntgatgcagatggggtttagggtttcggcccctctgccccgacatggggtcctgggccgaacgaaggcctggaggtactgacaaagaagccgaaggggaagaaacgaagctcatgaacccttgaacgcgcccgttgcgcgaccaaaagagatgaaatcgggagtcgctgccaaggccg

SEQ ID NO: 86358 - protein, 156 aa, Zea mays
  misc_feature: Ceres CLONE 1572787
  misc_feature (123)..(123): Xaa is any aa, unknown, or other
  misc_feature (125)..(125): Xaa is any aa, unknown, or other
  misc_feature (130)..(130): Xaa is any aa, unknown, or other
  misc_feature (131)..(131): Xaa is any aa, unknown, or other
MASSRVMPSSSPSHTASDLARLAHAASMPGGGGSRLGSMNVEELLRGIYSDMPTPAPPASEPERPRSPAPAPDVATRRTAEEVCKEITGGGGSGEPVPPVEAHAAVPAGGGGASCPDMTLDDXMXQEDGXXMQMGFRVSAPLPRHGVLGRTKAWRY

SEQ ID NO: 86359 - DNA, 741 bp, Zea mays
  misc_feature: Ceres CLONE 1572788
  misc_feature (284)..(284): n is a, c, t, g, unknown, or other
  misc_feature (295)..(295): n is a, c, t, g, unknown, or other
acccgcgtgtggcggccgctctagaactagtggatcccccgggctgcaggaattcgtctcacccctagaaaaaaaaaaaaaatctcccacaccacagctcccacacacagcaggcagcagctcgatcgctagctcctccgaaccggaaagccaagcccgctttggcgatcgtgcttgcttgcttggttccttcaattcctgccggagccagcgagagctagctgctgctgtcgcgtggtagacgtcgtcttgccagcgagagcctagctcgatcagtctctctngtacaacgtangggagaagatcgaggggggagatgacgacgacaatggccggcccgaccgtgacccttgaagagggtaaggatgcccatttcgcaacggggcccgcccacctgggttgggatttgggcccgccccccccgccaaatgggttttccagggcgaaattcccgggaaatttttttcgggtttcccaaagggaagcccccccccccccccggggaaaattcagaggatggcgccacatctttaatcccggaagggttttctgcccccccaaagggggattcctggggggaaaaccccaaaattttgggccgttataggggcccccccccttttaaccccccaaaaaaaaattttggttgggggtggggggggccccccaccgtggggggggggggggggcggccaaaaaaaggggaaaaaagagggggggggggggccccccccccccccc

SEQ ID NO: 86360 - DNA, 943 bp, Zea mays
  misc_feature: Ceres CLONE 1572789
  misc_feature: Encodes the peptide sequence at SEQ ID NO. 86361
  misc_feature (876)..(876): n is a, c, t, g, unknown, or other
acccgcggtggcggccgctctagaactagtggatcccccgggctgcaggaattcgtctcacccctagaaaaaggccactcctcatcagccatccccaaaaggccaaaacccgcgcacaccggcgacggcaggagaacctcccgccggccgccgccatgccgccgcctctacaggcccaccgcctactcatctcccaccgccgcctacccactccagctcgccgccggttcaccgccgcctcttccgtccaatccgctcccgccacaaccttggccccgggccccgccacatcctccatcctctccatccgcgagtcgctcctctcaggcgagaggaccgcggcggacatcacctccgagtacctctcccgcctccgccgtaccgagccgaccttgcgcagcttcatccacgtcgcggacgccgccgccgagcgggaggcggaggaactcgaccggaggattgcctccggggagaaggatgcggtgggtccgatcgctggagtgctggtgggagtgaaggacaatctttgcacagccaacatgccctccacgggcgggtcgcggatactggacgggtaccggccggcgtacgacgccactgccgtgcggcggctgcgggaggccggcgctattgtgttggggaagacgaacctcgacgaattcggaatggggagcaccaccgagggctcccgcgttcaggtgacaacgaacccgtgggatgattcacgtgtgcctgggggaatctctggtggttctgctgctgcagtatctgcagaggcatgcgtagtgtcactacgtagtgacacacgtgggaatgtgagaacaccagcgcctttttgcggtgttattgggaagtagccaacttatgggcgggttncctcgtttggtctcatggcctacgccttcatcctggatgttggggaatgcttcgttcgcccgttttt

SEQ ID NO: 86361 - protein, 233 aa, Zea mays
  misc_feature: Ceres CLONE 1572789
  misc_feature (64)..(234): Pfam Name: Amidase Pfam Description: Amidase
  misc_feature: SWISSPROT Homolog: EC 3.5.1.4 Amidase
MPPPLQAHRLLISHRRLPTPARRRFTAASSVQSAPATTLAPGPATSSILSIRESLLSGERTAADITSEYLSRLRRTEPTLRSFIHVADAAAEREAEELDRRIASGEKDAVGPIAGVLVGVKDNLCTANMPSTGGSRILDGYRPAYDATAVRRLREAGAIVLGKTNLDEFGMGSTTEGSRVQVTTNPWDDSRVPGGISGGSAAAVSAEACVVSLRSDTRGNVRTPAPFCGVIGK

SEQ ID NO: 86362 - DNA, 953 bp, Zea mays
  misc_feature: Ceres CLONE 1572791
  misc_feature: Encodes the peptide sequence at SEQ ID NO. 86363
tccccgcggtggcggccgctctagaactagtggatcccccgggctgcaggaattcgtctcacccctagaaaaaaaccgctacccattgcaaacgctttccctccactcgtccgctccggccgcgcgcctccgccccacgccgatgccgcccccgccctcgcccccgccgcctctcggcctccgcctccgtctctccctcctcccgccccaccctatcgcgccttctatccgtcatgccttctgctcaccctccgtcgtgtcctgccatctttcggtgcgccccctcgcccaacgccgcggtgggcgcccgcgccccctctgcgccgcgcggggcgaggccgaggcggagggcttcacgtggccggatgggtccgaggaggagctgcggcggctcctgaagctgctccctagggagctgagtgggcgggtggagacccacccagagctcccggcgctcgtggaggtggtcatggacctcagccggcccccgctcgcgcgcttcccgtccggagacttcctcctctcccaacgccccatctccttcgacgacctccgtgacgctacctcccaggttggggactttggagcggataatcgtgctggaatcagccgcacgctgcaccggatcagcgccattaggtatcggaaaggcgtcattgtcagcctcacatgccgtgttgtgcgtgcagtgcccgggagcgctaatttgcttcacgatttggtgtaggacagtggctcattgctgctcatcggccccctggggtggggtagactactgtcataagagaaatgcccgtatgtgagctgatgactatacgaagcgcgtgatgatcgtcgacactctaatgagattgagccgggaatggtgatattcctcacccagaattcgttatgcacgtaggatgaaagtgcccttgctatacatgcagcctaagaacgattgaaccgatgga

SEQ ID NO: 86363 - protein, 194 aa, Zea mays
  misc_feature: Ceres CLONE 1572791
MPPPPSPPPPLGLRLRLSLLPPHPIAPSIRHAFCSPSVVSCHLSVRPLAQRRGGRPRPLCAARGEAEAEGFTWPDGSEEELRRLLKLLPRELSGRVETHPELPALVEVVMDLSRPPLARFPSGDFLLSQRPISFDDLRDATSQVGDFGADNRAGISRTLHRISAIRYRKGVIVSLTCRVVRAVPGSANLLHDLV

SEQ ID NO: 86364 - DNA, 954 bp, Zea mays
  misc_feature: Ceres CLONE 1572795
  misc_feature: Encodes the peptide sequence at SEQ ID NO. 86365
ccccgacgtggcggccgctctagaactagtggatcccccgggctgcaggaattcgtctcacccctagaaaaagaagaagacgatgaagataaatactaaaggaataattcaacagctaggtactagtgtagtagtagtactacgtaccaaaacgaggtctttgccgtgttgcgtggcctgaggttgtcctcaacgcataggcaaagccagccagagccagccagcaagcggctccatcccctcctgccgtgctgccaggagcttggcatctgcggatatgcaatctcggccgtcctgatcgagcagcgcggggccgagagatggagggtgcttcgtcttccgccgccggaggttcgtctttggcagcagcggtgcatggcggccggggccgggagaccggacccgggagggtgggcgcgaccaacatcggcaggctgcggcaggggaagcagcagcacgccacgaggcccggcgtgggggccatcagcgtcacgtcctggcacctccgggtgttcacagccgtcgtctccctcatgggctgcctccttctcgccgactccctcgccatgtccgcgctacaccaggtgcagctcatgtacgccgccatctccagtaacatcaggcggcctccacgagcttaggctgagcatcgtgaggatggcacctagtggagcttatcatgcatgcaaggcgttctgcaaatgggccacttcagatctcaataagaacggtctgggatcccaggatttccccgctttggggaaaagccctgagatcatacggggtaattggaagccctgggccggctaagattagcttggccggacgaaaaacctgaagaagggaaccaagcacgatttgctggtggttccactaaaacgtggggccttaaaaaaaaaagggtgcatgtgttgcaataatcttttaccacaccccttgttctaatgccccttg

SEQ ID NO: 86365 - protein, 106 aa, Zea mays
  misc_feature: Ceres CLONE 1572795
MEGASSSAAGGSSLAAAVHGGRGRETGPGRVGATNIGRLRQGKQQHATRPGVGAISVTSWHLRVFTAVVSLMGCLLLADSLAMSALHQVQLMYAAISSNIRRPPRA

SEQ ID NO: 86366 - DNA, 903 bp, Zea mays
  misc_feature: Ceres CLONE 1572797
  misc_feature: Encodes the peptide sequence at SEQ ID NO. 86367
ctccccgcggtggcggccgctctagaactagtggatcccccgggctgcaggaattcgtctcacccctagaaaaaaccctcccccaccgtcattgctcagcaggagtagtaaagccacgcctgacagacagctggttcatttctggttgctgccttgctggtggtagccctcggcgcacgcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaagtgatcctgcagcgacggcccttcatgtacgtggtgcgcgacctccgggagaagtacgggcccatcttcaccatgcggatggggcagcgcaccctcatcgtggtcacctcggcggagctcatccacaaggcgctggtgaagcagggccccatgttctcgagccggcccagagacagccccacccgcctcctcttcagcgtcagcaagtgcaccgtctactcggcaccctacggacccctgtggcgtgctctgcgccgcaacttcgtcgccgagatcgtgtcccctcaccgcgtcaagggcttctcctggatccgggagtgggccatggacgctcacttgcgccacctctgcgccgagctctgagctgaccgtgccgtgcgagtcatgcccagctgccgcctcaccatctgcagcatcctcatctacatctgcttcggcgacaagatccccgacgagctcatccagaaagatcgaagatgtgctcaaggacagcatgatgatgaccatgcgccatgctccaggaatgcatgccactcctcacactggttctcaggaaacaa

SEQ ID NO: 86367 - protein, 167 aa, Zea mays
  misc_feature: Ceres CLONE 1572797
  misc_feature: SWISSPROT Homolog: EC 1.14.13.89 Isoflavone 2'-hydroxylase
MDVNDVLLVVLAAALAAMWWRRCSKTGGVDGLPPGPPGWPVVGNLFQVILQRRPFMYVVRDLREKYGPIFTMRMGQRTLIVVTSAELIHKALVKQGPMFSSRPRDSPTRLLFSVSKCTVYSAPYGPLWRALRRNFVAEIVSPHRVKGFSWIREWAMDAHLRHLCAEL

SEQ ID NO: 86368 - DNA, 1000 bp, Zea mays
  misc_feature: Ceres CLONE 1572798
  misc_feature: Encodes the peptide sequence at SEQ ID NO. 86369
  misc_feature (354)..(354): n is a, c, t, g, unknown, or other
  misc_feature (898)..(898): n is a, c, t, g, unknown, or other
gcggtggcggccgctctagaactagtggatcccccgggctgcaggaattcgtctcacccctagaaaaaaactgcaacagcttggaagcagtaagcacgcatcgccgctccccatctcccccgcaccgcgcacctctatggccgccggcgaaggcggaggtggggacatcggcgccgactcggagcggcgcctgcaaaaggctatggataagctctaccacttccccaagcccaagtcgagtagcaccggtggctccaagccctcttcgtcgacctcggctccaagctccgggagagcggtggggaaggcagcggcggaggcagcgaggaggttcggggtggtgcgcgggtcccnactcccgcatcagatgttggccatggcagcgatctcgccgccaccgccgtggcgcccctgggaccgccgcgaacctcttgcgtcgtctccggtcattcaaaagcatgacctggttcgcccaagcccaagggtattttatccccgttaaactgtgccaaaaagaggataggacttaccttttgggccccgaatgtttttaaccaggggaaaaccttgtggggggaaacaaccccccgggtctctcccccccccttccccctctggggaaaaaaccacccaaattttaaaaaaagggcgcgccgcgcgggtgtttccaacccccaaaaagctggggacccccgggaaaataaaacccacctttttgtcccccggggattgtataaaacacctgggggaaggaaaaaaccttggggtttttttttacacccaaaaaaccccccccccccgttttgtttttggggggaaccaacaactgaagctttttgttcccccccccccgcgcccacttttttggcacctcccacaaaaattttctccggccccnctcctcggtgacccctctaaaaaaaagaagcccccgccgtgtaaggaggtccctttaaaaaaacatgttcctctctacaacgggtttctacagagaggggag

SEQ ID NO: 86369 - protein, 121 aa, Zea mays
  misc_feature: Ceres CLONE 1572798
  misc_feature (73)..(73): Xaa is any aa, unknown, or other
MAAGEGGGGDIGADSERRLQKAMDKLYHFPKPKSSSTGGSKPSSSTSAPSSGRAVGKAAAEAARRFGVVRGSXLPHQMLAMAAISPPPPWRPWDRREPLASSPVIQKHDLVRPSPRVFYPR

SEQ ID NO: 86370 - DNA, 882 bp, Zea mays
  misc_feature: Ceres CLONE 1572799
  misc_feature: Encodes the peptide sequence at SEQ ID NO. 86371
  misc_feature (882)..(882): n is a, c, t, g, unknown, or other
ctccccgcggtggcggccgctctagaactagtggatcccccgggctgcaggaattcgtctcacccctagaaaaaagatgaaactcccacccccaccgacgctgccgccgctggtacgcattcctgcttcctctcctcctcttcttcatcggcgcggcgcggcacatcgctaggggagaatcactcggatggaaatccgctgctagagtgagaggagctaccggacagtatcctgcgcgccttcgtcggcggcggaggggggaaggaagcgatggaggcgagcgccgggctggtggccagatcccacaaccacagcgagctcgtcgtcatacatcacgacggcgatcccgggccgaagccgcctccgcgggagcagaacgggcaggtgtgccatatttgcggcgacgacgtcggccttgcccccggcggggagcccttcgtggcgtgcaacgagtgcgccttccccgtctgccgggactgctacgagtacgagcgccgggagggcacgcagaactgcccccagtgcaagacccggtacaagcgcctcaagggctgccagcgtgtgaccggtgatgaggaggacgacggcgtctatgacctggacaacgagttcaactggaacggccatgactcgcggtctgtggccgactccatgctctaccgacgtggaggtgaccctgatggcgcgccacatcctttccaggtcatccccaatgttccactcctcaccaacgggcagatggtcgatgacatcccacctgagcagcacgcgctggtgccttctttcatgagaagtgggggatagagatccatcccctgccctatgcggatcccagcttacctgtgctacccatgtctatggtaccttcaaggatcttgctgn

SEQ ID NO: 86371 - protein, 177 aa, Zea mays
  misc_feature: Ceres CLONE 1572799
  misc_feature: SWISSPROT Homolog: EC 2.4.1.12 Cellulose synthase (UDP-forming)
MEASAGLVARSHNHSELVVIHHDGDPGPKPPPREQNGQVCHICGDDVGLAPGGEPFVACNECAFPVCRDCYEYERREGTQNCPQCKTRYKRLKGCQRVTGDEEDDGVYDLDNEFNWNGHDSRSVADSMLYRRGGDPDGAPHPFQVIPNVPLLTNGQMVDDIPPEQHALVPSFMRSGG

SEQ ID NO: 86372 - DNA, 980 bp, Zea mays
  misc_feature: Ceres CLONE 1572800
  misc_feature: Encodes the peptide sequence at SEQ ID NO. 86373
ggcggccgctctagaactagtggatcccccgggctgcaggaattcgtctcacccctagaaaaagcacgccacgcctcaccgagtcaccttcccagccagctacccttccccctaccaattccaaatctctcacccggcttgaggatggcggcgcaggtggtcgcagcggcgggcaccccggtggccaggccgctgggcggtggatctggggccgacgcgctccggcccgcggcgaggatgccaagggagagaaggaccggtgctgtggccgcgagaggacgccgcgagtctcaggtggtatccgtcataagccgcgccccacgccccgatgccggggtgctgccggtgtcgcccgacgacgacgcggccgtaaatgaatgtgcaaacctccagcacctttaagctatccagcaaacttgcaactgcagcaaatggcgtgttggtctaaacccaaatgtaaggcgcaagaacaaagattgtgtgtacaatcggtcccttcaaccaacccaagggaacttgatttgggaaacccccctgaaactgggttgaaatggggccccggctttattatgtcccttggaaaccctggcctccccccccaaaaattttttgtccctggaaaagggagaaaatgcgtccccctgcccgaaaagggggatgggcctcccggcgctgacacaaaggggaacaaaaaattccaaagggaaaatttccccccccccaattttttcggaaaagggaaaaaaattttctttttcccaaaaaaggggtgtggggacaaaacctggttttacataaaaaaaaaaactttttttatttgtttggggggccacccccccccgtaaaggaaagaaagattcttttgggaaacaaaaaaaaaaaattctaaaaaaaaatatttgcgggggggaaaaaaacgcgcccctttatttggggagaaaacccccccccctttaaggggggggggtattttgtggggg

SEQ ID NO: 86373 - protein, 85 aa, Zea mays
  misc_feature: Ceres CLONE 1572800
MAAQVVAAAGTPVARPLGGGSGADALRPAARMPRERRTGAVAARGRRESQVVSVISRAPRPDAGVLPVSPDDDAAVNECANLQHL

SEQ ID NO: 86374 - DNA, 939 bp, Zea mays
  misc_feature: Ceres CLONE 1572801
  misc_feature: Encodes the peptide sequence at SEQ ID NO. 86375
  misc_feature (939)..(939): n is a, c, t, g, unknown, or other
ctccccgcggtggcggccgctctagaactagtggatcccccgggctgcaggaattcgtctcacccctagaaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtacggtggtgttgaaggggagaagtttaagatctgttcaccagatcacgcgtgcgcgctcgcgaatcgggggttccacacatagcttcgtcgttttgaatttgatgtactaatggagtctaatggtggcaagaagtctagcactactcgttccatgatgtatgaagctccccttggctactgcattgatgacgttcgacctgcctgaggcgcaaagaatttccagtctgctgcttactccgactgcgcaaagaagccatcctgatatcccttttggcttcctcgttcgagaaggttatgatttcttttctgacacttcgattcttgccgatccccctggcctgctgctttcctgactatctaccagctccccagtcttgctccctgcaatgctccctcctccatctccagcgttgtgttctgactcacctggcccgatggctgttccttctgctgctggtgctccccctgcctcaactatcgtgtctgaagagcatgagaagcgccctgagacacattctctgaagctgctgactatgcggacccccatggcaacgattgcacgccctctacagggcccaaattgactccgtgctggatcttgcacggagcacgatcgcgtcctactctacaacaagattttgactccttggatctcacgtattcaacgtgttcatctgtctctgagatcgtctcaagaccggtggacan

SEQ ID NO: 86375 - protein, 31 aa, Zea mays
  misc_feature: Ceres CLONE 1572801
MESNGGKKSSTTRSMMYEAPLGYCIDDVRPA

SEQ ID NO: 86376 - DNA, 1035 bp, Zea mays
  misc_feature: Ceres CLONE 1572802
ccgctctagaactagtggatcccccgggctgcaggaattcgtctcacccctagaacacccggaccccggtctgcgtttgtccctgcgggctgcggccctgcctcttctcgtctcccgttcccctcgccgcgtgagctctctctctctctctctctcctctgtggtgacgactgggcgcccgcacccctggcagccgccgccgcccagtccccgtcgggcccttcggcaggtcttcttcggccccttcgccggcgacgagccgcaccaggcgtacatgtgtacacccagcccagggccttaactgcgcccgcccctgcgactggttttcctggctggtttctgtggatttggctgcccggaggattggtgcacccctttaagatcacgggtgaattcccctgtgaaaatccaaagggtgcgtcccgggcatgtttggggggacccaccgcaatgatatctgggggcttttaattcggggaaacttcattcaaagcacttgcccccttgaatttttgccccccgcctgtaaaaaggattccctcctgttgaaccaggaaaccttgcggttgaaccaaccccccccggcccgggtggggggggggggggcccccaataaggggaaggacaaaggggggggagggggcccttggggtgataattttgtttttttgccacaaaaagaaaaaaaaaaaaaataaacccggccagagtgggttttcaaagaggaaactcttgttagcccagaaaacccctgtgggccccccccaaaatagggagggggttctctctaataagaggggtgggataaaattataaaaaggggggggaaccccctcttctgggaggggataccccgcggggggaaattgggcgattttttttgtgcgcgggctccggctttttcaccggggtgttatttattttataaatgggcaagaggtgaataaaaatatttttctcccccccttggagggtggggggggaggttctacatcgttaaggcctgtgtcgttggattctctcccaaaaatattc

SEQ ID NO: 86377 - DNA, 905 bp, Zea mays
  misc_feature: Ceres CLONE 1572803
  misc_feature: Translation starting site: 185
ctccccgcggtggcggccgctctagaactagtggatcccccgggctgcaggaattcgtctcacccctagaaaaaatggagatacggacgagcatgtcagagcgaaggaatggactgcatggttcagcgacgacagctacctaggagcagcgacctatccgaatccgaatccaccaccgctaccgatgaccgtgcgcctccagctgggcgggctgacagcggccatcgacgccgtggagctccgcgacgggacggtgaaccgctgcctgtgcggcgatgatcgaccggctcctgagcgcgcgcgccagcccgcgccctgactcctccggggtgcgctactactacgtgaccatggacgcgtcccacggcatctgggcacacgtcttcacgccttgccgcagcggaccgaccgctccccgtggtggtgtacttccacggcggcggcttcgcactcttctccccggccatcgggaccttcaacggcgtgtgccgccacctctgctcatcgctcggcgccttaatagtgtccgtcaactaccgcctggtccctgatcaacgctgggccgccgcctacgacggcgtcgacacgatgcgcttactctacgcccgaagtggcttcccaggacatagacgacagcgtgcccgtctacctcaatacctgcttcctagcctgggactacgagagcggaaacatcgatgacgacgtagacaaccactgggcggacctcatggcagccgatcgcacgggacctccgctttcctgccttgctccccgtgcacggctacttcagcagcatggagcgcacgcccatccgatctggaactacagggcggggcgcccggggtcatcctcaggcgactcgaactcctcgtggacgccgatcataccatatagggctaccggaa

SEQ ID NO: 86378 - DNA, 894 bp, Zea mays
  misc_feature: Ceres CLONE 1572804
  misc_feature: Encodes the peptide sequence at SEQ ID NO. 86379
  misc_feature (388)..(388): n is a, c, t, g, unknown, or other
gcggtggcggccgctctagaactagtggatcccccgggctgcaggaattcgtctcacccctagaaaaaggatgcaacgccttccacacttgaagcagccaagctaagtgaggtgagcttagccatgccgacggcttcctctgcccaccgctcactcctcctctgcctctgcctggctctgctctccaacccggtcgccgcctcgccctcgccccgcggcctccgcttctccgccaaggacatcgcggcggtggaggccgcgctgccgcgacacggcagcagggcgtcgtcgtcgtccaagaccaccttcttcgaggtcgaccgcccgctccgcccgcccaggggcagctcggggccctgctccacgctgctgctctcgcactccttcncgttcacgctcaccaagccgcccgtcaccgcggcctactcgccgccgccgtgcctgtccggctccgacgcgccgccggtctcgctcgccgtgctcgagtggcgcgccgagtgccgcggcgcgcattacgaccgcaccttcggcgtgtgggtcggcggcgccgagctcctgcgcggcagcaccgcggagaccgcgccccgcggggtggtcttgtcggtcttcaaggacgtcacccgctacgcggccctcctcccggcgggaaaaccccctcgcttggctctccggaaactcttcgagaaacctacaaaggggtttacaaggcaaaccttaggtcacctttatttcgccccgggttggtggcgtccgcccccgccccccccccaaaccctttttcccggctccagaaaccggcccccaaaaaggggtttggttcttcttccaaaaaaacccaagggatcccccccccgggtttgcccccaacactaccgccccccctctagattactt

SEQ ID NO: 86379 - protein, 257 aa, Zea mays
  misc_feature: Ceres CLONE 1572804
  misc_feature: SWISSPROT Homolog: EC 3.5.1.52 Peptide-N(4)-(N-acetyl-beta-glucosaminyl)asparagine amidase
  misc_feature (89)..(89): Xaa is any aa, unknown, or other
MPTASSAHRSLLLCLCLALLSNPVAASPSPRGLRFSAKDIAAVEAALPRHGSRASSSSKTTFFEVDRPLRPPRGSSGPCSTLLLSHSFXFTLTKPPVTAAYSPPPCLSGSDAPPVSLAVLEWRAECRGAHYDRTFGVWVGGAELLRGSTAETAPRGVVLSVFKDVTRYAALLPAGKPPRLALRKLFEKPTKGFTRQTLGHLYFAPGWWRPPPPPPQTLFPGSRNRPPKRGLVLLPKKPKGSPPRVCPQHYRPPSRLL

SEQ ID NO: 86380 - DNA, 877 bp, Zea mays
  misc_feature: Ceres CLONE 1572805
  misc_feature: Encodes the peptide sequence at SEQ ID NO. 86381
ctccccgcggtggcggccgctctagaactagtggatcccccgggctgcaggaattcgtctcacccctagaaaaatcttctctctccttcttcctcggtcctctcctctccgcatttcgggaggccacttgtggcggcgtatctagcgtactacagctccctgcatggtgatggaggggcgcacgggctcactctacgggcgcctcaacaagagcagcacgcgggggttcctcgcctacaccgccgccagggctgcctgcgcggctgtcctctcctgcttcgtgctctccgcctcggactcgccggcatctgctgcgcgcaacgatggcgagcgcctccgcctgtcctcgcgctcaccgcgcgtctggcccgacctcgcgttcaactggcgggtggtggtcgccaccgtcgtcgggttcctcggttccgcttttggcaccgtccgcggcgtcggcggaggcaggatcttcctgcccatgctcaacctcgtcgtcggcttcgacaccaaatccgccgccgcgctctccaaatgcatgatcatggggtcctcggcgtcatcagtttggtacaacctccaggtgtagcacccgaccaaggaggcgcccgtcatcgactacaagctcgcgttgctcttccagcccatgcttatgctcggcataaccatcggcgtagagctcagcgtcatcttcccatactgagctatcactggtctcattataatcctcctcgtaggcacctcgtcgatgatcttctacaagggcattctgatgtgggagggaggaggtcaggattctgatggagaccccgggagaaaacagcaatcaagtctacctgcgctgcaaatgaagtggccatggatcccaggtttgggagaccca

SEQ ID NO: 86381 - protein, 139 aa, Zea mays
  misc_feature: Ceres CLONE 1572805
MVMEGRTGSLYGRLNKSSTRGFLAYTAARAACAAVLSCFVLSASDSPASAARNDGERLRLSSRSPRVWPDLAFNWRVVVATVVGFLGSAFGTVRGVGGGRIFLPMLNLVVGFDTKSAAALSKCMIMGSSASSVWYNLQV

SEQ ID NO: 86382 - DNA, 905 bp, Zea mays
  misc_feature: Ceres CLONE 1572806
ccgctctagaactagtggatcccccgggctgcaggaattcgtctcacccctagaaaaagaaaaagttgggatgtggctctcctgttagttgaggatgctatctttcgttttttcaacaaaacttttatctcgtagatgccactacttcgtatgctcgtctcgctcttggtcttcgcaggcttgctcggtatctcggcctaggccgacggggggctcgcgtgcgctgccgataggaagggaactaccgcgcgaacgcttcttggtaggctgatacggcggcgatggcgagtctggtggacgaagaacaaacgtacgacaagataatgctggggatgctcaagctggccgtcatcgaagggtgcatcgactgtaagaattccagaccactagatgtctgcataaatttctggaccctcgtttgctccaattgcagaggcacacatctggagttcacgcatcgagttggatcgcgttccacggtcaaatttagtgcacaagaaggtactgcccttcatcatgtgggaatgaacgagctagagagcacttctgggggagcgagattctcacggaaaggatacccggaatgcagtaaaggtgacaaattgagaaattgcataaacatgtgtatgtgggaaggaaatccccgggtaaataagtactgttacgcccccaggggggatggaggacaagatggagttcggcaaaaggggagacccgaggaaatttgggcgggtgcaagaagtcgccaaaaagaaggtacccccgttcgggggaatttcgtggacggagttgaatgacaaaattccaaatttttctattggggacggtttcccgggctttggcccagttggctctcggaaaaccccccacactttagaggtggggtttaaaactttggttaaaac

SEQ ID NO: 86383 - DNA, 945 bp, Zea mays
  misc_feature: Ceres CLONE 1572808
  misc_feature: Encodes the peptide sequence at SEQ ID NO. 86384
acccgcggtggcggccgctctagaactagtggatcccccgggctgcaggaattcgtctcacccctagaaaaaacacgcctcttctccccccccaaaaaatccagcagcagcagcaagccccacgcaacattagcagcaggagaccaccccaatcccccacggacattcgtcgcgaacccttatctgcacgccgcgccatggccgcagccgccgcggtcgcccacctctccatccacggccgcctccgccgctcaccggagcatcggccgtccatcaccaccaccaccacctcctcctcttcctcgtccgctcaccgcccgtccctcctgcggtgccgcgcgttcaacaagaggcccgcgaacgcgaacccgctgaagccgacccgcggaaacccaagatgggcccgctgtacaagctcaaggcggcgatccagggcctcgcgggatcccgctccgccgcccgccgaagtgtaccgggggagagtaccaataccagcgcgccctcgaaaagggcggaggagaactttctttctcgggtggctactcagctaagcaggatatgttattcactatgatggagcagcggtggtggtacttggggggtgggattccaccctgttcagggcggagaacgcccaaatggaacgaaactaaatttgggataacctggcctgggggggggggaattatcgggacaattgataggggccaaacagggtcctcagaagaacactgccaaaactgggaccccgccaagggggtcctaaccgggaaacacaaaaagggttaggaaaaacgccttggccccggaatttcctctcttcccggagaacccgggttgtaatttacttcacaaagacccgtaacaagcccctccgaaacttataaagaacctgaaaaaacatatccggaagagggttctgttgcccaaaaaaaaacaaagaaa

SEQ ID NO: 86384 - protein, 58 aa, Zea mays
  misc_feature: Ceres CLONE 1572808
MGPLYKLKAAIQGLAGSRSAARRSVPGESTNTSAPSKRAEENFLSRVATQLSRICYSL

SEQ ID NO: 86385 - DNA, 713 bp, Zea mays
  misc_feature: Ceres CLONE 1572810
  misc_feature (310)..(310): n is a, c, t, g, unknown, or other
  misc_feature (311)..(311): n is a, c, t, g, unknown, or other
  misc_feature (623)..(623): n is a, c, t, g, unknown, or other
tccccgcggtggcggccgctctagaactagtggatcccccgggctgcaggaattcgtctcacccctagaaaaaagagaccagagagaggccaatggcgagggagtagctcgcggcggaccagagaccagagagcgagagcgagcaaagctcacaagggcgaagcggaattgattgcgaccaccaccaccacgtcttctccacctccgtccgatccgtcgtcaccaagccaccatcattggcgcaccgcgccgcccgcccagctgcgcattcttaaactgttctctcttggcttatcggcgaagtgttgcnngtttgccggggggtactggattgccgaaagcaacccggccgttacctgtgcgtttgctgcccctgggcttgccccagtgaactaggggggaaaaaacccaaggggggaagaaaaaacccccccccccccaacccccccctctcatttaaaaggggggtttaaaggggggcggccccctttggggcctttaaccaaaaaaaaaaccaaaagccgggaaaccccaaaatataaaaaaaggggggggggattaaccccccccccccccctcaaaaaaagaggagaaaatatatttttttccccccccccccccgnacccaaaaatttttcccctcccccccccccccccccggggggggggaaacaccccccccccccccacaaaaaaaaaaagaggacacctct

SEQ ID NO: 86386 - DNA, 921 bp, Zea mays
  misc_feature: Ceres CLONE 1572812
  misc_feature: Encodes the peptide sequence at SEQ ID NO. 86387
ctccccgcggtggcggccgctctagaactagtggatcccccgggctgcaggaattcgtctcacccctagaaaaaccctcacagtcacagacacacaccgctgcttcaagaaaccaccgagagcccaaccgcacaggcaggagagagagcagggagccagggacagtagcgtggggccggggagcaacgatggaggggaaggaggaggacgtgcgcctgggcgccaacaagttctcggagcgtcagcccatcggcacggcggcgcagggcgccggcgcctgggacgacgactaggactacaaggagcccccgccggcgccgctgttcgagcccggggagctcaagtcctggtccttctaccgcgcgggcatcgccgagttcgtcgccaccttcctcctcctctacatcaccgtcctcaccgtcatgggcgtctccaagtccacctccaagtgcgccaccgtcggcatccagggcatcgcctggtccttcggagggatgatcttcgcgctcgtctactgcaccggccgcatctcccgaagacacatcaacccagctgtgaacttcggggctgttcttggccaagaaagctgtccctgactaggggccatcttctacattatcattcaatggccctgggtggccacccggtgggaaactggaaatggtgaaaagggccttcccacaagggggctttataactgggggaaaaggcgggggtgggggcccatatttttttttcccccccgcggggggtcacccaaaaggggggggagttggccccttcgccccccaaaaatattgttgggacaccctctcctccggtggtgtagtacccacatttttctttggcggccccttgttttaaataagaaaaaccccgggagggtctctctgtggtgtgccccctcttttttccaaccct

SEQ ID NO: 86387 - protein, 57 aa, Zea mays
  misc_feature: Ceres CLONE 1572812
MGVSKSTSKCATVGIQGIAWSFGGMIFALVYCTGRISRRHINPAVNFGAVLGQESCP

SEQ ID NO: 86388 - DNA, 1011 bp, Zea mays
  misc_feature: Ceres CLONE 1572813
ctccccgcggtggcggccgctctagaactagtggatcccccgggctgcaggaattcgtctcacccctagaaaaagtcttttccattcccatttgttttggcggcggcggctgccgcgccaccagctttcctgtgcctctttagactcgagggctatttctcctcctcctacctctcggcctcgtcctcatacaagcgccattgtaaattttcgggcagcagctaactagcctgtcgactcctccctcttgttcttggctactgatcctgttctgtccgtgatatacaacaaaacaaagacttggtctttttcctctgcgtgagcgaactgagtgaaggagctcacttcttcgaacagccggagcctggagcagcagttgagctccccctgagaaaccccaaccacagcgcctttgttgctctccgcacaatgaacaggcagctcgctcttcccatcaggaacagctcaaggctccaacgtgagggtgaaggaaggactcagtcccgccatgggaaagggattccaggtccaggggttgcttctcaaaaacagagtccctgctccaggcactgccgaggttccgtttaattaccaaatttgaattctgccaacgccgggaaccctttcaccggaaacctttcttgaaaacccaccattaatggccccaactggaacattgttcgtccaccgaagttctccccacatgcaaaagcccttccacccgaaaaaaaaaaaaaagaatgttccaaaaaaatagacacctccccgggaatttcccccaaagcaatttgcccagggtctttcccccccttaaaaagcaaccctaacgggcccccgaaagagctggctccaaaaccggtttgcaaatattgttgggggagaaatgcccaccccttttaccaggaattcttctccaaaggaaaattggcctgtctccttcctatagaaaaaaaccgttggaccatatccctttttggaagagcggggctcccacaacccaaaacactgtgg

SEQ ID NO: 86389 - DNA, 881 bp, Zea mays
  misc_feature: Ceres CLONE 1572817
  misc_feature: Encodes the peptide sequence at SEQ ID NO. 86390
aaagctggagctcaccgcggtggcggccgctctagaactagtggatcccccgggctgcaggaattcgtctcacccctagaaaaagtaggagtacgtggactatgccaatcccagagttggtgtataacggcgaaagccctcagggctctcttttcccctctgctccttgactcactcacttggccaatccctctactcctcattaatccactctccagcacttgttccgaagaaaaagaagctataacacgatcaccagactagaaggatcacggggcgaatgcgaagacagctcctgctgccggcagtatccgcctgactatggaccctgtatcgcgcactgctgatgcatcgagtcccctcacagcgctggggccggcgccggcgggctgctgagggtcgagctcagcaggcgcggcggcggcctcgaccaatgagcgatggatgagaccaaggccgctagggaccacgaggacaaccttctcgtggcctgctgcgtctgcgacctccctatactcgactacttcatcaccgagtactatggggtcgtcagcatcgagacaccgccgcagaacttcaccgtcatgttcaacaccggcaggtccaatctctgggtcccctcctccagatgctacttctcgattgcctgctacctgcaccacagatacaagtcgggcaagtctatcacgctcaatgcaagacgcgatgactgctggatcacctaccggtgcagatgaatcgcctggctcttacgaaacgacgacatgctggtcagggacctcaccgtcttaaaccagaagttcatcgagacaacgcgtgcaagcaacgtaacgttcgacatcagcaagtgagacggcatccttggactcggataccccgaa

SEQ ID NO: 86390 - protein, 98 aa, Zea mays
  misc_feature: Ceres CLONE 1572817
  misc_feature: SWISSPROT Homolog: EC 3.4.23.40 Phytepsin
MDETKAARDHEDNLLVACCVCDLPILDYFITEYYGVVSIETPPQNFTVMFNTGRSNLWVPSSRCYFSIACYLHHRYKSGKSITLNARRDDCWITYRCR

SEQ ID NO: 86391 - DNA, 974 bp, Zea mays
  misc_feature: Ceres CLONE 1572822
  misc_feature: Translation starting site: 269
  misc_feature (974)..(974): n is a, c, t, g, unknown, or other
ctccgcggtggcggccgctctagaactagtggatcccccgggctgcaggaattcgtctcacccctagaaaaaagaaaaaactcccacccccaccgacgctgccgccgctggcacgcattcctgcttcctctcctcctcttcttcatcggcgcggcgcggcgcatcgctgggggagaatcactcggatggaaatctgctgctagagtgagaggagctaccggacagtatcctgcgcgccttcgtcggcggcggaggggggaaggaagcgatggaggcgagcgccgggctggtggccggctcccacaaccgcaacgagctcgtcgtcatacgtcgcgacggcgatcccgggccgaagccgccgccgcgggagcagaacgggcaggtgtgccatattttgcggcgacgacgtcggccttgcccccggggggggagccctttcgtggcgtgcaacggagtgcgccttcccccgtctgccggggactgcttacaagttctaagcgccggggagggcacgccaaaactggcccccggtgcaaggaacccgggtacaaggcgccctcaagggggttgccacccggggtgggccgggtgttgagggagggaggaacgggccttccaatgaaccctgaaaaaaccaaagttccaactgtggaaaggggcccttgtcttcccggggccctgggggcgggaacccctgtggctctatgggggggggtggaggggggaccccttatttggggggccccaaaaaacttttctcaggggcaaacccccagtggtcccccccccccccccaaggtggggaagggggcaattaaaattcccccctcggggagcaccccgcgcgggggtgctctttttttgtgggggggggggggaataaaaataccccccccccctttatggggagacccctttttgtggggccccctgtttttgggcccccccaagatttttgcaattagggtttgtgn

SEQ ID NO: 86392 - DNA, 873 bp, Zea mays
  misc_feature: Ceres CLONE 1572823
  misc_feature: Encodes the peptide sequence at SEQ ID NO. 86393
  misc_feature (782)..(782): n is a, c, t, g, unknown, or other
ccgcggtggcggccgctctagaactagtggatcccccgggctgcaggaattcgtctcacccctagaaaaagaagcgaaagcgaggctgctgtctcacggctgcggctgcggctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccgtcggactcgaggggctgctcgcctcgctcgcgtccaccgggttccaggcatccaacctcggcgacgccatcgacgtcgtcaaccagatgactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgaggtaagcatacctgctggggtcaagctatcnaatatttcttctgggctgaacaaatgtacttgctaaccatggctttccattttgcgtatgcagttgctattcaatactacaagtggtatat

SEQ ID NO: 86393 - protein, 95 aa, Zea mays
  misc_feature: Ceres CLONE 1572823
  misc_feature: SWISSPROT Homolog: EC 2.5.1.46 Deoxyhypusine synthase
MVDVIVTSAGGIEEDLIKCLAPTYRGDFSLPGALLRSKGLNRIGNLLVPNDNYCKFENWIMPLFDQMLQEQSTEVSIPAGVKLSNISSGLNKCTC

SEQ ID NO: 86394 - DNA, 938 bp, Zea mays
  misc_feature: Ceres CLONE 1572824
  misc_feature: Translation starting site: 166
gctctagaactagtggatcccccgggctgcaggaattcgtctcacccctagaaaaactcctgcctggactatatcatcagctcccgaaatcctaattgaaacagttgcaggcgattctgagctcgggttttgttccggggacggattcctgtgccggcggacgggatgtctggccctctcgaccgatttgctaggccatgctttgaagggtttgtacgtagcgatgaaaggaaagagagcagatctgatgcagactactcagaaggagataagaagactaagattgggtctttcaagaaaaaagcaattaatgcggggaacaaattcaggcattccttgagaaggagaagcaaaaaaaagaccgaaaggggggattccctccaggacataagggacgttaaagagcttcaagatgttgagacattccgacaatgcttaattgatgaggatttgctgccaccacagcacgatgattatcacatgatgttaaggctcctaaaagcacgtatatgtgaagttgagaaagctaagagtatgtggtcagacatgatcacttggaggtagggattcggagtcgacaaaatagaggaatttgactacaccgagttagatgaggtgacagagtattacccacaatttatcctggagtagataaagatggtagacctgtctacatagaattagtagaaaagttgatgcatacaagctaatacaagtgacaaccctagatccgtatgtaaaatacctgtcaaagaattcgaaaaggcttccagatgaatttccccctggccccttgttgctaaaaagcattaattcgccccctaccatttgggtgtggcaaggccggggttcaaaaactttccaaatccgccgaaatatttcccccttttccgaatacaacgggtaactccccaagacctggccggttgttttaatat

SEQ ID NO: 86395 - DNA, 942 bp, Zea mays
  misc_feature: Ceres CLONE 1572825
  misc_feature: Encodes the peptide sequence at SEQ ID NO. 86396
  misc_feature (860)..(860): n is a, c, t, g, unknown, or other
ctccccgcggtggcggccgctctagaactagtggatcccccgggctgcaggaattcgtctcacccctagaaaaaacaaaaacccttccgccccgagccgaccggaaccctacccatcccgcagcgccgccggccgcccgccccgccccgccccttcaccccctacctcttcttgcgccgtcatcccgatcccctacgctcgctgaggcattatgggtaaatcaagcaagaagtccagtgttaaggctgcacctgctgctgtctcagttccagaggtgaaatctgcaaagaaggggaagagaaatgcagaagatgagattgagaaggccgtgagtgcaaagaagcaaaagactgtacctgaaaaagctgtgccggttaagaagcagccccctccaaagaaagttgagagcagcagctctgaggaggattcttcagattccgaagtggaggttaaggtccagccgaagaaggttattcaaccgaagaaaggtacacaacctgctaaacaggagtccagtgatgacagcagctctgagagctcctcagacgatgaaccttccaaaaaaccagttgccggttcaaaaaagcctcctgccagtagtagcagcagtgatgatagcagtgacagtgatgatagtagctctgatgaggcaccagcatagaagcccacggtcctttcatagaagcccactgtcctttcaaataaacatgtcacagcagtcagtaatggttcaaaacacgttaaacctgatagcagcagctctgacagtagctcagatgaagatgaaaacctgctgctagccctaaagtagctggtgttgcctctgtgcaaaagagaccaacgatctgatagctctgacngtgattctgatgaggatgaatcccagatgatttccttgctatagctcagtagtagccaagaaaaggagagtcccgtagcagt

SEQ ID NO: 86396 - protein, 149 aa, Zea mays
  misc_feature: Ceres CLONE 1572825
MGKSSKKSSVKAAPAAVSVPEVKSAKKGKRNAEDEIEKAVSAKKQKTVPEKAVPVKKQPPPKKVESSSSEEDSSDSEVEVKVQPKKVIQPKKGTQPAKQESSDDSSSESSSDDEPSKKPVAGSKKPPASSSSSDDSSDSDDSSSDEAPA

SEQ ID NO: 86397 - DNA, 922 bp, Zea mays
  misc_feature: Ceres CLONE 1572826
  misc_feature: Encodes the peptide sequence at SEQ ID NO. 86398
  misc_feature (896)..(896): n is a, c, t, g, unknown, or other
ggagctccccgcggtggcggccgctctagaactagtggatcccccgggctgcaggaattcgtctcacccctagaaaaaagccctcgccatccatggccaccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgccgccgcccccaaccatgtccaccaccctccccatcaccaccagtcggtgcctcccccaggaccccctccacagtggtccgcgcagggacatccgcctccgccgccccgtggctatgggcctccaccgccgcagcaccagcatgtgccgcctccgccaccacgcggctacggacctccaccaccgcctccacacggccacgtacctccgccgcctccgccgcgacacggccacgggcctccaccaccgggccagcacgtactgccgcccctgctaccacacggtcacggacctccgccaccgggccagcacatgccaccggcacacggccacgggcctccaccaccgggccagcgcgtaccgccgcctccgccgccacacggccacggtcctccgccaccgggccagcacctaccgccgcctccacaccagacagacacggtgctgcacccccgcaccagcaggcaccgacgccgcctgatcctgttgcggggcctggggagctgatgggactgtgccgggcaggggcgggtaaaggatgcccgtggagcttctctccaagggtgcgcgcaacaactgggacaccttctaggagctcgcggggcacctgcttccaacccttaagctgctggaaggagctcaggtaggtggcangattttcgtcctccggttcgcctttc

SEQ ID NO: 86398 - protein, 218 aa, Zea mays
  misc_feature: Ceres CLONE 1572826
MATTAAIHLRPLRSVAVSSARSRSLLHLLARPLSSSQSSYAYRPSPTAPAAAAPNHVHHPPHHHQSVPPPGPPPQWSAQGHPPPPPRGYGPPPPQHQHVPPPPPRGYGPPPPPPHGHVPPPPPPRHGHGPPPPGQHVLPPLLPHGHGPPPPGQHMPPAHGHGPPPPGQRVPPPPPPHGHGPPPPGQHLPPPPHQTDTVLHPRTSRHRRRLILLRGLGS

SEQ ID NO: 86399 - DNA, 899 bp, Zea mays
  misc_feature: Ceres CLONE 1572828
ctccccgcggtggcggccgctctagaactagtggatcccccgggctgcaggaattcgtctcacccctagaaaaagtcttgccttctcttctctacctgccgcacccgcacagccacagccaaccacacaccccacatcacaacagctccctctgcatctccgcctcgtcgacgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgcgttttcagtaaggagcacataacgcccttagggaatgcagaaagatgtgctcgcacgtccgaagaactacttttttgagggacttgggcaggaaaagcacggccatacccctttcattcttctggccacctccttggattgacttccgaaagcctcaaaaagatacacgttttccccccaccctcctggcctttttcccaaaaatgggtggtttagaaaaatggggggggctcaaaaccctttctttacttaagaataacccaatcccgggtggggaaaacaagtttttaaaaaatttttttaaaacccccctccaaaaacagtttttggggggcccccacaaaattttttttttttcccgggcccaagggaataaaaaaagggggaagcctcttttggttcgaaacaccccccccccccccctctcggggtataataacaccggggccccaaaagtgggaaaaaacattaaatggggaaaatttttctttttttcaaaatttttgttaaataaaggggaaaaattttggtggggaaacagaaccccccttttcacaagtggttttaacacgagcctct

SEQ ID NO: 86400 - DNA, 969 bp, Zea mays
  misc_feature: Ceres CLONE 1572830
  misc_feature: Encodes the peptide sequence at SEQ ID NO. 86401
  misc_feature (694)..(694): n is a, c, t, g, unknown, or other
ctccccgcggtggcggccgctctagaactagtggatcccccgggctgcaggaattcgtctcacccctagaaaaagtcaccgtcaccgccgctttccgagctctcatggcggcgtccgcgtcctccctccttgccgcccccgcatcctcatcctgtggggccatctccccccagctccctcgtggagctccggccgctgcctccgtcgcttcgccgtcgcgtcactcctgctacctcctccgcgcttccccttcgaggcgccatcggagtcgcttcgtagccaacgccgctcccaccatgcagcctccggcggagtccagggtctccacggtagtcgatgtcgacctcggcgaccgtagctatccgatctacatcggcgcaggcctcctcgacgagccggacctgctgcagaggcatgttcatggtaagagggttctggtggtgaccaacacgaccgtcgcgccgctttacctggacaaggtgacatgggcactcacccacgacaacctgaatgtatcagtggaaagcgtgatcctgcccgaccgtgaaaagtacaaaaatatgacacgctgatgaaggtgtttgacaaggcagtcgagtcccgttttgacggcagtgcactttgtacactgggtgggggtggcatggggaaaatgggtgggtttgaaactgccgcattcccccggggggtaaantcctaacaaatccaacacttcgaagggccaagccaaaacctttttttggggccccaaagtgggttaaaaaaaagtttgggtccaaaattgccccggaaaaccccttaagggggaatccccttgggggggaaaacccgggtttacccccccatgaaaaactggtgggggggttctcccccccacgtggttttattaaaaaaaatcaaataaaattcccggagagagaaactcccaccctcccagaaaaataatagggcgcaaaagagacccctttt

SEQ ID NO: 86401 - protein, 155 aa, Zea mays
  misc_feature: Ceres CLONE 1572830
  misc_feature: SWISSPROT Homolog: EC 4.2.3.4 3-dehydroquinate synthase
MAASASSLLAAPASSSCGAISPQLPRGAPAAASVASPSRHSCYLLRASPSRRHRSRFVANAAPTMQPPAESRVSTVVDVDLGDRSYPIYIGAGLLDEPDLLQRHVHGKRVLVVTNTTVAPLYLDKVTWALTHDNLNVSVESVILPDREKYKNMTR

SEQ ID NO: 86402 - DNA, 962 bp, Zea mays
  misc_feature: Ceres CLONE 1572831
  misc_feature: Encodes the peptide sequence at SEQ ID NO. 86403
ccccgcggtggcggccgctctagaactagtggatcccccgggctgcaggaattcgtctcacccctagaaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgacaaaaaagagggtggtccacttcggcaagggcaagagcgagggcaacaagaccatgaaaggactgctgggcggcaagggcgcgtacctggccggaaatggcaagcatcggggctgtcggggccccccgggttcaacgtggtcaaaggaggcttggcaacattaccagaaacccggggggcccctccccccggggcctggggcccaaatccccaacgccccgcaagggggggaaggaataaagggggccccccctggggaaaaccaagggccccccctcggttccccccccctcccggggcccccgttttttttcccgggaaaaggaaaaaggggccaacccggggccaaaaaaaaaaatgccccccgggtgggggcaaaaaaaggggaaggttttccctaaaaaaccccgcgccccttcccaaatttgcgaaaaactcttgtgaaaccccccccgtcttaaa

SEQ ID NO: 86403 - protein, 205 aa, Zea mays
  misc_feature: Ceres CLONE 1572831
  misc_feature: SWISSPROT Homolog: EC 2.7.9.1 Pyruvate, phosphate dikinase
MAASVSRAICVQKPGSKCTRDREATSFARRSVAAPRPPHAKAAGVIRSDSGAGRGQHCSPLRAVVDAAPIQTTKKRVVHFGKGKSEGNKTMKGLLGGKGAYLAGNGKHRGCRGPPGSTWSKEAWQHYQKPGGPLPPGPGAQIPNAPQGGEGIKGAPPGENQGPPLGSPPLPGPPFFFPGKGKRGQPGAKKKNAPRVGAKKGEGFP

SEQ ID NO: 86404 - DNA, 900 bp, Zea mays
  misc_feature: Ceres CLONE 1572832
  misc_feature: Encodes the peptide sequence at SEQ ID NO. 86405
  misc_feature (595)..(595): n is a, c, t, g, unknown, or other
ccgcggtggcggccgctctagaactagtggatcccccgggctgcaggaattcgtctcacccctagaaaaagctcgtgctcgtcctctgccagcaccgtagccaccgacagagcacgcaccatgacgaggaccaccaccagcagcacgctgctgacagcggcgctgctctgcctcgcgctgccgctgctccccggggccacggccaataaggcggcgcggcggcggcagggcgacaacctggcgcgcctgcgcgggtcgccgtggccggccgagtcgtccgtgtcgctggcggtcgcggcgactgatgacagagcgtcccggcacgcggcgtcaccgcccgcggggcgcagcatggaggacgaccgcgtggacaagctgcccgggcagccgtcgggcgtggacttcgagcagtacgccgggtacgtgacggtggacgccgcggccgggcgcgcgctcttctactacctgaccgaggccgtccgcggcggggcggcggtcaagccactcctcctctggatcaacagacgcccctggtgctcgtcgctggggtacggcgccatggacgagctgggccctttgcgggtgaagagcgacngctagacgctgtaccgcaacacgtacgcgtggaaacacgcggcgaacctgctgatcctgtataccccacccgcgtggggctctgctactccacgagaacgaggacttctgccagaacgggtacaacaaaacgccgaggacgcgctcatgtccaggcccacgtggatgggaaattcccccagttaaggggccccactttaaccccccgcgaaagaaaccggccacttctccccggggggaaaaaaaatcctcgggaaaggcggcgggccccctaaaaccctggatccccccttacccctttaggtt

SEQ ID NO: 86405 - protein, 158 aa, Zea mays
  misc_feature: Ceres CLONE 1572832
  misc_feature: SWISSPROT Homolog: EC 3.4.16.6 Carboxypeptidase D
MTRTTTSSTLLTAALLCLALPLLPGATANKAARRRQGDNLARLRGSPWPAESSVSLAVAATDDRASRHAASPPAGRSMEDDRVDKLPGQPSGVDFEQYAGYVTVDAAAGRALFYYLTEAVRGGAAVKPLLLWINRRPWCSSLGYGAMDELGPLRVKSD

SEQ ID NO: 86406 - DNA, 923 bp, Zea mays
  misc_feature: Ceres CLONE 1572833
  misc_feature: Encodes the peptide sequence at SEQ ID NO. 86407
  misc_feature (600)..(600): n is a, c, t, g, unknown, or other
ggagctccccgcggtggcggccgctctagaactagtggatcccccgggctgcaggaattcgtctcacccctagaaaaaagtcggggagaagtggaagtggactcgaggatcactctcgctatcgactacgctatctcaactgccacggacaatcgaaaccaacagtgagagctagcctcgccaaaccgccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggacgcctgcagcagcggcgggccctctaccagccccgcctcccgccatgcctccagggaccgacggtaagggcggagtacggtgacgcgaccacaaccatagatcccacctgtgcccaagccgtcgcgcaggccttcccgcacacctttggccagccgctcgtcagcttcgtcgcgccgggcgccggcgcccgggccnttgaggagcgccccccgatccgggtgggcgtggtgttccttgggaagaagcgcccgggaggggacaacgccttctgggggcctcatgaaccacttaaacctacaaccctccaacttgctctaccggttccccggggggcccggaaggactggtttcaaacaaaaccttggagatcccaaagaaggttcctgcttcccaaaaaacaaggggggttccgatttgcccgggagaaggtactaatcgagcccgccccaccaaccaaggtgaagggccgcatggaaaaagggcccaatttagaacttggggggggtgtgggctctctt

SEQ ID NO: 86407 - protein, 186 aa, Zea mays
  misc_feature: Ceres CLONE 1572833
  misc_feature: SWISSPROT Homolog: EC 2.7.1.90 Diphosphate--fructose-6-phosphate 1-phosphotransferase
  misc_feature (79)..(79): Xaa is any aa, unknown, or other
MNADFGAPKELAGRLQQRRALYQPRLPPCLQGPTVRAEYGDATTTIDPTCAQAVAQAFPHTFGQPLVSFVAPGAGARAXEERPPIRVGVVFLGKKRPGGDNAFWGPHEPLKPTTLQLALPVPRGARKDWFQTKPWRSQRRFLLPKKQGGFRFAREKVLIEPAPPTKVKGRMEKGPNLELGGGVGSL

SEQ ID NO: 86408 - DNA, 804 bp, Zea mays
  misc_feature: Ceres CLONE 1572834
ctccccgcggtggcggccgctctagaactagtggatcccccgggctgcaggaattcgtctcacccctagaaaaaatcattaaaaaaggacacggaaacttaatccgatccaccaaacaaaaatccctgtctctcgcgcagggcaccgccacgcgcgcctcatccggtaccgccatgacgtgcgccagcacctgcacaccgtgagaatccgtcgccccagtctccctcccgcttgattattgtcgtatcagttgtgttgtggctggatcggagaatcaccggcgctggcttatacaattcgtggacactattaggattaggctcgcgcggaattcaatgatgaatggaaatgccgattttatgatcatggttacatagctcgggaaatgggtaccgatagggattacgcacttgcatttgttaccggggttgaacctgtgtattttttttgccaacatactggggttaaactttcaacgttctaattggtgaaatactgaaatgtatcggatttgtaatcctatctgagattctgaaccaagcttcataatcccacaggcactggactaccatgttgcacaaagagtgaaacgacaaacgagccttgttcattatagtagcagtgatcgagcttggcatcatgtagtcctgaacgctttgtgcgattgtagctcttcccgcagtgaaaatttcgatatgacacagggtcgttgctagttctgggcctgtgggattatttttgcgggaaacttagtgcacagtttccttaggtcatggtttaaatgaccaactacgaaaatagcta

SEQ ID NO: 86409 - DNA, 900 bp, Zea mays
  misc_feature: Ceres CLONE 1572838
  misc_feature (790)..(790): n is a, c, t, g, unknown, or other
  misc_feature (892)..(892): n is a, c, t, g, unknown, or other
ctggagctccccgcggtggcggccgctctagaactagtggatcccccgggctgcaggaattcgtctcacccctagaaaaaaacatcgccccgaccaaagcttccccagacggcaggagacagcagcaggccggacgccggactcctcctccctcccccgtacgcatccactgactgagatccttcctgtgcgaaggaaatctccagttcttcggccccggccaggttttcaagtgttgcttgccccgccggagttttcctctaacccgcagtccaattggctaagaagttgatgggatcggggggacactggaaggctgtgtgagatcgcgaaggggaccgtgaattccttgcagggctgcggcgattcggctgcgctgctgtatgaactgtttcgtgaacctgggactcaactcgaactcgaaccactacgtcgcctgcctcctcatcttcctgctgcatttctcccctcagttgttaaatccatccgattttaattctcatagtaattgtgaaggagaacaacagagctgcacagatggcgaacaacagctcatatggtgaaaatgctaggagaaagccacacacaccatctgctattgttatttggtggtgggtttgctggtcttgctgctgctgatgctctcagaaatgcatccttccaggttattctactggaatctcgtgataggattggtggcagagttcacactgactactcttttgggtttccggtcgatttgggagcatcttggcttcatgaggtctgtgaagaaaaatccttggcaccnataattggaaggcttgggactcactgtaccgcacaagtggtgatgaatcggggcggttggatcagaacctaagaggtatgcctctatgaccctaacggacgnaagtaccc

SEQ ID NO: 86410 - DNA, 648 bp, Zea mays
  misc_feature: Ceres CLONE 1572839
  misc_feature (325)..(325): n is a, c, t, g, unknown, or other
  misc_feature (331)..(331): n is a, c, t, g, unknown, or other
  misc_feature (332)..(332): n is a, c, t, g, unknown, or other
  misc_feature (347)..(347): n is a, c, t, g, unknown, or other
  misc_feature (350)..(350): n is a, c, t, g, unknown, or other
  misc_feature (353)..(353): n is a, c, t, g, unknown, or other
  misc_feature (386)..(386): n is a, c, t, g, unknown, or other
ctccccgcggtggcggccgctctagaactagtggatcccccgggctgcaggaattcgtctcacccctagaaaaaacctcacctcactcaaaccgagcgccagttgccagcacgaagagtaggagtaggaatcgaagagtgagtgaaactgaaagacgaggaggagccatggtcgaccccggatgaccgcggcagctggttgctgtacctgtccctagccgccaaatgcgccggcgagcagccttaccgcctcgcgggcttcctggccgtctgcgccgtggccttcgtcgtgacatggctcctccactgagtgctttcccgggagnccagcnntgggggagtgggtgntgnacnccgccgctccggtgcccggtgcccggtgcgggnccactgcgggtggcggcggccccttcccggggcccaaggggccctgcccgtgggtcgggaaacatgtggcttcatgacggggctgggccccccgcaaagtcccccgggggggggggggggaaccccccggggcccaaggggccccgaaaggggccttcccccccccggggggaccaaaggggggggggggggggggggccccccccccccccaaaaaatttttgggcgcccccaaaaaaaattctcctgtaagagacccgcg

SEQ ID NO: 86411 - DNA, 940 bp, Zea mays
  misc_feature: Ceres CLONE 1572840
  misc_feature: Encodes the peptide sequence at SEQ ID NO. 86412
  misc_feature (894)..(894): n is a, c, t, g, unknown, or other
  misc_feature (901)..(901): n is a, c, t, g, unknown, or other
  misc_feature (919)..(919): n is a, c, t, g, unknown, or other
  misc_feature (922)..(922): n is a, c, t, g, unknown, or other
atagctggagctccccgcggtggcggccgctctagaactagtggatcccccgggctgcaggaattcgtctcacccctagaaaaagattcctttccctttccgttagcaggatagagagggagaggagcagaagagagcagagggccagaggcgcagaaggcagtcgcggacaggaggaagaggaagaagaagcggcagcgagcgaggatgccgtgcctgaacgtgtcgaccaacgtgaacaagaagcttagtgctggcatcgcttctatcctggagtcaaagctgtctgttcccaagtcgcgcttctacctcaagttctatgactcgaagcgctcggacttcggttggaacggctccaccttctagacttgaggtctgcagctgaaataaaagaaattcgtggaatcatggtacctaatgcccatggctattgcctattaaggacaatgtcataagatgtgtcttaatcggtgctgaactgagaaacagtaactgttgtcgtggaactggaagtggggtgctggcgtgtcagagtgcttgcttcctacctagcatagcatgcctgtgctatcttgttattggtattggcttgatatcagtctatattatcagcatccacttcgcccgcccgcccgctgcctgactgccattattgcctcccggtcttcgctgtccatccgaccgtccgtggcttctccctccggtccccgctacccgccccgccccgccgagaagcttcgggctagctagcaagctagctagccacctacccgtgctttgggtcggttggttgggcgccatagccttgccgaggagcgagggagcatccggtcgggcagtcaggaggcggtgagttagcatgctgggagcgagccccaagggcaggtatgccgncccgccnccggttgagcttgggtcngcntaagaggccctgctgccg

SEQ ID NO: 86412 - protein, 52 aa, Zea mays; identical to SEQ ID NO: 81925
  misc_feature: Ceres CLONE 1572840
  misc_feature: SWISSPROT Homolog: EC 5.3.2.1 Phenylpyruvate tautomerase

SEQ ID NO: 86413 - DNA, 835 bp, Zea mays
  misc_feature: Ceres CLONE 1572843
  misc_feature: Encodes the peptide sequence at SEQ ID NO. 86414
  misc_feature (833)..(833): n is a, c, t, g, unknown, or other
ctccccgcggtggcggccgctctagaactagtggatcccccgggctgcaggaattcgtctcacccctagaaaaaaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgctgccgtcggaggtcacccgcgcggcgatgctggtgcgcatcaacaccctcctccagagctactccggcatccgcttcgagatcctcgtagccatcacgaagctgctcaacaccggtgtcagcccctggctgccgctcggggcacccatcacgcgtcgggcgacctggtccgctctcctacatcgccggctcatcacggccggccccacgcgcaggccttaacgtccaccgaaggaaggggaccccncc

SEQ ID NO: 86414 - protein, 210 aa, Zea mays
  misc_feature: Ceres CLONE 1572843
  misc_feature (41)..(207): Pfam Name: PAL Pfam Description: Phenylalanine and histidine ammonia-lyase
  misc_feature: SWISSPROT Homolog: EC 4.3.1.5 Phenylalanine ammonia-lyase
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEVTRAAMLVRINTLLQSYSGIRFEILVAITKLLNTGVSPWLPLGAPITRRATWSALLHRRLITAGPTRRP

SEQ ID NO: 86415 - DNA, 925 bp, Zea mays
  misc_feature: Ceres CLONE 1572844
  misc_feature: Encodes the peptide sequence at SEQ ID NO. 86416
acccgcggtggcggccgctctagaactagtggatcccccgggctgcaggaattcgtctcacccctagaaaaaaaaccacagcactggatagaacacgccaaaagcaagagatatttctgcttcgctcttgtctcagctcagctcctgccagtcgcaactcgcgtcctctccaaaaacagcccacagctgaagcgagaacacgaatgctcagtgatatttctctcgaggtctgcacactcgtctcctaccgagaccgtcggcggccatcgtcgcacacgctgtgctcatgctaagtgtcgaggctcacacgtactactactacccgaccgcgaggccgagacggaagctatgcgcctgcagaaacgtcttgcaggaaaccgccccgcgtgacgcagaggcaaatccctgccgtcacggcgagaggaagagcaggagaaggggcgacggtgcttattacatcgacaaggacggcggcggcgtagccaggaccttcgaccggaagaaaatatccagaaagagggggggtgctatcaaagggcgcggatggaagtacggctccgggttcgtcgacggagtgttcccagtgctgagtccgatggcgcaggatgtgctagaactcgtgcagacgagggggaccgacgcggccagcgtctgggagtcactggacaagatccctcaagcgcacgatctttgggacgacatcgtcaacgtcgccgtccagctccgcctgaaccggcaatgggagccgatcatcacagtctgcgagtgggtcctgcgccggagctcgttccgccccgacatcatctgctacaacctgctcatcgacgcgtacggccagtagcgtcagctgagcgaggcggaagcggcctacatggcgcttctggaagctcgctgcgtgccccacgaggggaactacgctcggctg

SEQ ID NO: 86416 - protein, 184 aa, Zea mays
  misc_feature: Ceres CLONE 1572844
MLSVEAHTYYYYPTARPRRKLCACRNVLQETAPRDAEANPCRHGERKSRRRGDGAYYIDKDGGGVARTFDRKKISRKRGGAIKGRGWKYGSGFVDGVFPVLSPMAQDVLELVQTRGTDAASVWESLDKIPQAHDLWDDIVNVAVQLRLNRQWEPIITVCEWVLRRSSFRPDIICYNLLIDAYGQ

SEQ ID NO: 86417 - DNA, 941 bp, Zea mays
  misc_feature: Ceres CLONE 1572845
  misc_feature: Encodes the peptide sequence at SEQ ID NO. 86418
aagctggagctccccgcggtggcggccgctctagaactagtggatcccccgggctgcaggaattcgtctcacccctagaaaaaaaaccacagcactggatagaacacgccaaaagcaagagatatttctgcttcgctcttgtctcagctcagctcctgccagtcgcaactcgcgtcctctccaaaaacagcccacagctgaagcgagaacacgaatgctcagtgatatttctctcgaggtctgcacactcgtctcctaccgagaccgtcggcggccatcgtcgcacacgctgtgctcatgctaagtgtcgaggctcacacgtactactactacccgaccgcgaggccgagacggaagctatgcgcctgcagaaacgtcttgcaggaaaccgccccgcgtgacgcagaggcaaatccctgccgtcacggcgagaggaagagcaggagaaggggcgacggtgcttattacatcgacaaggacggcggcggcgtagccaggaccttcgaccggaagaaaatatccagaaagagggggggtgctatcaaagggcgcggatggaagtacggctccgggttcgtcgacggagtgttcccagtgctgagtccgatggcgcaggatgtgctagaactcgtgcagacgagggggaccgacgcggccagcgtctgggagtcactggacaagatccctcaagcgcacgatctttgggacgacatcgtcgacgtcgccgtgcagctccgcctgaaccggcaatgggagccgatcatcacagtctgcgagtgggtcctgcgcctgagctcgttccgacccgacatcatctgctacaactgctcatcgacgcgtacggccagaagcgtcagctgatcgaagacgaagcggcctacatggcgcttctggaagctcgctgcgtgcccaacgagacacctacgctctagctgcgcgca

SEQ ID NO: 86418 - protein, 187 aa, Zea mays
  misc_feature: Ceres CLONE 1572845
MLSVEAHTYYYYPTARPRRKLCACRNVLQETAPRDAEANPCRHGERKSRRRGDGAYYIDKDGGGVARTFDRKKISRKRGGAIKGRGWKYGSGFVDGVFPVLSPMAQDVLELVQTRGTDAASVWESLDKIPQAHDLWDDIVDVAVQLRLNRQWEPIITVCEWVLRLSSFRPDIICYNCSSTRTARSVS

SEQ ID NO: 86419 - DNA, 868 bp, Zea mays
  misc_feature: Ceres CLONE 1572847
  misc_feature: Encodes the peptide sequence at SEQ ID NO. 86420
acccgcggtggcggccgctctagaactagtggatcccccgggctgcaggaattcgtctcacccctagaaaaaatcggtcagcacgatgtcattgacccgatgagaggtcgaagaagggcggatgcttcaagctttctctgctcggttaggttgctgtcgctcgctctgagtctgaggcctcgacgcgctgctagctgagagccgaaagaaggaatcctcggccggctgcaggagaggagagccaccgtttgatcagcgaccgggcaagagcaggccgcggccggccaccccgcccgtctctgtccgaccccgcaccagcgactcgccgagcgcaggcacaagaggggggctccatccatgaggcagccatgctggtgctcatcaacaggtatttcaggagcaggaacagcagcccggccggaggaggcggcgaagagatggcgccggcggcggtctccagcgaccacctctgtttgccgggctgcgtgcccgtgcgcgccaagcgggcctcctcctccgccgccgccgcggccacggccaccacggcgcgggcgtcgcggcacaacttcgtcagggccgcggcgtcgggcctgctggcgggggcgcacttcaccaaccacgagtcgctgccgccgcttccccacgcgtacgccgagttcgtcgcggcgttcccgcagtacgcccacggcgcgctggcgcgggcggacgcgatccggggcgaggagtacagcacctgtaccgccacgtgtgcctggactacaccggcatcaacctcttctcgcacgcgcagatgagcgcctgcctgtcgtacactgctacagcgcgccctcatggaatgcgcccttcttcgacatcgcgtacagtacat

SEQ ID NO: 86420 - protein, 141 aa, Zea mays
  misc_feature: Ceres CLONE 1572847
MLVLINRYFRSRNSSPAGGGGEEMAPAAVSSDHLCLPGCVPVRAKRASSSAAAAATATTARASRHNFVRAAASGLLAGAHFTNHESLPPLPHAYAEFVAAFPQYAHGALARADAIRGEEYSTCTATCAWTTPASTSSRTRR

SEQ ID NO: 86421 - DNA, 946 bp, Zea mays
  misc_feature: Ceres CLONE 1572849
  misc_feature: Encodes the peptide sequence at SEQ ID NO. 86422
ctccccgcggtggcggccgctctagaactagtggatcccccgggctgcaggaattcgtctcacccctagaaaaaaccaaaaacccttccgccccgagccgaccggaaccctacccatcccgcagcgccgccggccgcccgccccgccccgccccttcaccccctacctcttcttgcgccgtcatcccgatcccctacgctcgctgaggcattatgggtaaatcaagcaagaagtccagtgttaaggctgcacctgctgctgtctcagttccagaggtgaaatctgcaaagaaggggaagagaaatgcagaagatgagattgagaaggccgtgagtgcaaagaagcaaaagactgtacctgaaaaagctgtgccggttaagaagcagccccctccaaagaaagttgagagcagcagctctgaggaggattcttcagattccgaagtggaggttaaggtccagccgaagaaggttattcaaccgaagataggtacacaacctgctaaacaggagtccagtgatgacagcagctctgagagctcctcagacgatgaaccttccaaaatacagttgccgggtcaaaaaagcctcctgccagtagtagcagcagtgatgatagcagtgacagtgatgatagtagctctgatgaggaaccagcaaagaacccccggcgctttcaaagaagccccctgtcctttcaaaaaacctggcccagcagtcagtaatgttcaaaaacaggttaaaccgaaaaccacagcctcgaagtagcccaaaaggggaaaaaaaccgggggtagcccaaaaaaccggtgtgtcccctgtgcaaaaaaaccaaaattcgaaacccctaacgggttctgaaaggggaaaacaaaaaaaaattccccgtaacccccgtggcccccaaaaaaaagaaaccccgcccccttctttccaaaaggtttccgc

SEQ ID NO: 86422 - protein, 184 aa, Zea mays
  misc_feature: Ceres CLONE 1572849
MGKSSKKSSVKAAPAAVSVPEVKSAKKGKRNAEDEIEKAVSAKKQKTVPEKAVPVKKQPPPKKVESSSSEEDSSDSEVEVKVQPKKVIQPKIGTQPAKQESSDDSSSESSSDDEPSKIQLPGQKSLLPVVAAVMIAVTVMIVALMRNQQRTPGAFKEAPCPFKKPGPAVSNVQKQVKPKTTASK

SEQ ID NO: 86423 - DNA, 974 bp, Zea mays
  misc_feature: Ceres CLONE 1572851
ctggagctccccgcggtggcggccgctctagaactagtggatcccccgggctgcaggaattcgtctcacccctagaaaaagcatcgccacatttttacccagaggatggcacggttccgcctctcctcctgcggcgggcggtgctgccgagcttctcctctccctagatcccgcgcacccctctccgtatcacagatcatggcgcgcctgccgtctccattgcccggcggatcctgcgatgcgagcatggaaccgacagggaggagcgacggagcgcccgcgtagagaaggcggggcggggtcaggaatgaaggaaggaccccccgcccctctgcatctcgtgtcaccgccctctgcccgacgacatcgacctttcacggaagcccgtgcaggcgccgctctacacgagtgccttcctgactcggacgccgtgcgcgtctccctcagcgcctaccccgccttcctctgctctgactgctgctagggctgcgtcgccgcttccgtggtcgcgcgtgtccgttgacgcgttctcggggagcccctcgacggccgacctcgccccgtcatgggaggctctacctcctccgcgcggccgtggccctgcgcgacgacgacgacggcggagacgactacgaccccttcctctcggtgctcgactactcatgctgagggatgggggtggcctacacggacatgcacgacctctacgtgacgtgcgacccgaccgcgggtgccagtcactcgacgccggcagcgcgcccgggtcatgggctgagcagctgtgataccagtctaactgcaaatggatgctggcgcgactaaaccagtaatcgttctcattggacatctgtcatgtagggatgtggaaccatgggaatctcctggttctgcacctcggcggggttttcatccggaaaacatgcccctttggggaatagtatggagcctcccttccccgttgcttggccggtgaa

SEQ ID NO: 86424 - DNA, 926 bp, Zea mays
  misc_feature: Ceres CLONE 1572852
  misc_feature: Encodes the peptide sequence at SEQ ID NO. 86425
tggcggccgctctagaactagtggatcccccgggctgcaggaattcgtctcacccctagaaaaaacctcacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagccgccaaatgcgccggcgagcagccttaccgcctcgcgggcttcctggccgtctgcgccgtggccttcgtcgtgacatgcctcctccactggtgcttcccgggaggcccggcgtgggggaggtggtggtggacgcggcggctcggtgccggtgccggtggcggcgcgacggcggtggcggcggccctgccggggccgaggggcctgcccgtggtcgggagcatgtggctcatgacgggcctggcgcaccgcaagctcgcggcggcggcggggagcctcggcgccaggcgcctgatggccttctccctcgggggcacgagggtggtggtggcctcgcacccggacgtggcgcgcgagatcctcagcagcccggcgttcgcggaccggcccatcaaggagtccgcgtacgggctcctgttccaccgcgccatcggcttcgcgccctacggcgccctactggcgcgcgctgcgccgcgtggcggtcacgcacctcttcttccccggggaggtcgccgcgttcggcgcgcagcgcggcgtcatcgcgccgccaaatggtcggcccccttcaaggacctgtctgcggccttccccgggggcggccggcgggcttcaaggtcccgcccgtcttgcgcccgggctccctggccagagtcatgtgtgttcaggtttcggccggcgttccaccttgtacttgtacccgcccgggaatcccctaaacccg

SEQ ID NO: 86425 - protein, 256 aa, Zea mays
  misc_feature: Ceres CLONE 1572852
MATPDDRGSWLLYLSLAAKCAGEQPYRLAGFLAVCAVAFVVTCLLHWCFPGGPAWGRWWWTRRLGAGAGGGATAVAAALPGPRGLPVVGSMWLMTGLAHRKLAAAAGSLGARRLMAFSLGGTRVVVASHPDVAREILSSPAFADRPIKESAYGLLFHRAIGFAPYGALLARAAPRGGHAPLLPRGGRRVRRAARRHRAAKWSAPFKDLSAAFPGGGRRASRSRPSCARAPWPESCVFRFRPAFHLVLVPARESPKP

SEQ ID NO: 86426 - DNA, 984 bp, Zea mays
  misc_feature: Ceres CLONE 1572854
  misc_feature: Translation starting site: 281
  misc_feature: SWISSPROT Homolog: EC 4.2.3.9 Aristolochene synthase
  misc_feature (866)..(866): n is a, c, t, g, unknown, or other
  misc_feature (872)..(872): n is a, c, t, g, unknown, or other
  misc_feature (877)..(877): n is a, c, t, g, unknown, or other
  misc_feature (879)..(879): n is a, c, t, g, unknown, or other
  misc_feature (920)..(920): n is a, c, t, g, unknown, or other
acccgcggtggcggccgctctagaactagtggatcccccgggctgcaggaattcgtctcacccctagaaaaaaactgtgattggcggtagcccatcgacgacacgagatatcagctgcctcagatctcgtcggtgggtgccaatcacattcttcgacagtttgtcgatcgtcgtcaagacatttcaacagctagctagcctgcctataaaatgcgcgcgcacgaacctctgtagcacaaatggacctgtgagaaagcaagaaataaagatatatacacacatggctactacgggcacaacatctatgccagcacctgtgtttcaccccacggtgtggggggactacttcatcaaatttgtcccagagccattgcaggtttcagatgaaacgatggcagagagaatcaggcatttgagagaggaggtaagtggtatgttccaggcttgcaagaacgttgtggacaaaacgaacctagtagacgtggtacaacgtcttggaatagatcaccatttcgaggaacagatagccactgccctagccagcatccacagcgctggattattcaatagctcaagcctacacgaggctgcccttcggtttcgcttgcttaggcagcagggagttttgggttcctgcagatgaacttgtcaagttcatcaagaacgaagacgggagctttatcgatggtataaccaatgacccaaagggcctgttgagcttatacaacgcagctcaccttgttactcacgacgagtgtacgacgacacttgaagatgccatcgcatttgcaaggcagcatctggaaagctgctagagatgtagtctcaagtcccctctagctgaacaatgtcgcccgtgccttggntatccnactgncnagggaccttaagaggaggaagcaatagccttttttcccggnatatagctcacaaccagatcaacaatgtacagccccgtggatactaaagctgccaagctagact

SEQ ID NO: 86427 - DNA, 901 bp, Zea mays
  misc_feature: Ceres CLONE 1572855
  misc_feature: Encodes the peptide sequence at SEQ ID NO. 86428
gcggtggcggccgctctagaactagtggatcccccgggctgcaggaattcgtctcacccctagaaaaaaactgtgattggcggtagcccatcgacgacacgagatatcagctgcctcagatctcgtcggtgggtgccaatcacattcttcgacagtttgtcgatcgttgtcaagacatttcaacagctagctagcctgcctataaaatgcgcgcgcacgaacctctgtagcacaaatggacctgtgagaaagcaagaaataaagatatatacacacatggctactacgggcacaacatctatgccagcacctgtgtttcaccccacggtgtggggggactacttcatcaaatttgtcccagagccattgcaggtttcagatgaaacgatggcagagagaatcaggcatttgagagaggaggtaagtggtatgttccaggcttgcaagaacgttgtggacaaaacgaacctagtagacgtggtacaacgtcttggaatagatcaccatttcgaagaacagatagccactgccctagccagcattcacagcgctggattattcaatagctcaagcctacacgaggctgcccttcggtttcgcttgcttaagcagcagggggttttgggttcctgcagatgaaactgtcaagttctaaagaacgaagagggagctttatcgatggtttaacaatgaaccaaagggccggttgagctaatacacgcagctcacttgttactccgacgaggggacaacacccttaaaatgcctcccattttcaagcaacactggaaacgctaaaaaagtatccaaacccccctaatgaaaaaatggccggcccttggattcccctgccagaccttaaaagggagaacatacctttatccccgaataacctaaaaaa

SEQ ID NO: 86428 - protein, 120 aa, Zea mays
  misc_feature: Ceres CLONE 1572855
  misc_feature: SWISSPROT Homolog: EC 4.2.3.9 Aristolochene synthase
MATTGTTSMPAPVFHPTVWGDYFIKFVPEPLQVSDETMAERIRHLREEVSGMFQACKNVVDKTNLVDVVQRLGIDHHFEEQIATALASIHSAGLFNSSSLHEAALRFRLLKQQGVLGSCR

SEQ ID NO: 86429 - DNA, 939 bp, Zea mays
  misc_feature: Ceres CLONE 1572858
  misc_feature: Encodes the peptide sequence at SEQ ID NO. 86430
gcggtggcggccgctctagaactagtggatcccccgggctgcaggaattcgtctcacccctagaaaaaacacccaacatcacgaaaccacgcgcagatccaaacgaacccgagcccttccaaaccctaagctcgcctcccctcccccccaaacaccaccgcgcacctatggcgaagtacggcgagggcgacaagcggtggatcgtggaggagcgcgccgacggcaccaacgtccacaactggcactgggcggagcgcgactgcctggagtggtcccgcgcgcggctctcttccctgctcgcgggcctcaccatcctcgacggcgagggcggcctcagtctccgcaccgtcgcgctcgacaagcttgatggcgaggcctacgtcaacatccgcaagggcaaggtcatcccggggtacgagctctcgctcaccctctcctgggaggccgaggccgcctcggagtccggagctgcgaaggtcaccggcaccgctgaggttccctacctcgccgacgagaacgccgacgaggaccccgacctccgcgtcaccgtgcgcggcgacgagacgcccctcgcgctccgcgccaaggacgccttcctctcccgcgggaaacccatggtgctcgagaagatcggggagttcgtcgctgccatggccaagggggggaccggccaaggacgagctggactccaagaaaaactcccacgaagtcgccggctccccacccgggtaaagaagggggtcttggctccctgccccgggtgtgggagaggaaaaagggccaaggggaaaggacaaggaggggcctcaagaacattgagattgacgggagaaattccaactggccctcccaaaggaatattatggagatcttgatggggatgaaaaccaattggaaagggtgttccgccaagacattggcgggggtccccccgaaagg

SEQ ID NO: 86430 - protein, 235 aa, Zea mays
  misc_feature: Ceres CLONE 1572858
  misc_feature (29)..(164): Pfam Name: Aha1_N Pfam Description: Activator of Hsp90 ATPase, N-terminal
MAKYGEGDKRWIVEERADGTNVHNWHWAERDCLEWSRARLSSLLAGLTILDGEGGLSLRTVALDKLDGEAYVNIRKGKVIPGYELSLTLSWEAEAASESGAAKVTGTAEVPYLADENADEDPDLRVTVRGDETPLALRAKDAFLSRGKPMVLEKIGEFVAAMAKGGTGQGRAGLQEKLPRSRRLPTRVKKGVLAPCPGCGRGKRAKGKGQGGASRTLRLTGEIPTGPPKGILWRS

SEQ ID NO: 86431 - DNA, 770 bp, Zea mays
  misc_feature: Ceres CLONE 1572859
  misc_feature (400)..(400): n is a, c, t, g, unknown, or other
  misc_feature (733)..(733): n is a, c, t, g, unknown, or other
  misc_feature (734)..(734): n is a, c, t, g, unknown, or other
ctccccgcggtggcggccgctctagaactagtggatcccccgggctgcaggaattcgtctcacccctagaaaaaaaaaccctaatccccaccgccgcccgaccccgcagcctcattccaggcgcatcgacagcgacggcacgcgctggtccatccacggtccaccagtcgacctcgctcacccgcgagccgcgggccttgtcctcgtcgtcgttcataggcagtgcagcctcattcaccggtcgtcctcgtccaccagagaattgaagttcctcgcccatcagccaacgacgtcgacgcgggctcgttctcgtccagcccacagaccagcgtgctgcacgtcgccttgctgttgctgtgctgctgctgcctatgtttcaaatgtcccaactggacctagncctcagaccgaagtgccccatgacatgtcaatatatgccagctgtggcgggagccagaactgagcggcgtacagatttcctagccctggatttgatcaaggggaaaagtggcccgccccctagctgcccaatattaagaaactaagtcccccccgccattttccaaattgggccagcagggggccccggccccctaggtggactgcggtcccggggggttccccccccaggtgtacaaaatttccccccccaaaagggtaacgggccgagaaaacccccccccccctggccttgggggggcattttgggaaaaatatttcccccagggccccnnggggggggggaagaaccccttataaataacctggcg

SEQ ID NO: 86432 - DNA, 976 bp, Zea mays
  misc_feature: Ceres CLONE 1572860
  misc_feature: Encodes the peptide sequence at SEQ ID NO. 86433
ccccgcggtggcggccgctctagaactagtggatcccccgggctgcaggaattcgtctcacccctagaaaaaacaccgcttcactcgtttccttccgatccatacacaccgcgcacgtacgcgtactccatcgtcccggtgcaggcgggttcacgtacgagctcgatcggccgagacgagatggcgacgccgaacgggcttgctcggatcgagacgaacggggcgacgaagcccgacaacggcgtgtgccacgacgacagctcggcgccggtgcgcgcgcagaccatcgacgagctgcactcgctgcagcggaagcggtcggcgccaaccacgcccatcaaggacggcgccgcctcgaccttcgccgccgcgctctccgaggaggagcgccacaggcagcagctgcagtccatcagcgcgtcgttggcgtctctgacacgtgaaaccgggccgaaagtggtcaagggcgacccggcccggaggggcgaggcccccgcgacgggtgcaccgccgacgccacaggcgcaccaccagcaccaccaccccgccgcccccaccatcgccgtcagcgacagctccctcaagttcacccatgtcctctacaacctctcgcctgctgagctgtacgagcaggccatcaagtacgagaaggggtcgttcatcacgtctaccggcgcgctggcgacgctgtccggcgccaagaccggtctgtcgcccagggacaagcgcgtcctccaagaagaagtccccgccccgggaactgtgggtggggcaagggcctcgccaaacatcgagatggacgaccccccgttcctgaccaacagggaggagggccgtggaccacctccacctcccggaacaaggtgttcgtgaaacaacaagtttcctcaactgggaaccccaaaaaccggatccagggtccccctcttctcccgcacagggcgtaccactcccctcttcttgccacaatatgtgg

SEQ ID NO: 86433 - protein, 230 aa, Zea mays
  misc_feature: Ceres CLONE 1572860
  misc_feature: SWISSPROT Homolog: EC 4.1.1.49 Phosphoenolpyruvate carboxykinase (ATP)
MATPNGLARIETNGATKPDNGVCHDDSSAPVRAQTIDELHSLQRKRSAPTTPIKDGAASTFAAALSEEERHRQQLQSISASLASLTRETGPKVVKGDPARRGEAPATGAPPTPQAHHQHHHPAAPTIAVSDSSLKFTHVLYNLSPAELYEQAIKYEKGSFITSTGALATLSGAKTGLSPRDKRVLQEEVPAPGTVGGARASPNIEMDDPPFLTNREEGRGPPPPPGTRCS

SEQ ID NO: 86434 - DNA, 929 bp, Zea mays
  misc_feature: Ceres CLONE 1572862
  misc_feature: Translation starting site: 108
  misc_feature (711)..(711): n is a, c, t, g, unknown, or other
  misc_feature (712)..(712): n is a, c, t, g, unknown, or other
  misc_feature (732)..(732): n is a, c, t, g, unknown, or other
  misc_feature (879)..(879): n is a, c, t, g, unknown, or other
ctccccgcggtggcggccgctctagaactagtggatcccccgggctgcaggaattcgtctcacccctagaaaaaagggacaccccctccagctctccgccgtcggccatgggtcaagcctggggtaatctccaagataggctccaagggcggcggtggaaggagcaccaggtgaggaagatcaccgacaaggtgttcgaccgcctcacggaggacgcccagaagcgcgacaaggaggccctcagattcgaggaggtctacatcgccgtcctctgcgtctacaagtacagaagcgaagcgggccgtatgctacctcgtaacaccctgcagttttcatctgtttctgactgattggtgccgttcttgtcggtggcagtgacatcaataagtacttgccggggccgcaccacgaccccccgtccaaggagaagctcagggccatgatggaggtaaccacatccttctccttcgtttagattttgctgtttcagtatggccaatcgaatatcgtgttcttccggctgttccttgaactggaagcaaagtgttcttgatttatgtgtttaattatggtcacaaagtcagtgatttgatttggaagtctagaagtaattattgttttttccccttgtcgagatcccagttgcttcagctgccacagcctacaggtagtttcttgggttgagtcatttgagtgtggtttatcactggnnctggttcctgcaacgcgcangagtacgacgtggacctggacgggctcctggaccgcgaggagtttcgcggagtcatccgggagctgaccgcggactcgctgtgctcgatcagcgtgaagctgctgatcaccctggttgccgcgccggcgcctgcgatggcgaccaancgggcgaacgagggcgtcccccggctggctaaggtggtacgcaggtggcc

SEQ ID NO: 86435 - DNA, 943 bp, Zea mays
  misc_feature: Ceres CLONE 1572863
  misc_feature: Encodes the peptide sequence at SEQ ID NO. 86436
aaagctggagctccccgcggtggcggccgctctagaactagtggatcccccgggctgcaggaattcgtctcacccctagaaaaagtgtcgtcccccctgcccctacccccctccggttgccaacgactcctggctccactgtcgctctcgctcccttccctcccactcaatggtggccgatcgcctccgcactcgcgctgctgctctccacgtgcctctgctccacgtgggcacgcccacacctagagcctaccatccgactaccgccccatcgccctgctgtccaccaaacagtacacaaccccatcgggacccgtgtcgggccgtgctcatcctcggctcctactgctactacaactaccgccaccacgctgacatctgccatgcatacctcatcatgaacaagggcggacttcacgacgacaacatcgctgtcttcatgctcgatgacatcacgcatatcaccgcaaatcccacgcccggtgtcatcataaatcatccccagggtggcgacatctttgctggggtgccgaaggatcacactgtgcgagatgacaacgccgacaatatctgcgctgttctgcttggcaacacaactgctctattgggtaggagcggcaaggttgtggacagtggccccaatgatcatatatgtgtcttctacagcgaccatggaggtcctggcgtccttggaatgcctacatatccgtatctctatggcgatgaccccgcagatgtcatgaagaagaagcatgctggcgagacctacaaaaaccgtggactattaccctgaatcatgcggatctgggaacatcgtatgagggctcccgccgaatggacatcatgtgattgcgatccacgcgtcaaatgcacatgacaatagctaggaggacgtcctaccctggcgattcccgaacccgtcagctggatatgacacttgcta

SEQ ID NO: 86436 - protein, 131 aa, Zea mays
  misc_feature: Ceres CLONE 1572863
  misc_feature (1)..(132): Pfam Name: Peptidase_C13 Pfam Description: Peptidase C13 family
  misc_feature: SWISSPROT Homolog: EC 3.4.22.34 Legumain
MNKGGLHDDNIAVFMLDDITHITANPTPGVIINHPQGGDIFAGVPKDHTVRDDNADNICAVLLGNTTALLGRSGKVVDSGPNDHICVFYSDHGGPGVLGMPTYPYLYGDDPADVMKKKHAGETYKNRGLLP

SEQ ID NO: 86437 - DNA, 923 bp, Zea mays
  misc_feature: Ceres CLONE 1572864
  misc_feature: Encodes the peptide sequence at SEQ ID NO. 86438
atagctggagctccccgcggtggcggccgctctagaactagtggatcccccgggctgcaggaattcgtctcacccctagaaaaagattcttttccctttctgttagcgggttagatagggagaggagcggaggagagcagagggcctgttgctctcaaggcagtcccggacatgatgaagatgaacatgaagcggcagctagcctcgttgccgtgcctgatcgtgtcgactatggtgtaccacacgcttagtgctggcatcgcttctatcctggagtctaagctgtctgttcccaagtcgcgcttctacctctagttctatgactcggagcgctcggacttcggttggaacggctccaccttcttgacttgaggtctgcatctgaaataaaagaaattcgtggaatcacggttcctaatgcccatggctattgccgattatggactatgtcctaagatgtgtctttttcggtgcggacctgagaaacagtgtctgtgtgtcgtggaactggaattggggtgctggcgtgtcagatcgcttgcttcctacctgggatagcatgcctgtgctatcgtgttttcggagttggggttgatctcaccctctattttctggatcaaattcagtctgtccgccctgtgcctggatgccctttttgcctcctggttttcgctgtccgtccgaacgttccgtggtttctccctccgttcaaagctaaccgccccgcccaatcggataatgttcaggctagacagcattcctggctagtaccctccgcgtccttggatttggtgggtttggggcacttagcctttgcgatggagcccgggtagtttccgggcgggtattctgggaggcggttattacctttgcctggcatcttaccccaggggtttgtaaggcttctctctcctccagtggat

SEQ ID NO: 86438 - protein, 47 aa, Zea mays
  misc_feature: Ceres CLONE 1572864
MMKMNMKRQLASLPCLIVSTMVYHTLSAGIASILESKLSVPKSRFYL

SEQ ID NO: 86439 - DNA, 950 bp, Zea mays
  misc_feature: Ceres CLONE 1572865
  misc_feature: Translation starting site: 232
  misc_feature: SWISSPROT Homolog: EC 5.4.2.1 Phosphoglycerate mutase
  misc_feature (950)..(950): n is a, c, t, g, unknown, or other
ctccccgcggtggcggccgctctagaactagtggatcccccgggctgcaggaattcgtctcacccctagaaaaaacctcgattcgcgccgagagccttccagagcaaagaagccggccaccaacaaaacccgacccgacgacgacgagcaagtagctgccagaacccagcacagctctacccaccaattctgattctggaagacagacagtagtcgatcgcatcgcatcgcatggcgacgaggccggcagcggaggagaagccgtgggagctggcggcgcacccgcggctgcccaagggcaggacggtggccgtggtggtgctggacggctggggcgaggcggcgcccgaccccttcaactgcatccacgtcgccgacacgcccacgctcgacgccctcaagaaggtacgttacgttacgtacacggcctggcgttcgctgaactctgcgctcacgtgcggcaggcagctccggagagatggaggctcatcaaggcgcacgggacggcggtggggctgccgacggacgacgacatggggaacagcgaggtcggccacaatgcgctcggagcgggacagatatacgcgcaggggtaactagattatacctcgacttcgactagctagctaccactctgctcccttgttagacacgtatcatatacgccatctgatagccaaaccgaagcagaattaaaaagcatggcaaaaaagaatcactcgtattattagtgaatgaatttgcaatggtcagccggtcacaacatgcagcgcgaaactggtcgatctggcgctggggtccggggaagtatacgatggcggaggggttcagtacatccagcagtccttccaggacggcactctgcacctcatcggcctgctcagcgacggaggcgtgcactccagggtcgaccagctgcaggtcggtcgttgaacgctgcattgcatcgn

SEQ ID NO: 86440 - DNA, 947 bp, Zea mays
  misc_feature: Ceres CLONE 1572868
  misc_feature: Encodes the peptide sequence at SEQ ID NO. 86441
  misc_feature (904)..(904): n is a, c, t, g, unknown, or other
aaagctggagctccccgcggtggcggccgctctagaactagtggatcccccgggctgcaggaattcgtctcacccctagaaaaagaagctgctgcgccctcccctcccccatctccgccccccgcctcacccaccagacgagagagcgagcgcagttcggccgccggtcgcgtccgactccagcaaagccgagcgcccaccccctcaccctattaccttcctctcgggtccaattcggtgcctggctgactccgcacgtcttccccccttttccctccctcgaccgacgaccgtccgtccaccaccggatccaggagcgaccctccctcgtgctcgtcgacgatcgaccggccgccgatcgtccaggtactgcgcaagctcatcaccgccgcagcttcgctgctcgcttcttactgcctagctggggtttgtggttctgtttcgtaccgcaactgattcatcatcgaaacggaagccgacaccaccaaggccgagcgacttgctgagacggacaaggtactctagtccacgacgaacgaaattgagcttatggattccctgttcttctcaggaaggatgtcgagcctcgaggagccgctgggtctcggagacctgcccaagttgagtattaacagactcgggcggttcgtgtcgctgggcgctcggaggccaccggccgacgacgacgaccacagcactggcaaatacagcagcagctcctgcaacaatggcagccctcagatggcattccatcatgacagcaactcctcctatccctggcacccgcagtgccgccaggcccgccgatcatcacgcgatgcagtggagcttagagatctccctcgccaggtcatgtgggagctgcccgagttcgtgaaaatggtgggagtgggggctcggtacngcctgcaaaacgaaaggtcaacgtcccgggcgtcgtgaagatc

SEQ ID NO: 86441 - protein, 121 aa, Zea mays
  misc_feature: Ceres CLONE 1572868
  misc_feature (110)..(110): Xaa is any aa, unknown, or other
MSSLEEPLGLGDLPKLSINRLGRFVSLGARRPPADDDDHSTGKYSSSSCNNGSPQMAFHHDSNSSYPWHPQCRQARRSSRDAVELRDLPRQVMWELPEFVKMVGVGARYXLQNERSTSRAS

SEQ ID NO: 86442 - DNA, 980 bp, Zea mays
  misc_feature: Ceres CLONE 1572872
  misc_feature: Encodes the peptide sequence at SEQ ID NO. 86443
ctccccgcggtggcggccgctctagaactagtggatcccccgggctgcaggaattcgtctcacccctagaaaaagaaccctactcaccaacccacccgcaggagaacggaaaaaaaaaatcgtgtcgaggcgactttcgccgccatggcaggcgatcccccgacggctgcggagaaggagaccctggtctcctccttcatcgagatcaccgccggccagaccctcgagactgccacccagttcctccagatgacgagctggcacctggaggaggcgctgcagctgttctacatcgacggcgaggccgcccacaccgccgcgcattcggtggacccgtcgcctgcggcggcggccccgtcggcactagcggcggcggccggggtggaagaggcgatgaggttcgctccacccccggcggctgcactgggcgatgcaatgtcgcatgggtttggggtcaaggaggacgacgacgttcgcgcgcccctgccggtgaagatggagactctctacggcgagggaatcgtgtccgtcatgcgacctaatgcatcagctgcatttcgtaactttgaacaagaagcaagacatctgctgtttgggactctgagcagaatgttgcatctaagtccggggataaacttgcttctttaaaccgccaccttttcctttgatgttccagggatcccttggacaaggaaagttaaagggttcctcccgggacaaaggggctttatccatttgccggccacaaaggaattttacccccccctggctaaaccaaaaccttgggggaataaaccggggggccctttatttggccaaccctaaaaaaatttttttttcgggggggttatttttgccccgggggggggaggagggagcgcctctttccccttgggggcgccggccgcgttcccccaaataccccccccccgggagaaaaaaatggtggggagagaaggtgccccaccccttttccgagg

SEQ ID NO: 86443 - protein, 167 aa, Zea mays
  misc_feature: Ceres CLONE 1572872
MAGDPPTAAEKETLVSSFIEITAGQTLETATQFLQMTSWHLEEALQLFYIDGEAAHTAAHSVDPSPAAAAPSALAAAAGVEEAMRFAPPPAAALGDAMSHGFGVKEDDDVRAPLPVKMETLYGEGIVSVMRPNASAAFRNFEQEARHLLFGTLSRMLHLSPGINLLL

SEQ ID NO: 86444 - DNA, 957 bp, Zea mays
  misc_feature: Ceres CLONE 1572873
  misc_feature (615)..(615): n is a, c, t, g, unknown, or other
ggcggccgctctagaactagtggatcccccgggctgcaggaattcgtctcacccctagaaaaactctgctccgctgcttgcctccggctccccaatgccacgagatctccagttccagcgcgagtcgtctctgcatgcggaccccataccccgatcgatgccctaaaggccatggttttctccgccgccgcgtcgactctagtaggcaccgctgctgactctgcttcctcctgcgtcgccaacctccgctgctgctgtcacgatagttgctgccgttgttgaagacgcggagatctttagggttcgcgatttctcgccgatgagctcgagaatgggtaagctatggatctctcgcggcccacatcggcggacctctaactcgggatcaagtctgatggtcacgcccacgctgacgctcgcaaggacgcggtagccgcgccgctgggcctgttcgacgacgcggaggagccgaacccggagcgcgtcatgacccgataggccgacccggaaagggattactaggaccgggggcaacagcacttctccctcctagggtactacctcattctaaagagccggcgcttggcaggcaaaggcggagggtggcgaaaaaanttcgtccagattcttccatgtcggagcggttcccccttgccatggaaatgcaaagggggaggggaccggccaaatttggggaaccccccggccccagggggccgccaggggaattcatccccggggggagtcaaacccgaaatggccttccctaaaaaaaaggggaattgaacccccggggccaaggtattaggcccaaaccctggaaaaaattttttctccgggcggggtttctataaccctcgggggcgccccaaaataaaacccctctaaggtccccccggtttctcccataatgggggagaaaccccctcccccccaaaaagagcgctctgaagggag

SEQ ID NO: 86445 - DNA, 949 bp, Zea mays
  misc_feature: Ceres CLONE 1572874
  misc_feature: Encodes the peptide sequence at SEQ ID NO. 86446
  misc_feature (820)..(820): n is a, c, t, g, unknown, or other
  misc_feature (922)..(922): n is a, c, t, g, unknown, or other
ctccccgcggtggcggccgctctagaactagtggatcccccgggctgcaggaattcgtctcacccctagaaaaaaaccgctacccattgcaaacgctttccctccactcgtccgctccggccgcgcgcctccgccccacgccgatgccgcccccgccctcgcccccgccgcctctcggcctccgcctccgtctctccctcctcccgccccaccctatcgcgccttctatccgtcatgccttctgctcaccctccgtcgtgtcctgccatctttcggtgcgccccctcgcccaacgccgcggtgggcgcccgcgccccctctgcgccgcgcggggcgaggccgaggcggagggcttcgcgtggccggatgggtccgaggaggagctgcggcggctcctggagctgctccctagggagctgagtgggcgggtggagacccacccagagctcccggcgctcgtggaggtggtcatggacctcggccggcccccgctcgcgcgcttcccgtccggagacttcctcctctcccaacgccccatctccttcgacgacctccgtcacgctacctcccaggttggggactttggagcggataatcgtgctggaatcagccgcacgctgcaccggatcagcgccattaggaatcggaagggcgtcattgtcggcctcacatgccgtgttgggcgtgcagtgcccgggagcgctaatttgcttcacgatttggttaaggacggtggctcattgctgctcatcggcccacctgggggtggggaagactactgtcataagagaaaattgcccgtatgttagctgatgactantagaggcgcgtgatgattgtcgacacatctatgagattgggggggggatggtgatattcctcaccaggatatagcaatgcacgtaggtttgcagtggcctanccagacatgcagcataaggtactgatt

SEQ ID NO: 86446 - protein, 221 aa, Zea mays
  misc_feature: Ceres CLONE 1572874
MPPPPSPPPPLGLRLRLSLLPPHPIAPSIRHAFCSPSVVSCHLSVRPLAQRRGGRPRPLCAARGEAEAEGFAWPDGSEEELRRLLELLPRELSGRVETHPELPALVEVVMDLGRPPLARFPSGDFLLSQRPISFDDLRHATSQVGDFGADNRAGISRTLHRISAIRNRKGVIVGLTCRVGRAVPGSANLLHDLVKDGGSLLLIGPPGGGEDYCHKRKLPVC

SEQ ID NO: 86447 - DNA, 947 bp, Zea mays
  misc_feature: Ceres CLONE 1572875
  misc_feature: Encodes the peptide sequence at SEQ ID NO. 86448
ctccccgcggtggcggccgctctagaactagtggatcccccgggctgcaggaattcgtctcacccctagaaaaagtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagaacgacgagagcggcgccggccagcgaccccgacaagctcttgagcctgctgccgtcgccgcccatgaagctccccatcatcaggcacctgcacctgatgggggacatcccctacatgtccctcgccgcgctcgccaccaggtacagcccggacctgatgctgctccgcctcggcgccgtgccgaccgtggtggtctcgtcgccgcgcgtcaccgaggccgtgctccgcacctacgaccacgtcttctcctcccgcccgcgctccctggtgtccgacatcatcatgtacggcgccaccgactcgtgcttcgcgccctacggcgaccacttccgcaaggcgcggaagctggtcaccgtgcacctgctcaacgccagcaatgtgcggtcgcagccgcccccggaggaaaaaaaagggcgcgcgtggccctcgaacgggtgcgccttgccgcccactggcccggagggccctggaaaagacaacctcctgcacacaattcggcaacatcttcgctgccgactccgactacgggcagttctatcgtggagcattgccaacacaagcggggcccaagggctcatctacctccccgggagtaccccctggacgggtgccggatccaggcactacccaccattaggcggggcg

SEQ ID NO: 86448 - protein, 194 aa, Zea mays
  misc_feature: Ceres CLONE 1572875
  misc_feature: SWISSPROT Homolog: EC 1.14.13.68 4-hydroxyphenylacetaldehyde oxime monooxygenase
MKLPIIRHLHLMGDIPYMSLAALATRYSPDLMLLRLGAVPTVVVSSPRVTEAVLRTYDHVFSSRPRSLVSDIIMYGATDSCFAPYGDHFRKARKLVTVHLLNASNVRSQPPPEEKKGRAWPSNGCALPPTGPEGPGKDNLLHTIRQHLRCRLRLRAVLSWSIANTSGAQGLIYLPGSTPWTGAGSRHYPPLGGA

SEQ ID NO: 86449 - DNA, 793 bp, Zea mays
  misc_feature: Ceres CLONE 1572877
ggagctccccgcggtggcggccgctctagaactagtggatcccccgggctgcaggaattcgtctcacccctagaaaaatccccgaaaccccacttctcggatcgagactagggttagggttttgtcactcccgccccgattcgaaccaatccgcctaggcccccgccgcgccatggccgccggttccattgtggtggacttcccctccatgggcgccgccctctgcttccccgaactcgtaatcactcctgcgagaactcccgctcggtttctctcggcgtctcgcgccccggcccagggcaccgactcacaacttcaacggtctttccggggtcctaaaacctataaaaccgcggccaaggcttctggtattttcccgccccctttcagacggcccttaaaaccccgggaaagggtaaattttttcccccttttcccttttttttttgggggggccaaacccttttccctttttaaaacaatggccccaaaaaatttttccccaaaaaaaacccccccggggagaaaaaaaaacccccccaaaagagggccccccccaaaaataatttttgtgggttttttccccccccccccccttttttttttaggacccccccccccacccgggggggggtggtgcccccttttcccgccggttttttaaaaagggggggggggggggcccccccaaagaaagaaaaaagcacccccttcttttttcctcccccccccctttctaaaaaaaaggcgggggggggttttaaaaaaaaaaaagaggggccgccccttctct

SEQ ID NO: 86450 - DNA, 995 bp, Zea mays
  misc_feature: Ceres CLONE 1572878
  misc_feature: Encodes the peptide sequence at SEQ ID NO. 86451
aaagctggagctccccgcggtggcggccgctctagaactagtggatcccccgggctgcaggaattcgtctcacccctagaaaaagaatggcgacctcctccactccgccacctgctgcttcccacgcctccctctccccccgtctctaggttcgttcgttccacgtcgccggccacccctgtccacagccgcgacaaactcttcctcagacccacgccacgtacgatgcctctccccccttccctttcccctccgcccaacgccaccgccgccgccgccctgcccctcctcctgctgctcgtctgcgccagcagcattgccgcgcagccgctggcgtcgtcgcaggccaaggcgctcctccgggtgcgccgcctgctgttctacccgccggcgctcgagccgctgcgcggggcgccggacccctgcgcgctgccgcccgcgccggccctcgccgtcgcctgcgagggcggccaggtcacagcgctctccgtcctgggcgaccgcgacccggacgcggcctggcgcgccacgctgcccggcagtttctcttccgaggcgctgttcaacatgctcacaaggctcccggcggctcgggggcctctcgctcgtttggctcggggcctgggggccgggtcccggggcccagctccccccggttcaggtgctgacagaactaaacctgaagttcaaataattttaagggcccgtcccccaagggcctcgcccggttttaatctgctgaaaaacccctgggctgcccggagaaggggtcaaaagacccggggcgtgccctggccggggccccagttcctcgggaaacctgactggtggaaaaaccgggttccccccgggttttccagaaaggggggggacgtggttcccccctgtggcccgaaaaaaaaaaaatttgcgggcgggttcttccggtgcgggagagaaacccgtgaggggctccaaaatttttcgaccggcgggggaaacagtggcgggtgtgg

SEQ ID NO: 86451 - protein, 256 aa, Zea mays
  misc_feature: Ceres CLONE 1572878
MPLPPSLSPPPNATAAAALPLLLLLVCASSIAAQPLASSQAKALLRVRRLLFYPPALEPLRGAPDPCALPPAPALAVACEGGQVTALSVLGDRDPDAAWRATLPGSFSSEALFNMLTRLPAARGPLARLARGLGAGSRGPAPPGSGADRTKPEVQIILRARPPRASPGFNLLKNPWAARRRGQKTRGVPWPGPQFLGKPDWWKNRVPPGFSRKGGDVVPPCGPKKKKFAGGFFRCGRETREGLQNFSTGGGNSGGC

SEQ ID NO: 86452 - DNA, 961 bp, Zea mays
  misc_feature: Ceres CLONE 1572879
  misc_feature: Encodes the peptide sequence at SEQ ID NO. 86453
ctccccgcggtggcggccgctctagaactagtggatcccccgggctgcaggaattcgtctcacccctagaaaaaaagctcttccaccccgaagcaccacacctcccgccatgcactgcatcgccccccgcctgctcctcctcccactcccgaccgcctcccgccatgcgctatcgccaacccagacgccacctcttcctcccctcccgcgcctgtaagttccacctcgcctcggcacgctcgccgtcccgcgccgccgtttcggttttcggcgacgacgaggatgagatggcgcgtgcgtgcagggctgctgctgctgctcgtccctgtgccttctcccccgcgacgacgcgctctcgtccccctccgcctgcgcgcaccgcctcaagccttggtcttggcgtgcccaatcccccacctcgtcctcctaacgcttgtccccgcccgctccccaccctgatctacctgtctctacccttacctctttcatttctacttctccccggtgctgctctgctcctgctgccacaagaagattcacttttcatcgttgctcccgcctgtgatttcgtggcgcaacgccacttgtttgctgttttccctgcccgcttccggtggaatcgaattggctggaatccctcccaaaaccgaacttccccttttaagggcccacccctttcccttggttaagggcccggccccaatttaacccccccaaaatttgggttttcccccaccctgggggcccccgccggatcgaaacaaggggaattcccggatctcggccccctaagggaaaatcggatatttaggccccttccccccaggaaaagggttcccgccctcccagtttccccggggggtttggtcccaattttggtgaaattaaacccagggggggtggcggggtcctaaagaggattttaaaacccgtggcctttctccccaatgaggttttttgg

SEQ ID NO: 86453 - protein, 174 aa, Zea mays
  misc_feature: Ceres CLONE 1572879
MRYRQPRRHLFLPSRACKFHLASARSPSRAAVSVFGDDEDEMARACRAAAAARPCAFSPATTRSRPPPPARTASSLGLGVPNPPPRPPNACPRPLPTLIYLSLPLPLSFLLLPGAALLLLPQEDSLFIVAPACDFVAQRHLFAVFPARFRWNRIGWNPSQNRTSPFKGPPLSLG

SEQ ID NO: 86454 - DNA, 722 bp, Zea mays
  misc_feature: Ceres CLONE 1572882
  misc_feature: Encodes the peptide sequence at SEQ ID NO. 86455
  misc_feature (339)..(339): n is a, c, t, g, unknown, or other
ccccgcggtggcggccgctctagaactagtggatcccccgggctgcaggaattcgtctcacccctagaaaaagaagcgaaagcgaggctgctgtctcacggctgcggctgcgtgctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcatcgacccggccgtcggactcgaggggctgctcgcctcgctcgcgtccaccgggtttcaggcatccaancctccggcgacgccatgctacggtcgtcaacccagatgaactggagggttgtccccatggaggaaccccaacccaagggattgggaatgaaaccctggaactttgacccccttaaattataaaaccattccggggggaaaattgggcaaaaaaaaaattttttgggggggggttttacaccccctaaaaaccccccggggttttttttgggggggcgcgggggagaaaataaaccccgccttttttttttggcccccaaaaaaaacaaaagggggggggggggggtttttttttttttttcaaaaagaaccgggggggggggggtaataaagaagagaggaaaagacccccccccctaaataagaggcccccccccccccccc

SEQ ID NO: 86455 - protein, 75 aa, Zea mays
  misc_feature: Ceres CLONE 1572882
  misc_feature: SWISSPROT Homolog: EC 2.5.1.46 Deoxyhypusine synthase
  misc_feature (63)..(63): Xaa is any aa, unknown, or other
MAAGAGGGELEALEGVRSIVLKPSESLDESRFTRIAGADFIDPAVGLEGLLASLASTGFQASXPPATPCYGRQPR

SEQ ID NO: 86456 - DNA, 856 bp, Zea mays
  misc_feature: Ceres CLONE 1572883
  misc_feature: Translation starting site: 134
ctccaccgtcggttgtgcggccgctctagaactagtggatcccccgggctgcaggaattcgtctcacccctagaaaaaaagaggccaggacaggtaggcgcacatgccacatcccccgcgagcaactactaccatggcatcctcccctccacctcctcgccaggaagaggaccagcaacgggaagaagggcaccaccatggcgacggaggcgacgactaccagatcaccacaccgctcctggtggaagcggcgacgacgtcgtcgccgtcgccgtcggagggagacgatccagagaactcgccgatcgagcatgtggcgctgacggtgcctgtgggcgacgacccgtcgacgccggtgctgacgtttccggatgtgggtgctgggcacggcgtcttgcgcgctgctgtcgttccctgacccagttctctggtaccgcaaatagccgctgaccctaacgggcattctgggccaaaatccccgtgggtccccctgggcccccctaatggggggggggttccccggggggggcctggtttccggggaacccggtgggggattttccgctaaaccccggggcccttttaggggaaagaaaaaatggttccttacaactttttttccaaaaccgggggccggggaccctttaaccccatccccgggtttaaccccgccgggccggggtttaaaagagaagaaaaaaacccccctttgtgtgccccccccccgggggggggccccccccccaaaattggggggtcccccggggggggaaaaaaattccccccccccccccggggaaacccccggcgcaaattagtggggcgcataacccccgccggggaggccccccctcct

SEQ ID NO: 86457 - DNA, 900 bp, Zea mays
  misc_feature: Ceres CLONE 1572884
  misc_feature: Encodes the peptide sequence at SEQ ID NO. 86458
  misc_feature (580)..(580): n is a, c, t, g, unknown, or other
  misc_feature (588)..(588): n is a, c, t, g, unknown, or other
  misc_feature (615)..(615): n is a, c, t, g, unknown, or other
ggagctccccgcggtggcggccgctctagaactagtggatcccccgggctgcaggaattcgtctcacccctagaaaaagcgacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtgggcagaagaattactcgtttatgctccggaacaagaacccttgtgggaaagtnccaaaccnactttatttagctatggatacactagnctgatgagtttggcatcggaacactccgcctgacgacaggcagacattccagttgcacggtgttctttagaagaaactgagactggtcctagcactgtcataaagaatatgggctcacattgggtgcttgtggcgatctcaaccagaatgtacttgctcctgcaacgccttttgtaaaaaagaattccttttgcccacaaacagcagagaacatgcacccccttaaccccaatccggggcttatttgacccggggtggatggcaaaaaaaatgccacctaaaacc

SEQ ID NO: 86458 - protein, 143 aa, Zea mays
  misc_feature: Ceres CLONE 1572884
  misc_feature: SWISSPROT Homolog: EC 1.8.7.1 Sulfite reductase (ferredoxin)
  misc_feature (135)..(135): Xaa is any aa, unknown, or other
MSGAIGGAEVHGFRGAAAQLPRSRVLGRPIRVAPPAAARPGGASAGSIRAVSAPAKKDASEVKRSKVEIIKEKSNFLRYPLNEELVSEAPNINESAVQLIKFHGSYQQTDRDVRGQKNYSFMLRNKNPCGKVPNXLYLAMDTL

SEQ ID NO: 86459 - DNA, 921 bp, Zea mays
  misc_feature: Ceres CLONE 1572886
  misc_feature: Encodes the peptide sequence at SEQ ID NO. 86460
  misc_feature (813)..(813): n is a, c, t, g, unknown, or other
ccgcggtggcggccgctctagaactagtggatcccccgggctgcaggaattcgtctcacccctagaaaaaaagctcttccaccccgaagcaccacacctcccgccatgcactgcatcgccccccgcctgctcctcctcccactcccgaccgcctcccgccatgcgctatcgccaacccagacgccacctcttcctcccctcccgcgcctgtaagttccacctcgcctcggcacgctcgccgtcccgcgccgccgtttcggttttcggcgacgacgaggatgagatggcgcgtgcgtgcagggctgctgctgctgctcgtccctgtgccttctcccccgcgacgacgcgctctcgtccccctccgcctgcgcgcaccgcctcaagccttgggtcttggcgtgcccaatcccccacctcgtcctcctaacgcttgtccccgcccgctccccaccctgatctacctgtctctaccctttactcttccatttctacttctccccgttgctgctctgctcctgctgccacaagagtattcactttcaatcgttgctcgcgcctgtgatttcgtgccgcacgccgacttgtttgctgttttcgctgccgtcttctgttggatcggatttgtctggatcgcttccgagaccggatctacgctgttcagtgccgcaccccttctcttggtcagagctccctgcgcctgattagacccgcacgactctggatttgccccaaccgtgcggccccgccggatcgaaaccaggggatgtcccgatctcggtccctgaagcgagatgcggatctaagccccctccntccggggaatagttgctgctgctgctgttcccccggcggttgatcccatatagctgagttaagcctgagggaggtgccggtatcctaaaggacttgatgaaccggtac

SEQ ID NO: 86460 - protein, 140 aa, Zea mays
  misc_feature: Ceres CLONE 1572886
MRWRVRAGLLLLLVPVPSPPRRRALVPLRLRAPPQALGLGVPNPPPRPPNACPRPLPTLIYLSLPFTLPFLLLPVAALLLLPQEYSLSIVARACDFVPHADLFAVFAAVFCWIGFVWIASETGSTLFSAAPLLLVRAPCA

SEQ ID NO: 86461 - DNA, 958 bp, Zea mays
  misc_feature: Ceres CLONE 1572888
  misc_feature: Encodes the peptide sequence at SEQ ID NO. 86462
  misc_feature (821)..(821): n is a, c, t, g, unknown, or other
tggagctccccgcggtggcggccgctctagaactagtggatcccccgggctgcaggaattcgtctcacccctagaaaaaaaaaaaaaaagccctcacatcgcctgaccgacgcgcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccgcgaccgcgacctctgccgcttccacgccgacgactacatcaacttcctgcgctccgtcacgccggagacgcagcaggaccagatccgcctgctcaagcgcttcaacgttggcgaggactgccccgtcttcgacggcctctacagcttctgccagacctatgcgggtgcctccgtcggcggggccgtcaagctcaaccacggccacgacatcgcaatcaactggtcggggggcctgcaccacgccaagaagtgcgaggcgtctggcttctgctacgtcaacgacatcgtgctcgccatactcgagctgctcaagcatcacgagagaagtctgtatgtcgatatcgatatccaccatggcgatgggagtggaagaagcntttctacacaacagacaaggttatgactgtctcgttccaaaagttttgtgattatttccccaagaacaggggatatccgtgacattgggaactcaaaaggaaaagacaactccctgaatggccctctagaaaaagga

SEQ ID NO: 86462 - protein, 207 aa, Zea mays
  misc_feature: Ceres CLONE 1572888
  misc_feature (24)..(208): Pfam Name: Hist_deacetyl Pfam Description: Histone deacetylase domain
  misc_feature (200)..(200): Xaa is any aa, unknown, or other
MDPSSAGSGGNSLPSVGPDGQKRRVCYFYDPDVGNYYYGQGHPMKPHRIRMTHSLLARYGLLNQMQVYRPNPARDRDLCRFHADDYINFLRSVTPETQQDQIRLLKRFNVGEDCPVFDGLYSFCQTYAGASVGGAVKLNHGHDIAINWSGGLHHAKKCEASGFCYVNDIVLAILELLKHHERSLYVDIDIHHGDGSGRSXSTQQTRL

SEQ ID NO: 86463 - DNA, 916 bp, Zea mays
  misc_feature: Ceres CLONE 1572889
  misc_feature: Translation starting site: 88
  misc_feature: Pfam Name: DUF247 Pfam Description: Plant protein of unknown function
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
ctccccgcggtggcggccgctctagaactagtggatcccccgggctgcaggaattcgtctcacccctagaaaaatcttgtgtcactcatggactctcctctaatggagcccctactagtgcccaacaaccacggtcccggtccggttgtcgccgccacgccgggagaacacggcggtgctgcggtcgacgagagcagcaccctcgtggatgctgccagtggcacggatgagagccactgggcactcgccgacgccgacgtgaagatgaacgacgatggcgacgtacaaggggacgagctgtccgcgtccgtgctgcgccggctggacgagagcagcgccgtggagggggaggatgaagaggaggcagattggtgacgacgcggatggcgaccacatggcggctcgcatggaacggcgcctggcggcgctgcccgggaatgcacatgagagcgagccgttcaccatcttacgagtggcggggcccatgggcgaccgcaaccggcgactctacgagccgcagatgatctccgtcgggcccttccaccgtggcgccggactgcacctccccgccatgcatgagcacatgtgtgcggtacctccgcgacattctggcccgcgccggcgggcacctgctcgtccctgcctcctgtgagcgcgccgcagacacggtcccaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 86464 - DNA, 998 bp, Zea mays
  misc_feature: Ceres CLONE 1572890
  misc_feature: Encodes the peptide sequence at SEQ ID NO. 86465
tggagctccccgcggtggcggccgctctagaactagtggatcccccgggctgcaggaattcgtctcacccctagaaaaaaccacgcctcgctgctcagctgcctgctctgaagtcgatggcctgacctcgttccatcatcattgctgtcctccccctatctttcagatggctcaagctgttgccacgccggaaatcgatcagcctcgctcaactacgccggcagcgttgactgcgcaggttccaactcggataacccctactagaccaggcccagtaagtaccaaggacattgccgctggacaacctatcactttgcggcatccgctacggcgaccgcgtgcttgggtagctgtggcgggagttactgagactccagcggttgcagctgcgttcctgcgaccgcaccaggggacggcccccgtcactcgacttgacgggttgacttgctggattgctcgcgcttgacatcccagcttgccgtgctgtggtccaccgtttactcctgcttgataccgaccagtgaccgaacgctaacttacctcctgggctaagaacgcgggcgtcatcgatggaccttcatcggttcatccagcggcgtggtggctggttatgcaacaccttggtaccttcaacttccagcttggactggcaaaaactatcatccttcctcggcaaatggaacctgtaatctatttaacaaatgttagaaatggggcctaggtttcaattcgacctgcccaaacttactgcgcttatccccgggggaagtgccctccgggtccctgggtaggccaagagctccgggagctcagaataataaaacatcaaccttggttaactatacacatggcttaaaacgggaaccccggggttgggaaaatttgctcttcatgagaagccccgggacccgtctatttatcccggcttcaccttgagccccggtagaaaaaggggatgggcggcatgcttctccctggccggaattattgttagtgtg

SEQ ID NO: 86465 - protein, 39 aa, Zea mays
  misc_feature: Ceres CLONE 1572890
MDLHRFIQRRGGWLCNTLVPSTSSLDWQKLSSFLGKWNL

SEQ ID NO: 86466 - DNA, 967 bp, Zea mays
  misc_feature: Ceres CLONE 1572894
  misc_feature: Encodes the peptide sequence at SEQ ID NO. 86467
  misc_feature (653)..(653): n is a, c, t, g, unknown, or other
  misc_feature (713)..(713): n is a, c, t, g, unknown, or other
  misc_feature (714)..(714): n is a, c, t, g, unknown, or other
  misc_feature (717)..(717): n is a, c, t, g, unknown, or other
  misc_feature (721)..(721): n is a, c, t, g, unknown, or other
  misc_feature (722)..(722): n is a, c, t, g, unknown, or other
  misc_feature (731)..(731): n is a, c, t, g, unknown, or other
  misc_feature (736)..(736): n is a, c, t, g, unknown, or other
tccccgcggtggcggccgctctagaactagtggatcccccgggctgcaggaattcgtctcacccctagaaaaaactccactccactgtctgctggctgctgcttccttccagatctaggggatcaagcagccagccttccccgcgccgccagcaatggcggcacccccgcccgcgccgttcctcctcctgctgctcgccgtggcagcagcgtcgctcgccggcgccgacgacccctaccgctacttcacctggaccgtcacctacgggccaatcagcccgctcggcaccacgcagcagggcatcctgatcaacggccagttcccgggcccgcgcatcgactgcgtgacgaacgacaacctggtggtgaacgtcgtcaacagcctggacgagccgttcctgctcacctggaacggcgtcaagcagcgcaagaactcgtggcaggacggggtagcgggcaccaactgcggcatcccgccgggcgccaactacacgtaccgcttccaggccaaggaccagatcggcaccttcttctacttcccgtccctggccctgcaccgcgccgcgggcggctacggcgcgctcaacgtgtaccagcggcccgccatcccggtgccctacccgccgccggccggggaactcacgctgctcgtcngcgactggtacgccgccgcgtccccgcacgcggacctccggcgcgcgctggacacccggnnggngggnnggggggggntaaanttttccgccgcccgccgggctgtgtatataaagggccgcgtcctggggcgcgccgttcgtcggcggcccaaggcggaacgtacctgtttcggggggtcaaagttcgggctccggggcctccttcaaattcctgggtgaaagggccaacccctcccacttgtggggaaggggaaaggcacccaccccggtggcgaaaggaccataaatatgctttagaggtcaacaggggga

SEQ ID NO: 86467 - protein, 239 aa, Zea mays
  misc_feature: Ceres CLONE 1572894
  misc_feature (34)..(150): Pfam Name: Cu-oxidase_3 Pfam Description: Multicopper oxidase
  misc_feature: SWISSPROT Homolog: EC 1.10.3.3 L-ascorbate oxidase
  misc_feature (167)..(167): Xaa is any aa, unknown, or other
  misc_feature (187)..(187): Xaa is any aa, unknown, or other
  misc_feature (188)..(188): Xaa is any aa, unknown, or other
  misc_feature (190)..(190): Xaa is any aa, unknown, or other
  misc_feature (193)..(193): Xaa is any aa, unknown, or other
  misc_feature (194)..(194): Xaa is any aa, unknown, or other
MAAPPPAPFLLLLLAVAAASLAGADDPYRYFTWTVTYGPISPLGTTQQGILINGQFPGPRIDCVTNDNLVVNVVNSLDEPFLLTWNGVKQRKNSWQDGVAGTNCGIPPGANYTYRFQAKDQIGTFFYFPSLALHRAAGGYGALNVYQRPAIPVPYPPPAGELTLLVXDWYAAASPHADLRRALDTRXXGXGGXXFSAARRAVYIKGRVLGRAVRRRPKAERTCFGGSKFGLRGLLQIPG

SEQ ID NO: 86468 - DNA, 1047 bp, Zea mays
  misc_feature: Ceres CLONE 1572895
  misc_feature: Encodes the peptide sequence at SEQ ID NO. 86469
tcaccgcggaggcggccgctctagaactagtggatcccccgggctgcaggaattcgtctcacccctagaaaaaactccactccactgtctgctggctgctgcttccttccagatctaggggatcaagcagccagccttccccgcgccgccagcaatggcggcacccccgcccgcgccgttcctcctcctgctgctcgccgtggcagcagcgtcgctcgccggcgccgacgacccctaccgctacttcacctggaccgtcacctacgggccaatcagcccgctcggcaccacgcagcagggcatcctgatcaacggccagttcccgggcccgcgcatcgactgcgtgacgaacgacaacctggtggtgaacgtcgtcaacagcctggacgaccccctcctgctcacctggaacggcgtcaagcagcgcaagaactcgtggcaggacggggtagcgggcaccaactgcgggatcccgccgggcgccaactacacgtaccgcttccaggccaaggaccagatcggcaccttccttctacttcccgtccctgggcctgcaacgctccgccgggcggcttaccgcgcgctcaaagtggtaccagccgggccccccattcccggtggccttacccgcccgcccgggccggggaactttcacgctggctccggtcggacaaatgggaacgccggcctgggttcccccggaaagtgagaacatcccgggcgcgcgcctggaaacaacaccgggccggatgggtctaggcgagctgaaaacaccttctcgaatgaactaagcgacggaggccaataaaaaaaggagtcatccatcccgtggagtctagacaactattagttttgtcgcccacaaagcgaggagaagatacaacaatttccgggagtagaaataacctatggagatcagagcgcactcgttttaattagttccggggagagaggataacctgctctaagaaacaattgattgaatgatagacgagacacaccaactggggcagagataacgcacatacgtatgcgatgctgattccc

SEQ ID NO: 86469 - protein, 184 aa, Zea mays
  misc_feature: Ceres CLONE 1572895
  misc_feature (34)..(151): Pfam Name: Cu-oxidase_3 Pfam Description: Multicopper oxidase
  misc_feature: SWISSPROT Homolog: EC 1.10.3.2 Laccase
MAAPPPAPFLLLLLAVAAASLAGADDPYRYFTWTVTYGPISPLGTTQQGILINGQFPGPRIDCVTNDNLVVNVVNSLDDPLLLTWNGVKQRKNSWQDGVAGTNCGIPPGANYTYRFQAKDQIGTFLLLPVPGPATLRRAAYRALKVVPAGPPIPGGLTRPPGPGNFHAGSGRTNGNAGLGSPGK

SEQ ID NO: 86470 - DNA, 938 bp, Zea mays
  misc_feature: Ceres CLONE 1572897
  misc_feature: Translation starting site: 159
  misc_feature: SWISSPROT Homolog: EC 1.4.1.2 Glutamate dehydrogenase
  misc_feature (779)..(779): n is a, c, t, g, unknown, or other
ctccccgcggtggcggccgctctagaactcgtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaagtcatttctgggcctggtgagaagccaatgattgctgtccagcacaagggtgaggagaagcagtttgcagctgaagagatctcctctatggctcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgactagaaggctaccagtgtcggtgagaagatgtcctcatctttgatcttggangtggtacctttgatgtctccctcctcagcatcgcagaaggcactcttgaggtcagggcacagctggtgacaccccatctgggtgtgaagacttttgacacagatggtcaacaactcgtccccagagtcagaggaagatcagatgatatcactggcaccc

SEQ ID NO: 86471 - DNA, 993 bp, Zea mays
  misc_feature: Ceres CLONE 1572898
  misc_feature: Encodes the peptide sequence at SEQ ID NO. 86472
  misc_feature (908)..(908): n is a, c, t, g, unknown, or other
gcgctctagaactagtggatcccccgggctgcaggaattcgtctcacccctagaaaaaaaccgctacccattgcaaacgctttccctccactcgtccgctccggccgcgcgcctccgccccacgccgatgccgcccccgccctcgcccccgccgcctctcggcctccgcctccgtctctccctcctcccgccccaccctatcgcgccttctatccgtcatgccttctgctcaccctccgtcgtgtcctgccatctttcggtgcgccccctcgcccaacgccgcggtgggcgcccgcgccccctctgcgccgcgcggggcgaggccgaggcggagggcttcgcgtggccggatgggtccgaggaggagctgcggcggctcctggaccccctccctagggagctgagtgggcgggtggagacccacccagagctcccggcgctcgtggaggtggtcatggacctcgggcggcccccgctcgcgcgcttcccgtccggagacttcctcctctcccaacgccccatctccttcgacgacctccgtcacgctacctcccaggttggggactttggagcggataatcgtggctggaatcagccgcacgctgcaccggaatcagcgccctttaggaatcggaaggggcgtccttgtgcggcccccacctgccactgttggggcgtggcgttgcccggtgagcgccttattttgcttcagggattggggtaaggacggtgggttcatttgtggtccaccggcccccctgggggggggggaagaccaccggctttaaggaaaatttgggccctattttgggcggacggctttatagaagcgcgcggagtgttgttccaaccctcttattatgaattgctgggggaaggcggagtattcttcctcccgaaagaagggngtgacttttatgtgtgagagtggcctatccaacaaagtgcgtgaaatgggaccgtgtttgacctctggataaccacatatgcccg

SEQ ID NO: 86472 - protein, 198 aa, Zea mays
  misc_feature: Ceres CLONE 1572898
MPPPPSPPPPLGLRLRLSLLPPHPIAPSIRHAFCSPSVVSCHLSVRPLAQRRGGRPRPLCAARGEAEAEGFAWPDGSEEELRRLLDPLPRELSGRVETHPELPALVEVVMDLGRPPLARFPSGDFLLSQRPISFDDLRHATSQVGDFGADNRGWNQPHAAPESAPFRNRKGRPCAAPTCHCWGVALPGERLILLQGLG

SEQ ID NO: 86473 - DNA, 939 bp, Zea mays
  misc_feature: Ceres CLONE 1572899
  misc_feature: SWISSPROT Homolog: EC 1.4.1.2 Glutamate dehydrogenase
  misc_feature (853)..(853): n is a, c, t, g, unknown, or other
  misc_feature (939)..(939): n is a, c, t, g, unknown, or other
tccccgcggtggcggccgctctagaactagtggatcccccgggctgcaggaattcgtctcacccctagaaaaactgacgcctcgcgagagccatcatcttccaaaccctcgccgcagccgcagccgcagccgcagccacccttgcttccgcacgatagtgcccgggaccagccttctatggcggcgtcgctgctcctccgcgctgtgcgccgaagaggagctcgcgtcccctctcggatccctgggtgccaacttacagtcaacatgtgctgccaacatatgctcaaaatggggaaattttgcaagaccttttagtgcaaaagctgctggaaatgaggttattgagattgatttggggacaactaactcttgtgttgctgttaaggaaggaaagaacccaaaagttattgagaatgctgaaggtgcgagaacaacacactctgttgtcgcatttactcagaagggagaaagacttgttggtactccagccaagcgccaggcagtaaccaatccccagaatactttctttggaacaaagaggatgattgggcgacgctttgatgatccacagacacagaaagagatgaagatggtgccatacaaaatcgagaaggctccaaatggtgatgcttgggttgaaacaacagatggcaagcagtactcaccgagtcaagtcggtgcatttgtgctgaccaagatgaaggagacagctgaatcttaccttggcaaatcagtctcagaggcagtgattactgttccagcttacttcaatgatgctcagcgtcaggccacaaaagatgctggtcgcattgctgggcctgattgtgaaagatcatcaatgaacctacagcanctgctctgtcttatggaatggacaacaggaaggctttgatagcgtatttgatcttgggaggaggacttttgcaatctctatccggn

SEQ ID NO: 86474 - DNA, 952 bp, Zea mays
  misc_feature: Ceres CLONE 1572900
  misc_feature: SWISSPROT Homolog: EC 1.2.1.70 Glutamyl-tRNA reductase
  misc_feature (737)..(737): n is a, c, t, g, unknown, or other
  misc_feature (799)..(799): n is a, c, t, g, unknown, or other
  misc_feature (873)..(873): n is a, c, t, g, unknown, or other
gcggtggcggccgctctagaactagtggatcccccgggctgcaggaattcgtctcacccctagaaaaaataaaaaatgggtacgcatcaataaataggagcttgggaagttgccaaggcctccgattttgccaatgcgacggtgaaatcccgcacctacctccttcctctctcaccgaggaccctcgcaccaagaactgagcgggaagagaggtagagaggcaagcgcacgagagtttctgcttctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcggccctctgccagagggtggccggcggcggcaggcggcgctccgggtgtggtgcggtgcgactcctcctgcgtggaggcccaggcgcatgccgtggcaaaggcggccagcgtcgccgccctcgagcagttcaagatatccgccgaccggtacatgaaggataggagtaccatagctgtgataggcctcagtgtacacacagcaccatgtggagatgcgtgaaaaacttgctgttgcagaggaactgtggccccgtgctattcaagaactcactagcctgaaccatattgaangagctgctgtttcttagacctgtaatagaatgaaaatttatgtgggtgcgctatcatggaanccgtggtatcagagaagagtggactggatgtccgaataaaagtgggattcccgctttcgagcttaaggagcaantggtcattctgcgatcagtgatgcacacggcatctgtttgaggtgtcactggccttgaccctttggttccggtgtagaa

SEQ ID NO: 86475 - DNA, 1004 bp, Zea mays
  misc_feature: Ceres CLONE 1572901
  misc_feature (1004)..(1004): n is a, c, t, g, unknown, or other
tggagctccccgcggtggcggccgctctagaactagtggatcccccgggctgcaggaattcgtctcacccctagaaaaataaaaaatgggtacgcatcaataaataggagcttgggaagttgccaaggcctccgattttgccaatgcgacggtgaaatcccgcacctacctccttcctctctcaccgaggaccctcgcaccaagaactgagcgggaagagaggtagagaggcaagcgcacgagagtttctgcttctagtctcgtctcgccccgcctccgtctcctttccctctctggttctctctctgcgattctcgtcgcattggttccgttccctcacgaaaggcggtagctttctgtcttccctgatctatctagataatggcgacaacgacgtcacccaccaccgccgcagcagcagccgccaccaccgccaagccgcgggggtcgtcttcggccctctgccagaaggtggccggtcgccgcatgcggcgcttcaggggtggtgccggtgccacccccccctgcgtgggaaggccaaggcccaggccgtggcaaaaggcggccaaacgttccccccccctccaacaatttcaaaaattttcccccgaaccgggtccttgaaagggaaagggagtacccctaccctggtgaatagggcctccaggggtaaccccagcgcccccggggggagaagccgggaaaaaaacttgctggtttggcaaaaaaaaacttgtggcccccctgcccttttcaagaaaccaccctgcccctgaaccctttttgaaagaggccgggctgttccttagaaccccggaaataaaatggaaaattttttgtgtggggggcgcttttatggataccccggggttacccaaaaatatcgggaaccgggagttgcaaaaaaaaaggggttttccccccttccaaacctatggggcaccccttcccccttgggaagatggattgcccacccccctctttttggggggcccccggccccn

SEQ ID NO: 86476 - DNA, 952 bp, Zea mays
  misc_feature: Ceres CLONE 1572902
  misc_feature: Translation starting site: 408
  misc_feature: SWISSPROT Homolog: EC 1.14.13.11 Trans-cinnamate 4-monooxygenase
  misc_feature (717)..(717): n is a, c, t, g, unknown, or other
  misc_feature (952)..(952): n is a, c, t, g, unknown, or other
ccgcggtggcggccgctctagaactagtggatcccccgggctgcaggaattcgtctcacccctagaaaaagcaaccaaccaaagagcactgacactcaccgccggcgacgcccgaccgcaactgtggactcaccaacgccggcatcccgtgccaccaatgaccaaaaccttctccggctctccagtccctccacgacggctctacaccccctacctaccgcatgtccgtcaattttaccgccaactccccagtccccataccgccgtttctcctatatatgcgcacggacatgtccgttgagatctccaggaaggcaggaagaaccgccgccacgccacacacaaaacagtgactcagtgagaaaggacagcaagccctcccctccctccatctccgccccgtcgccatggtccttctcttcgtggagaagctcctggtcggcctcttggcgtccgtcatggtcgccatcgcggtgtccaagatccgtggccgcaagctccggctgcctcccggccccgtccccgtgcccgtcttcgggaactggctgcaggtcggcgacgacctcaaccaccgcaacctcgccgcgctgtcccgcaagttcggcgacgtcttcctccctcggatggggcagcgcaacctggtggtggtctcgtcgccgccgctggcgcgggaagtgctccacacgcaggccgtggagttcggctcccgcacccgcnacgtggtcttcgacatcttcacggacaagggcaagacatgttgttcaccgtgtacggcgaccactggcgcaagatgcgccccatcatgaccgtgcccttcttcaccaacaggtcgtgcagcattacccccccgcttggaagaccaggcccgccccttcttctacaatggcgccttaccccaaggtggccccgaacggaaacgtgctccgccaaccctgcagctcatgaagtaaan

SEQ ID NO: 86477 - DNA, 942 bp, Zea mays
  misc_feature: Ceres CLONE 1572903
  misc_feature (571)..(571): n is a, c, t, g, unknown, or other
ccccgcggtggcggccgctctagaactagtggatcccccgggctgcaggaattcgtctcacccctagaaaaagccttctcttctctacatggagcatcagcagagggacaggcaagaacacacccgagagtacatcaacagctccctctgcatctgcgcctcatgaccgtcatctgcctgcgcaatcttcttcttcctcaactgtctctctcttcttccgatgcgcaccgctcccagcaccgtaggaagggaagcccaggaatctacgtcccgctcccggacgcaggccttctgataacctcatcggatatgtattggattgtcagaagaagagcagaaaacgcctctaaggaatgcagaaagatgtgcttgcacgacgaagagctactttgtgatggacttggcaggaaagcacgccatactcttcattctcgtgacaactcttgatgacttctaagctcaagagtacaggtatctccacctcgtgctttcacacaatggggttagacgtggctgctcaaccgtcttcttagatcaccatctcggtggagacggttgaaggcttgacacnatctcgacctctttgatgtctcatttttgttaactgtcaaggataaacaagtgacctctgtgaggatgcagcaccaccatacgtagcatacacaggcacagatggcagagcatagagggaacattctcgtgcacgagtatgagatgggcaaattgcttgggcaatgcaacttcgccaggactaccaggctgatatgacggcgacctcgtaaagtgtaccgatgcaagtgattgataacgagaaggatatgaaagtggggtctcatgatgcaatgcagcgagaacttcctgggatgaaaatggtaggcatccaaaatcgtaagactctttgagtcatggcagcaaaacccaaatagacttgggctgggacat

SEQ ID NO: 86478 - DNA, 956 bp, Zea mays
  misc_feature: Ceres CLONE 1572904
  misc_feature (405)..(405): n is a, c, t, g, unknown, or other
acccgcggtggcggccgctctagaactagtggatcccccgggctgcaggaattcgtctcacccctagaaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagtttgtttcttcggcaccgagccatcgcacggccgcccccgcatctcgtcctgctctcaggtccttggcctccgccgttcttcgacaggggcgcgacccggtgcccactccgcgaaatccgagtccctcgtgcagctccgtagggtggaagagatccatcaggcggtgagcggtaggaggcgcccgtacaactganggggcgggcaatggcggccgtggcaggcccactctgcacgtggctcgttgccgcgtgcttgtcttgcggttgcgacccaaaagaatacaagcattagcattgctgccccccgcgaaagcggcccttggggccggggttatgcttgggccaggccccccccttggcgcccggggttccgggttgggggggccccggaaaagggctttgggtgtttggccttcaaacgggaaaaaaaggggccttgaaaaaaaaaaaaccccgtattcaaaaaaggggggggggggtgtcccccggcgggggggggattgtcccccttgggggcctttatcccaaaatctttttaaaaaactttttttgagtgggttgccggaaaaatggggaaaaaaggggttttgtgggtgccccctcccccccaaaattggggggaaaaaaaactcctccccccgagggggggggggcccccacctccccggggggggggcaattttttttcttcttaaaccgccggggaaaaaccttaaaagggggggcccccaaaaagaaaagagagt

SEQ ID NO: 86479 - DNA, 941 bp, Zea mays
  misc_feature: Ceres CLONE 1572905
  misc_feature: Translation starting site: 335
  misc_feature: SWISSPROT Homolog: EC 2.7.11.1 Non-specific serine/threonine protein kinase
  misc_feature (542)..(542): n is a, c, t, g, unknown, or other
  misc_feature (733)..(733): n is a, c, t, g, unknown, or other
  misc_feature (841)..(841): n is a, c, t, g, unknown, or other
  misc_feature (855)..(855): n is a, c, t, g, unknown, or other
  misc_feature (881)..(881): n is a, c, t, g, unknown, or other
  misc_feature (882)..(882): n is a, c, t, g, unknown, or other
ctggagctccccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaggacaagctggagcgcgcgggcatggcggagcagatcaagcgggagatcgccgtcatgnaagatggtgtcccaccccaacatcgtggagctgcacgaggtgatggccacccgctccaagatctacctcgcgctcgagctcgtccgcggcggggagctcttctcccgcatcgcgcgcgcggggcgggtccgggaggacgtggcgcgctgttacttccggcagctcgtcgccgcggtcgacttctgccacgnacgcggggtgttccaccgagacctgaagctcgagaactgctcctcgacgaagtaggcaacctgcaagtggcggactttgagctcagcgcgctcgccagcacgcgcgcntccgacggctgctncataccgcctgtgcacgccgtcaacnntccccccctagtgctccgcgggaaggctacaaacgcgcaaggggactccttgtctggac

SEQ ID NO: 86480 - DNA, 930 bp, Zea mays
  misc_feature: Ceres CLONE 1572906
  misc_feature (730)..(730): n is a, c, t, g, unknown, or other
  misc_feature (735)..(735): n is a, c, t, g, unknown, or other
  misc_feature (742)..(742): n is a, c, t, g, unknown, or other
  misc_feature (805)..(805): n is a, c, t, g, unknown, or other
  misc_feature (806)..(806): n is a, c, t, g, unknown, or other
  misc_feature (876)..(876): n is a, c, t, g, unknown, or other
  misc_feature (908)..(908): n is a, c, t, g, unknown, or other
ggcggccgctctagaactagtggatcccccgggctgcaggaattcgtctcacccctagaaaaagccagctctaggaggagctgaaaaagggtccgccatcctacgccaggtgccccggtcttggtagcctcgtcgaccccttcgcctggtcttcgtcgggcccttcgccggcgacaaacacccattagtagtcctcccgtggcaggccagacattcagattgaactcgtcggctctcgtcctccgtcctctggtcctctctgagcgagacagcaagagagatgctgctggaaggaagcttgcgaattcgaaggacggtaaatgagttctttgcgcgcgcgaaaggatgggctcctgtgtccagaaggatcgtgggttgacaaaaagtctttggccctgtcttgcttattgatgtgtggttgcagtttggtagttctctgctggctcttggctgctggtttgtaatatatcgttatgttagctgatgaatggtcggcttttgatactttccatcgttaggtctttatctcgtgtgtgagtttcgctaagtcgaactcaataaaatcgctagtgacttcacagtctgtagtaaggctgtccagtagttgatcgtcggttaggcgtttgaggtctatggtaccttaagtcgccgcctggagtaattgcactcgttttggtatgtttccctatttctatgaaaatagggggggtcttccctttcaccattccancaccntgcattncagtccgatttggacattgttctcggtctcctcatcccctgtcccactgtttctgctctgcgnncgcgccgctggcgctcccgttgccgcatgaaacctttacaagctgagcacccccgggctaaccggggtanctttgcagtattgaaataaggggccttctttncgccgggccgctcgtcgaaggt

SEQ ID NO: 86481 - DNA, 970 bp, Zea mays
  misc_feature: Ceres CLONE 1572907
  misc_feature: Encodes the peptide sequence at SEQ ID NO. 86482
ctccccgcggtggcggccgctctagaactagtggatcccccgggctgcaggaattcgtctcacccctagaaaaagctcctgcctcgactcaccaccattagagcgcgcgcgccaagctcgtggtgagggtctcgagatgaacgttatccacaacatcctggatgcggcgggggatggcccgacggcgttctcgttcgagtacttccctccttctgcgacatcacctggggcgccgggggatccaccgctgaccttaccctctaaatctcctaccgtatgcagaacatggtgtgtgtggaaaccatgatgctcctgacttgtacgacctgccatgtatactatattgaccctgccttgagaaccatctaattcaatgagattcagattgtttcggccccctgatgggacccccccctggggcaagacaaatttgggcaagtttaaagccgaattggcttgtgcccttgattttggggcaacatattttaagcccaaccacaggggaattttttgtgccttaaacggtgcccgggttttccccaatggacaccccccgggttggcatttccagggggaggggaaggggcttaaaattggggaaaacttattattccaatggtctttttgggctactcttgaaaaaaaaaaaaaggttgaaaaccccgggggcctcaaccctcttttttgtgttccaacaactttttttttttgttattcccccaccccccttttccccaaaatttttggaaaataaaaccgcccgcccacatttggttttatttttttccccccggggtgtcccggccctttttccccctttattctcctccccagggtttcccgccccctaaaaaagggtttttgcaaaaaaaaaaaaacccctcgaaaaacaggtgggtggccataccctctttaaaaaaaaaatggaggggttttaaaaaataaaaacccaccctggtgaagaaagggg

SEQ ID NO: 86482 - protein, 30 aa, Zea mays
  misc_feature: Ceres CLONE 1572907
  misc_feature: SWISSPROT Homolog: EC 1.5.1.20 Methylenetetrahydrofolate reductase (NAD(P)H)
MQNMVCVETMMLLTCTTCHVYYIDPALRTI

SEQ ID NO: 86483 - DNA, 900 bp, Zea mays
  misc_feature: Ceres CLONE 1572908
  misc_feature: Translation starting site: 306
  misc_feature: SWISSPROT Homolog: EC 2.3.1.119 Icosanoyl-CoA synthase
ccccgcggtggcggccgctctagaactagtggatcccccgggctgcaggaattcgtctcacccctagaaaaaacgggcgccactcgcggctccgcccctattttaagaccccaccacggcaccacctcctccgcaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgcctcggcccccggcgagctgctctcgctgtggcgctcgctggagctggacctggtccacatcctctgctcggcgttcctggtcgtcttcgtcggcaccgtgtacgtgatgtcgcgggcccagccggtgttcctggtggaataagcctgctaaaagcccccgccaagctggccggtgtcctttcgccaccttcatggagcaaacgcggccttttcaggaacaacaaaaagaactgggccttccaaaccagtatccctggaaccccccggggcccggcaaaaaaaaatggctccccgcccgccaaaccttatattccgccccaacccacaattggaggccccccgggccaaggggcaaattctttattttttcccccatataaaaaacattttccccccaacgggggtctaacccaagggaaatgaaactcccgtttggaaaaagggaggcctttttccccga

SEQ ID NO: 86484 - DNA, 944 bp, Zea mays
  misc_feature: Ceres CLONE 1572909
  misc_feature: Encodes the peptide sequence at SEQ ID NO. 86485
  misc_feature (771)..(771): n is a, c, t, g, unknown, or other
  misc_feature (820)..(820): n is a, c, t, g, unknown, or other
ctccccgcggtggcggccgctctagaactagtggatcccccgggctgcaggaattcgtctcacccctagaaaaaatagccgaagccactcgcttcttcctcctctcacctctctcgaaactttccccaatcccatctcctgcccccctctcccaaccctatccacgccgccgccagccctgctcgggtggtgcgcatacatgaaccatccgtcctcgtcttcgtcctccgcccagccgccgccagccccggcagcgagcggccgaggccacctccctagcgccgggcttccgcttccaccccaccgacataggagatcgtctcctactacctcaagcgcaaggtcctcagccgcccgctcaagggtgatgccatcgccgatgtggacctttagaagctcgagccctgggagctgatccgcccgctcccgcctgagctcccgcgactcccagtggtactacttcatccgcctcgaccgcaagcacgacaaccacgcccgcaacaaccgcgcctcggcgggagggtactggaacaccaccaggaaggacaggaaggtgcgccataggcccaggcttgtcgtgaacaagaacacgctcatactccacgccagacgcgccgccaacggcgaacgcaccaactgggtcatgcacgaatacagcctcgaaggcgacgacgccgcactgcataccgcaggactcattatgtgtgtgccggatcttacaaatagctggaccaggtcctcagaatggcgtacagtatggaccacctttcnatgacgacgaatggcgaggagatgaccctgatgatggtctgcttccagnaggaggtgcttgctgctgctgaccatgacgatgcacctgaatatcgtggaaatgcatgggggtttggataaagctatcctccaaagatcggccttattcgggtttggatgatccacatgaaaag

SEQ ID NO: 86485 - protein, 42 aa, Zea mays
  misc_feature: Ceres CLONE 1572909
MHEYSLEGDDAALHTAGLIMCVPDLTNSWTRSSEWRTVWTTF

SEQ ID NO: 86486 - DNA, 958 bp, Zea mays
  misc_feature: Ceres CLONE 1572910
  misc_feature: Translation starting site: 333
  misc_feature: SWISSPROT Homolog: EC 4.1.1.50 Adenosylmethionine decarboxylase
  misc_feature (746)..(746): n is a, c, t, g, unknown, or other
  misc_feature (772)..(772): n is a, c, t, g, unknown, or other
  misc_feature (800)..(800): n is a, c, t, g, unknown, or other
  misc_feature (825)..(825): n is a, c, t, g, unknown, or other
  misc_feature (914)..(914): n is a, c, t, g, unknown, or other
  misc_feature (947)..(947): n is a, c, t, g, unknown, or other
  misc_feature (958)..(958): n is a, c, t, g, unknown, or other
ggagctccccgcggtggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaagcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgangcacctgtctttgtgaccctcatggncgtggtttgcgtgccctctccagggccnagatgactctgttctggatctgcancggtgcacattgtgtccgactctcccacaggattcgactatatgtcctctctgagtcagcttgttatctatcctctgagattggcatcnagacctgtgcactaccagctctgctcaccatcnagaatcctgan

SEQ ID NO: 86487 - DNA, 810 bp, Zea mays
  misc_feature: Ceres CLONE 1572912
  misc_feature (288)..(288): n is a, c, t, g, unknown, or other
  misc_feature (316)..(316): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (610)..(610): n is a, c, t, g, unknown, or other
  misc_feature (618)..(618): n is a, c, t, g, unknown, or other
  misc_feature (734)..(734): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (772)..(772): n is a, c, t, g, unknown, or other
  misc_feature (773)..(773): n is a, c, t, g, unknown, or other
  misc_feature (781)..(781): n is a, c, t, g, unknown, or other
ctccccgcggtggcggccgctctagaactagtggatcccccgggctgcaggaattcgtctcacccctagaaaaagaggacatcctcggccttccagggcagcaaccacgaaagccttctgcgcagggtgctttcctcgcagcaaatattcctgccttttgcattcaggctttgcaagttccttgctttgggaatatatattgtgaggtctctatatatataggtggttcgaggtgatcggcagaaccacacacgcaaagatggcgagcatgcacaatgccaccacccnttggttctcatgtttctgccctgctagncgcctggggagaaccgggatttacccccaagttccaatggacccgaaaaaaaccccccccccctgtgtttctcttcaaagaaacccccggggggggcgaaaaaaaaaccccccccccaaaaaaaaaaatcgccccccaatttaaagccccccatccccgggggggggaaaaaaaaaccccccgcgggggaaaaacccccgggggggaaaaaaaaaaaaaaatttttttggttttttgggagggtgctctttttttttgttgccgggaggggaaaaaaaaaaaaaaannnngagnatcccccnccccccccccccccccccccacccaaaaagaagaggatggggcgccaccccccccccccccctcctccctgttgtggtggggtgggggcgccccccccccccccccccccctgtgngggttttggtgtgcgtgcccactccggcgnnnnacaannggaggaangcagagtcattgtagtgctatcgtctctt

SEQ ID NO: 86488 - DNA, 872 bp, Zea mays
  misc_feature: Ceres CLONE 1572913
  misc_feature: Encodes the peptide sequence at SEQ ID NO. 86489
ctccccgcggtggcggccgctctagaactagtggatcccccgggctgcaggaattcgtctcacccctagaaaaaggcttctcggcttctcccctcccctcccctcgactccctcctctcaatctccagcctctctttctcgctcgctggccacccgccgccgcaccctcctccccatcaggccagcagcgaggaagaatggagtacgagaggattcatcagaaagcccagcctggtgctctttctccaacaaagctgaggatgaagatcctgggagcccacaatcgagtgagagtcatcaccagcaactcgtcatcgcggacgtcgcactgcgaaaaccatcgaggcttcacaggcgcagaacatgctactagtttgtgatgttcttgacgaagtttcacacagcgcagatagcacaaaacacccgtcagcaactaagcaaaccgaagccgtagaaaaggttcaaaaggatccagcagtggacatcaagcaagtgcagaacgcttccaccagttccgctggctagccagcgacatgcagctcgagtatgatacagatacacccggtggagacccgcgaaagaagcagcactaccgaatgcgacggtgggcctcgacaacgccaggactttcaaacttccaatttccccgaattggaaaaaggcggcggcaacgcttaaatccatccccggggcccttgccccgaaaaaaatttccttttcccccaagtgggattgacccataaaaaatgggttggggtccccccccaaatgtccccccaaaaaaaccgtccccagggggcccttttctaaaaccccaccctttaaaccaatattacctccccccgccccaaggggggccccttttgtttcca

SEQ ID NO: 86489 - protein, 60 aa, Zea mays
  misc_feature: Ceres CLONE 1572913
MEYERIHQKAQPGALSPTKLRMKILGAHNRVRVITSNSSSRTSHCENHRGFTGAEHATSL

SEQ ID NO: 86490 - DNA, 947 bp, Zea mays
  misc_feature: Ceres CLONE 1572916
ctccccgcggtggcggccgctctagaactagtggatcccccgggctgcaggaattcgtctcacccctagaaaaaaacaggggtgggagctagcgcaaccttgcatggatgattacgctgaagcacagcgatgagtaggagagagagaatagagccgctgcgaccacgcctcgcgtgcaccatcgaccagcctctcgatcgctggggaatcgggcgagatcaccaagtcgtgcagatcgtgcgtgtggtcagcagagcaaggaagttggcgggggagacgaattgcttgccggtgcttggccgaagcctcaccgggaatcctcgggcggcactacagcgtcgaccggccgcatcgacgtcttctcgagtggagagaccctactaaattactcgccgtagcatccgcatagatgatccccattcaatttccgaatttagacctagaaatcggctagggttggttcgccagcaatggcgacgtcgtgcctgcgcgttctgtcgccggtcgggcgccgtggtgagagagagaggattgggggggagaaaaatgaatggcttgggctgttggatcatacacggatgagcccgatctaagcgcgcataccgcgtcgctcaatgagattggggccgtagatctgagatcagcgatgcggatgtgatcatagtcattctctatctggactgacgagctgtaatccggtggtcctcatggctgaccggttcatgatgtacgaaggctaatgctgggcgcgtgatcttcatctgactgctgaactcagcccgtacacttcggccggagaaaatgctcgtgggccctcataaagcatcaaaaaacccggcggcactcccggggaaaaaaattaaatggagggcgtgagcttcaaacttaaacccggtgttctgaaaaattgtgtcgacgctgcacttttggggaggccgtactcaagg

SEQ ID NO: 86491 - DNA, 927 bp, Zea mays
  misc_feature: Ceres CLONE 1572917
  misc_feature: Encodes the peptide sequence at SEQ ID NO. 86492
  misc_feature (813)..(813): n is a, c, t, g, unknown, or other
  misc_feature (874)..(874): n is a, c, t, g, unknown, or other
  misc_feature (895)..(895): n is a, c, t, g, unknown, or other
ggagctccccgcggtggcggccgctctagaactagtggatcccccgggctgcaggaattcgtctcacccctagaaaaaaccgtcgcattctgcagcgccagctcgctcctcgccccgcccccttctctcagcggcgacgcctcgggcgttcctaccctgccccctctccggaccccccacgccgtcggcgaagcagccgggcaagagcccgatccagaccccgcgagcaatccttgatatacctgatggctatgattgatgagcctctgtacccaattgctgtactgattgatgagcttaagaatgaggacatccagttgcgtctaaactccattagaagactttcgacaattgcacgggctcttggagaagaaagaaccaggaaggagctgattccctttcttagtgaaaacaatgacgatgaagatgaggtgcttcttgcaatggctgaggaattgggtgtgttcattccttatgttgggggtgtagaacatgctcatgttttgcttccccctttggaaacattgtgtacagtagaagaaacttgtgtccgtgataaggcagttgaatctctgtgccgtattggtgcacaaatgaaggaaactgacatagtcgactggttcattccagtagtaaagaggctagcagctggtgagtggtttacagctcgtgtatcatcctgtggtcttttccacatagcctatccaagtgcattggaccaattgaaaacagaattgaggactatctatggtcagttatgtcaggatgacatgcctatggtcagaagagctgctgcatcaaatcttggaaagnttgcagccacagttgaaacagatcatttgaagacagaaatatgtcaatatttgatgacttnacccagatgatcaagattcantgcggttgtttggctgttgaaagtggtgctgc

SEQ ID NO: 86492 - protein, 212 aa, Zea mays
  misc_feature: Ceres CLONE 1572917
  misc_feature (190)..(190): Xaa is any aa, unknown, or other
  misc_feature (210)..(210): Xaa is any aa, unknown, or other
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGEWFTARVSSCGLFHIAYPSALDQLKTELRTIYGQLCQDDMPMVRRAAASNLGKXAATVETDHLKTEICQYLMTXPR

SEQ ID NO: 86493 - DNA, 1041 bp, Zea mays
  misc_feature: Ceres CLONE 1572918
  misc_feature: Encodes the peptide sequence at SEQ ID NO. 86494
  misc_feature (795)..(795): n is a, c, t, g, unknown, or other
acccgcggtggcggccgctctagaactagtggatcccccgggctgcaggaattcgtctcacccctagaaaaagccgtctagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggaacaccgggatcgggataaaggattgacgggaaggagaaggagaggagccgcgatagccgcgggaagggacagagacagggaggggagagaaaacggggagaaaggataatggggggacaggcaccggcccataatagagggaggtggaaacgggagcgggaggatgcctgagccgttcgggggcggcgccgtatcgaggaagaggagatgggtgacgggaactcggagaatgggaaccccaagcgcatcctagcgacaccactattcgccgaccgtggaacttcgggcgttaaggaaaaattgacgggggcataagcccctaaattttgatcccaaaaaagggacccaggaagaacgggttttttcctactcccagctattttcctgaatggcaaaccaaaaaaaaaaagggtttaggaaattccctccccaaaggggcccgggaaaaaggttccctgaaggttcctcctttcatgacgaaaactccaaaaaaacngtccctccaaaaagaagaggtggggaataaaaccccccaaaaaattttttatgtttgggcccccccccgccccggggttttccggcgcattttccacgggaaaaggggagaagttttgacccccttcccagaaggcccgcccacaccttttgaggaagaaatttgtttatccaagcgttttgttaaaaaaaacctgtggggggtttttggggaataaaaagggggggcccccaaaacatactttct

SEQ ID NO: 86494 - protein, 97 aa, Zea mays
  misc_feature: Ceres CLONE 1572918
MEFDEYEYLEKAVEPAPPPANGSGSGEKDRGSRRREGDEGRISKRSRSGEDRERGRHRSVREHRDRDKGLTGRRRRGAAIAAGRDRDREGRENGEKG

SEQ ID NO: 86495 - DNA, 830 bp, Zea mays
  misc_feature: Ceres CLONE 1572919
  misc_feature: Translation starting site: 182
  misc_feature: SWISSPROT Homolog: EC 1.8.7.1 Sulfite reductase (ferredoxin)
  misc_feature (113)..(113): n is a, c, t, g, unknown, or other
ctccccgcggtggcggccgctctagaactagtggatcccccgggctgcaggaattcgtctcacccctagaaaaagcgacccctcgaccgtgcgaacgagcaaaggacaaatantcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccgcgggtagcatacgcgccgtctccgcgcctgcgaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtgggcagaagaattactcgtttatgctccggacaaagaacccttgtgggaaagtccaaaccaactttatttagctatggatacactagctgatgagtttggcatcggaacactccgcctgacgaccagcagacattccagtttgcacggtgtccttaagagaaactgaagacggttctaagaccggcataaggaaatggggccaactttgggtgcttgtgcgatccaaacggaatgtacttgccccggaagggcctttggcaaaaaaaaatactttttggccaaaaaaaggaaaaaaattggcgcacc

SEQ ID NO: 86496 - DNA, 947 bp, Zea mays
  misc_feature: Ceres CLONE 1572920
  misc_feature: Encodes the peptide sequence at SEQ ID NO. 86497
  misc_feature (891)..(891): n is a, c, t, g, unknown, or other
ccgcggtggcggccgctctagaactagtggatcccccgggctgcaggaattcgtctcacccctagaaaaaaaaaccagagcgaggccgcactgcccgcgagtcctccactctgaccgcacgatggctgcgctgcgcctcgcctccttcaccctccgccccgccgctgcctcggcctccgcctcctccggcgcgaccccagccgcgtccggctccgtctccgtctccttcgcccgcgcggcgcgggggctgccctccctccgcctggccccgccccgccgccgcggggacctcgccaggccccgcgccgcggccgaggccgcggcggagagctacgcgtccgcgctgtcggaggtggccgtcgagaacggcaccctcgagcagacggtctccgacctggagaagctggagaaggtcttcgcggacgaggccgtcgccgagttcttcgacaaccccaccgtcccgcgcgaggagaaggccgagctcatcgacgagatcgccaggtcgtccgagctgcagccgcacgtcgtcaacttcctcaacgtcgtcgtcgacaacttccgcgcggccatcgtgccgcagatcgtcgccgagttcgagaacgtctacaactcgctcacgggcaccgaggtcgccaccgtcacctccgtcgtgcaactcgagtcgcaggacctggcgcagatcgcgcagcacgtccagaagatgaccggcgcccagaacgtccgcatcaagacgcagctcgacccggagctcatcgccggcttcaccgtgcagtacggccgcgacggctccagcttaatcgacatgagcgtccggaagcagatcgaggagatcgcgtccgagttcgagtgccccgcgtcccgctctagtctgaccggcctgaagcgtcattntcgcccatgaagtgctttggagcttctgctgcactctccatgctcttatctgtaca

SEQ ID NO: 86497 - protein, 259 aa, Zea mays
  misc_feature: Ceres CLONE 1572920
  misc_feature (67)..(241): Pfam Name: OSCP Pfam Description: ATP synthase delta (OSCP) subunit
  misc_feature: SWISSPROT Homolog: EC 3.6.3.14 H(+)-transporting two-sector ATPase
  misc_feature (257)..(257): Xaa is any aa, unknown, or other
MAALRLASFTLRPAAASASASSGATPAASGSVSVSFARAARGLPSLRLAPPRRRGDLARPRAAAEAAAESYASALSEVAVENGTLEQTVSDLEKLEKVFADEAVAEFFDNPTVPREEKAELIDEIARSSELQPHVVNFLNVVVDNFRAAIVPQIVAEFENVYNSLTGTEVATVTSVVQLESQDLAQIAQHVQKMTGAQNVRIKTQLDPELIAGFTVQYGRDGSSLIDMSVRKQIEEIASEFECPASRSSLTGLKRHXRP

SEQ ID NO: 86498 - DNA, 901 bp, Zea mays
  misc_feature: Ceres CLONE 1572921
  misc_feature: Encodes the peptide sequence at SEQ ID NO. 86499
  misc_feature (815)..(815): n is a, c, t, g, unknown, or other
ctggagctccccgcggtggcggccgctctagaactagtggatcccccgggctgcaggaattcgtctcacccctagaaaaaccgtcgtcgtctagctcccatccgacctcctgcattccccactagtcccaactcccaaccaccgccagccgtccgctctccgcaagcgcgaccttccggacagatccgccccgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacagtgatcgtgcgaggtggggacaccatcagtgctctgtctggggttcggtctgttctttggctgcagatctggaagggtttcgtgggatccgtcactacgatctgtcccagtcagagcatctgcatcatctcgggttgggccatggagactctgctcatctcggaggagcgcaaccaccagctccaccacttctcgggtcgccgtaagaaggcgttagcagcgtcgcctcagtccacgcgcagctaccatgcaggcaactgccgggcgttccactccggcatcacggtcggcatcctgccgtccccgcccgcgcagagggttgcactgacccgctcctcgtctgaggccagacaccgaaacatcagcttcaccatgggaaaaagcgcagccgagcaatctctatgaacctttcgacgtcccctcctctgcgcctgagctctgggctggccggggttctgcatttagcgacatccagntccgtcacgatcccaggtctcactccacagtagcgcagggctcactagaattcacctgctgagcggtagagacaaaaagggccgtg

SEQ ID NO: 86499 - protein, 87 aa, Zea mays
  misc_feature: Ceres CLONE 1572921
METLLISEERNHQLHHFSGRRKKALAASPQSTRSYHAGNCRAFHSGITVGILPSPPAQRVALTRSSSEARHRNISFTMGKSAAEQSL

SEQ ID NO: 86500 - DNA, 948 bp, Zea mays
  misc_feature: Ceres CLONE 1572922
  misc_feature: Encodes the peptide sequence at SEQ ID NO. 86501
  misc_feature (912)..(912): n is a, c, t, g, unknown, or other
  misc_feature (913)..(913): n is a, c, t, g, unknown, or other
  misc_feature (933)..(933): n is a, c, t, g, unknown, or other
ctccccgcggtggcggccgctctagaactagtggatcccccgggctgcaggaattcgtctcacccctagaaaaactaatcaagctggaggaaccagaataaaaccttattctcaaacaccagatgttgacagtgctactagtggtactcagcctgctgcaaaacttgattccatatcagcaatgcctgagtacaaagagaagagtcatgaagaattgaggtgggaagactaccagcgtggagacaagggtggaccgaacacttctggaactcaaacattggcacctagctttccatcaccaatacaacataacacttttgcttcgacaagtaatccattctcaacgaacccattttcaacaaacaacccgtttgctcctaagcccactacaactactacttcaccattcaacacctcatttaacaatgcatcagttgcaagttcgagtctattcacatcatcccctggtaccacaatgtttgggcaaccaggtgtttctacacttccagctccagcaagtaattcaccatcattatttggaaaatcaatcctgctcctgctacatcgtcaatatttgccacgtcagtgacgaataatcaagtccattcggcactggaacatcattggctacactcaatcagcccgctattttcctcaacatttgctcaacgacatctagtaaccgcatttctcctctgggagcctatttggctcaactaaacttggcaggctgtttaccaacacggtcccttccttttttaaaacaacatttcaacctcttcccctgctcgaaattgaacatgttttctttcaacacccatttaacaacaccttctcccggggactccctttttccccaaaaaaaagggcctgagggggacgcaattttagagcggtcattgtggtcctgcnnccggatcttgtgtagaaccnttggggagggacagg

SEQ ID NO: 86501 - protein, 135 aa, Zea mays
  misc_feature: Ceres CLONE 1572922
MPEYKEKSHEELRWEDYQRGDKGGPNTSGTQTLAPSFPSPIQHNTFASTSNPFSTNPFSTNNPFAPKPTTTTTSPFNTSFNNASVASSSLFTSSPGTTMFGQPGVSTLPAPASNSPSLFGKSILLLLHRQYLPRQ

SEQ ID NO: 86502 - DNA, 964 bp, Zea mays
  misc_feature: Ceres CLONE 1572924
  misc_feature: SWISSPROT Homolog: EC 1.14.14.1 Unspecific monooxygenase
  misc_feature (586)..(586): n is a, c, t, g, unknown, or other
  misc_feature (823)..(823): n is a, c, t, g, unknown, or other
  misc_feature (837)..(837): n is a, c, t, g, unknown, or other
  misc_feature (838)..(838): n is a, c, t, g, unknown, or other
ctccccgcggtggcggccgctctagaactagtggatcccccgggctgcaggaattcgtctcacccctagaaaaagcccctctggctcttgcattcaatggagctgggctttggatcatgagcggagcacatgggagaaaaccagcgcagcacaagtccaaagaccgaacttcttgatctggttcgggccgacgccgcgcctgacggtggcggagccggagctggtgcgcgagatcttcctgacgcgcgcggaggcgttcgaccgctacgaggcgcacccggtggtgcgccagctcgagggcgacggcctcgtcagcctccacggcgacaagtgggcgctccaccgccgcgtcctcgccgacgccttctacccggacaacctcttacggctggtgccccacgtcggccggtcggtggcggctctggcggagaagtggcgcgccatggcgtccgcctcctcgagcggcgaggtggtaggtggaacgtcgcggagtggttccaggcggtctacgggatgatgccatcacgtcgcgccaccttcggccgcagctacgacgacgtgccgcgtcgtgttcgccatgcatgtnccgcctgatggcctacgccctcgagtccttccgcatgggtctggtccccttgctaccggttcttttgccaccagaagaactggcagtcgtgggagctggacagggagatacggcggaagcctgacctgtctcatcgcccggcgcatcgactaggccttaggcctaggaagaagtaaatgggcatccacttcccgcgggtttccgcgacttttctcggcgccatgatcaatgcctgcnaatagtataatccnnccggcggggggcgaccccgggggcgaaaatgctggaggaatgcaaaacgtcttcttcgcccggaaagaaaaaacaactacctccgtggccggggccccggccccttggccatgccccggattgcag

SEQ ID NO: 86503 - DNA, 998 bp, Zea mays
  misc_feature: Ceres CLONE 1572925
  misc_feature: Encodes the peptide sequence at SEQ ID NO. 86504
ggagctccccgcggtggcggccgctctagaactagtggatcccccgggctgcaggaattcgtctcacccctagaaaaagcccctctggctcttgcattcaatggagctgggctttggatcatgagcggagcacatgggagaaaaccagcgcagcacaagtccaaagaccgaacttcttgatctggttcgggccgacgccgcgcctgacggtggcggagccggagctggtgcgcgagatcttcctgacgcgcgcggaggcgttcgaccgctacgaggcgcacccggtggtgcgccagctcgagggcgacggcctcgtcagcctccacggcgactagtgggcgctccaccgccgcgtcctcgccgacgccttctacccggacaacctcaaacgggtggcgccccacgtcggccggtcggtggcggctctggcccacaagtggcgcgccatggcgtccgcctcctctagcggcgaggtggaggtggacatcccggagtggttccaggcggtcacggaggaagccatcacgcgcgccaccttcggccgcggctacaacgacggccgcgtcgggttcgccctgcagggcccgcctggatgggctaaggcctccgaagcccttccgcaaggttccttggtcctccgggcttaccggtttctttgcccccccaaagaaagaacctggcacatcctggaaaagccgggacaggggaaaaaccgggcggaaaccctgaacccggtttcatctccccgggggcatcctacaagagcccagagcccaaagaaggaagaaaattggccctccccccccggggggggttcgcggaaccttcccggggcccagtataatatgccggggcaaaaagaaaaacccccccgcggggggggcgatcccgggggggggaaacagccggtagaaataacaaaacctcttcttccccccggaaaaaaaaacaacataacccctcggcgcgggtgcaccggtctcctgggcatgtaaccg

SEQ ID NO: 86504 - protein, 182 aa, Zea mays
  misc_feature: Ceres CLONE 1572925
MASASSSGEVEVDIPEWFQAVTEEAITRATFGRGYNDGRVGFALQGPPGWAKASEALPQGSLVLRAYRFLCPPKERTWHILEKPGQGKNRAETLNPVSSPRGHPTRAQSPKKEENWPSPPGGGSRNLPGAQYNMPGQKEKPPRGGGDPGGGKQPVEITKPLLPPGKKNNITPRRGCTGLLGM

SEQ ID NO: 86505 - DNA, 956 bp, Zea mays
  misc_feature: Ceres CLONE 1572926
  misc_feature: Encodes the peptide sequence at SEQ ID NO. 86506
  misc_feature (833)..(833): n is a, c, t, g, unknown, or other
ctccccgcggtggcggccgctctagaactagtggatcccccgggctgcaggaattcgtctcacccctagaaaaaacctcgtggactccttccccacaaaactaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcggctgcgccggcaccttctgctccggccctcccacctccgcctccgcgcgccccactccatcgccgacctctcccgctcctccaattccgccccgagcccggcccgcccagcgctgggctccggcccggagaacggcagcggcggcgtccgcgcggtggagaaggacccgatcaagctgtgggagcgctacgtcgagtggctctaccagcacaaggagctcggcatcttcgtcgacgtcagccggatggggttcacggaggagttcctgcggcagatggagccgcggatgcagcaggccttcgtcgacatgcgggagctcgagaagggcgccatcgccaaccccgacgagggtcgcatggtgggccactactggctccgcgacccggccctcgctcccaactccttcctccggaacaagatcgagaccgcactcgacaaaatcctcgccttctccaagatgtcatctctggaaagatctttccccatctggtcgtttcacttcattctctctataggaatcggagggtcagctttgggccctcaatttgtttgcgaagcacttgcacctgattacccntcactgaagaatagatttattgacaaacagatcctgctggggatgatcatcaaattgctcaactaggacctggactggcaacaacccctggtattggcatttccaagagcggtaggcacccgt

SEQ ID NO: 86506 - protein, 232 aa, Zea mays
  misc_feature: Ceres CLONE 1572926
  misc_feature: SWISSPROT Homolog: EC 5.3.1.9 Glucose-6-phosphate isomerase
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDKILAFSKMSSLERSFPIWSFHFILSIGIGGSALGPQFVCEALAPDYPSLKNRFIDKQILLGMIIKLLN

SEQ ID NO: 86507 - DNA, 945 bp, Zea mays
  misc_feature: Ceres CLONE 1572927
  misc_feature: Encodes the peptide sequence at SEQ ID NO. 86508
ctccccgcggtggcggccgctctagaactagtggatcccccgggctgcaggaattcgtctcacccctagaaaaagcctcaccggactcacctccgccgctcataagccctagatgtccacgctctcctgcccccgacgcgccggcgacgcccgcgccgcgggtcgatcccaccatatctcgctcgaatcagaggccccgctactgcccgtggcccgattctccgcgcgcgcgactagtaacgggggtgatttgatccggttttggaggtgaggcgggggtgggatttccgtggtcctgtgccttgccgggcctggtggatggaatgctgcggatctgccgtttccagcccagagtggagttcgggaagatcctgggctccggacctgatatgggacagcgtggatgtccgcgcggtggagaatgaccccatcaagctgtggcgagcgctacgtcgagtggctctaccagcacaaggagctcggcatcttcgtcgacgtcagccggatggggttcacggaggagttcctgcggcagatggagccgcggatgcagcaggccttcgtcgacatgcgggagctcgagaaaggcgccatcgccaaccccgacgagggtcgcatggtggggcactactggctccgcgacccggcctcgctcccaattccttctccggaaacagaacgagaccgcactcgacaaaatcctcgccttctccaagatgtcatctctggaaaattctttcccatctgggcgtttcctttcattctctcataggaatcggagggccagtttggggccctcaattgttggccaagaacttggacctgaaaaccctccccggaaaaaaaattttttaaaaaccaaatccgggggggattgacctcaaatgggccaactggacttaacggggaacacccttggaaatggcattcccaaaacgggaggca

SEQ ID NO: 86508 - protein, 122 aa, Zea mays
  misc_feature: Ceres CLONE 1572927
  misc_feature: SWISSPROT Homolog: EC 5.3.1.9 Glucose-6-phosphate isomerase
MSARWRMTPSSCGERYVEWLYQHKELGIFVDVSRMGFTEEFLRQMEPRMQQAFVDMRELEKGAIANPDEGRMVGHYWLRDPASLPIPSPETERDRTRQNPRLLQDVISGKFFPIWAFPFILS

SEQ ID NO: 86509 - DNA, 802 bp, Zea mays
  misc_feature: Ceres CLONE 1572931
ctccccgcggtggcggccgctctagaactagtggatcccccgggctgcaggaattcgtctcacccctagaaaaaacacacccaattcctcgcaactgggctcccccgcctccacgaaccacgacactgccccccgcctcaagttcgccgtctccattcctcagctctcctctcctctgtagtctgcctgtacctattggctgaagcagagctgacccccactttatcaagagttgctcaacaatggacactggctgcctgtcatctatgaatattactggagctagccaggcaagatgttcttgcggaggcaacttcactctcagagatgttttgcgagtagtcactatacaggctttgccgtgaaaaaacttgcctcgaggaattaaggaaagaagatcaccccggagaaaaccccggccttgaaaggtggcctggcaaaggatttttccaaaaaccccccccccaaaaaagccccaagaaaaccttttttggaaaaaccggggaaaacccccccccttctttttttttaaaaaaaaaagaaaaaaaccccccccaaaaaaccccttttaaaaaaatctgggggttcccctgtggccaaaaaaaatagggggggggggtctaaaaacccccagaaaaatatttcggggaaaaaaaatggcgcccccaaaaaaaaaacaccaatttatttttttttggagaaaaaaaaaaaaaaaataattttttttttgggaagaaaaaaaaaaaaaacacccccccctttgagggggggggggaaaaaaaaaaagagtaagaagtggttt

SEQ ID NO: 86510 - DNA, 929 bp, Zea mays
  misc_feature: Ceres CLONE 1572932
acccgcggtggcggccgctctagaactagtggatcccccgggctgcaggaattcgtctcacccctagaaaaagtatcctctcctcagttgcttcgacgtatttctctctctatctatacggttccgaagaaggtagagagagaaactcgaaggggagaggacagaagagggagatacaggtacactgctcctgacccctcctcgattggtcagttctgttcttgagcgcactgccaccacagattggacggcttgtctgctctccgttcccggagtggcgtcgtgctcactctgctgggttgctttgccttatagtcttgctctgcggtttgatttgcttcatcttttttttttcttcaatcttgtcactcctaaggtttcccccctctggttttcttgattccccgcttgggaatttgtgaagtttaacaggattttttttggctgagttcgcatgtttctgttcttggccatgcccatgctatgcttgcttggataaagcttgggctcagcctagctcgcattgcacgatgcgttgttcctagaatccgatcgcaactcctatgagctgaccactatttcgtggattgcccggggcgtgggctgttgatggtttcggcagtttgggtgggtgggaaatctgcatcccttttctattctagctaggattagatggcttgaattcaatttgggtagactcggatgattatactgtctgataaacgtcatcttgaaggtgccgaattgcatgtaagacttccgaagagtggcgagtcaggcgtatcatggccttaacttgttgataccagctaaaatttgctgaacatccttccggggagacctgaaactgaactgccaaattaggtgtataaaggctgatccctctggtaaacaaaggtccctttaggtttccaggccaacctctgaag

SEQ ID NO: 86511 - DNA, 954 bp, Zea mays
  misc_feature: Ceres CLONE 1572933
  misc_feature: Encodes the peptide sequence at SEQ ID NO. 86512
  misc_feature (804)..(804): n is a, c, t, g, unknown, or other
  misc_feature (810)..(810): n is a, c, t, g, unknown, or other
  misc_feature (932)..(932): n is a, c, t, g, unknown, or other
acccgcggtggcggccgctctagaactagtggatcccccgggctgcaggaattcgtctcacccctagaaaaaatctagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacggcggcggcttcgatgactactactgggacgacgacttccatttccacgacgacggcttctccgcctcccctacgacccccggcagcggtggtgcgccccgccagcagcagcagatgggtgatatttcagcctcggactacaaagaaggcgaagacatgcaggggataccctgggaaagactcaactacaccagggaccagtatcgtcggatgaggctcaaagagtacaagagctaccagaacctcacgaggtcgcacagcgggctacaacaacaggaatgcaaacaggtggagaggaaggacacattctacgagttccatctgaacacgagagccgtcaagtcaacgatagtgcatttccaggtaaacaacaagcagtggcaggacgtttgggtgtgcgctatctgcagttagtcttgagtgatactagctgcaatttaatcagatcgatcaggtggatgggcatcctcagcagccgggaagagtgactccagcaggggggtggaaaagcttgcatatggtatggcagggacgttcgagatggacgaaatctgtgaaacggntcaccntgagtcctcattttttttgcaggtcatttgctgcatgtcatttgtggcacgccttttcgtgttatggaaatgtgctcaacccatgctgtccgttgaaagtttttatgggggttatatatcgnccaagggtgggtcctttgatgg

SEQ ID NO: 86512 - protein, 152 aa, Zea mays
  misc_feature: Ceres CLONE 1572933
MAHDLCEDLELVADDGGGFDDYYWDDDFHFHDDGFSASPTTPGSGGAPRQQQQMGDISASDYKEGEDMQGIPWERLNYTRDQYRRMRLKEYKSYQNLTRSHSGLQQQECKQVERKDTFYEFHLNTRAVKSTIVHFQVNNKQWQDVWVCAICS

SEQ ID NO: 86513 - DNA, 936 bp, Zea mays
  misc_feature: Ceres CLONE 1572935
  misc_feature: Encodes the peptide sequence at SEQ ID NO. 86514
  misc_feature (574)..(574): n is a, c, t, g, unknown, or other
  misc_feature (578)..(578): n is a, c, t, g, unknown, or other
  misc_feature (707)..(707): n is a, c, t, g, unknown, or other
  misc_feature (801)..(801): n is a, c, t, g, unknown, or other
aagctggagctccccgcggtggcggccgctctagaactagtggatcccccgggctgcaggaattcgtctcacccctagaaaaagactcttctcttctccccatcagccagcagtctctctctctctcacacacacaagcagcgacttgctcacagtagtgctccccggacagaatgaccaaagacgaggagttcaagctggtcaagatccagaaccatgcgctgaaggtgaacatacactgcgacgggtgcaagcacaaggtcaagaagcttcttcagaagatcgaaggcgtgtactcggtggccattgatgtggacaaccacaaggtctcggtgacgggcgatgtggactcggagaccctgatcaggaagctcaccaggggcggcaagcacgcggagctgtggtcgcagcccaagggcggcggcaaccagggccacaagggcaataatggccagcagcagaaacagcagcagccgcagaaccagaaccagaaccaccagcagaagcagaagcaaggtgccaatctcagcaaggatgggcacaacaagaacagcaacggcggccagaaggacangggnaatcaatgaggaagaatgagggggctgggggcctcatgcagggcctcaagggcgtcaagaacagcacgggcaacagcaccagctccctgagctcagctcggacgacgatgacctgtttgacgacgacgnaccaagaagagtttgacgacgacctacgagggaggacctccgcttccctcgggaaaagatgagccagttcggggtccccggcaaacacaagacnagaacggaacaaccctgctttcaacgttacccccccccgaaatggcaaaagggtaccgggggggggggagccaaaattttccaaaaaaaccccccccccccccaaacccgaaaacgtaaaggtgttaatgggggc

SEQ ID NO: 86514 - protein, 137 aa, Zea mays
  misc_feature: Ceres CLONE 1572935
  misc_feature (16)..(76): Pfam Name: HMA Pfam Description: Heavy-metal-associated domain
  misc_feature (134)..(134): Xaa is any aa, unknown, or other
MTKDEEFKLVKIQNHALKVNIHCDGCKHKVKKLLQKIEGVYSVAIDVDNHKVSVTGDVDSETLIRKLTRGGKHAELWSQPKGGGNQGHKGNNGQQQKQQQPQNQNQNHQQKQKQGANLSKDGHNKNSNGGQKDXGNQ

SEQ ID NO: 86515 - DNA, 825 bp, Zea mays
  misc_feature: Ceres CLONE 1572937
  misc_feature (271)..(271): n is a, c, t, g, unknown, or other
  misc_feature (291)..(291): n is a, c, t, g, unknown, or other
  misc_feature (496)..(496): n is a, c, t, g, unknown, or other
  misc_feature (497)..(497): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (546)..(546): n is a, c, t, g, unknown, or other
  misc_feature (563)..(563): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (610)..(610): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (713)..(713): n is a, c, t, g, unknown, or other
  misc_feature (720)..(720): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (752)..(752): n is a, c, t, g, unknown, or other
  misc_feature (753)..(753): n is a, c, t, g, unknown, or other
  misc_feature (755)..(755): n is a, c, t, g, unknown, or other
  misc_feature (756)..(756): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (793)..(793): n is a, c, t, g, unknown, or other
  misc_feature (795)..(795): n is a, c, t, g, unknown, or other
  misc_feature (800)..(800): n is a, c, t, g, unknown, or other
  misc_feature (824)..(824): n is a, c, t, g, unknown, or other
ctggagctccccgcggtggcggccgctctagaactagtggatcccccgggctgcaggaattcgtctcacccctagaaaaaaaaaaaaaaaaaaaaaaaaaaaaaaaaaaacgcgctcaattccactgccaagattcgccactccgtccgttaccttcactcgctcactcacaatgcggcgccatggcgaggtacgcgtgatctttgctatggccgccgccgccgccgccgcgctcttggcgtcggcggccgtggccggaacgaagaaacgnggccggcagaacctacatcngtcccacatggtccccattccgcccatgccggaaacgagttcccggagcatgagggaaaatgggtccccccccggttcccttctttaggggggggtttcataaaaaccccccccccccccgggggttttgttaaccccccctctgagggggcccccccctcctccccctcccagaggggggggtttttcttctgcgggggccggnnggggttttaaaaaaaaaaannngcgccccccggagaaagaggagcgcgnccccgcgtaagtataanacacaccccccccccccggggggggggttattattacctcctnnntnccccccccccccccccggggggggggggggggggggnnnacaggggggggggggaggagaaatataaggggggggagtnnnnnnnnnnttggggggttagcancaggggnccnnnnnnnnnnnnnnnnnnnnnnnnnnnncnncnntttnnnnnnnnnggggggggggggggggggggggggngngcgcnacagggagggagaagagaaaaaang

SEQ ID NO: 86516 - DNA, 870 bp, Zea mays
  misc_feature: Ceres CLONE 1572946
  misc_feature: Encodes the peptide sequence at SEQ ID NO. 86517
caaagctggagctccccgcggtggcggccgctctagaactagtggatcccccgggctgcaggaattcgtctcacccctagaaaaagtcctcctcttcgcattagcgcggccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaaagacccggcttggccaaggtgtactccgtcgcctccaacaacgtcaccaactgggaagggacgtggctacatcacggccgcttcatcggcgcccttctttccccgacgcgtacatgggggagggtttcttggaaccatcgcccatcttcatgaatcattccacatttttccggtctgggggcttgctgaagaatggcgcgtcctccggtgtaaaggggccttgttggcctaccgttcgttgcggggggaacaaggaacttgtggcccccccccgaacgggaaccccccataacggccgggtggggggtttcccgtgggcgcatttttaacctcccaatccccgtctggggggaccggggggcgggggaattcaaaccccg

SEQ ID NO: 86517 - protein, 154 aa, Zea mays
  misc_feature: Ceres CLONE 1572946
MGEVEDMYTQDGTVDMKGNPAVKKGTGNWRACPYILANECCERLAYYGMSTNLVNYMKDPAWPRCTPSPPTTSPTGKGRGYITAASSAPFFPRRVHGGGFLGTIAHLHESFHIFPVWGLAEEWRVLRCKGALLAYRSLRGEQGTCGPPPNGNPP

SEQ ID NO: 86518 - DNA, 822 bp, Zea mays
  misc_feature: Ceres CLONE 1572949
  misc_feature (268)..(268): n is a, c, t, g, unknown, or other
  misc_feature (269)..(269): n is a, c, t, g, unknown, or other
  misc_feature (273)..(273): n is a, c, t, g, unknown, or other
ctggagctcaccgcggtggcggccgctctagaactagtggatcccccgggctgcaggaattcgtctcacccctagaaaaaaaccaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggtgggggccaggggcggcnncccnaggtgacggcgccgcaggaacccacattgccagccaccggctccggcgctaccggcgcagcggcggtcggagtcaactccaactccgtgctggtgggcgctgctggattcgcactacacggaactggcggaactggtggagaaagcgctgctcccggcgacgcttggaagaaccccgtcggggaacacaaagtcaccattttttgcgcccccggaaacaaggcgcttgaaccgggacctggaacccggaggttcaaccgctttccgggttggaaccccgccaaacctcaggtgtcctgcaaggggcctgttttttcttaacaaggtgttttccccttggggggctgggccctccaaaatactgggggcccggggggtcccccccccccactttttccgggggaagaaggggccaaaattttccccccccccccccggggggccggggttgtgggcttttgggcaaacaccgccccttattcagccccccgggaaacccctgggtttcagggccccaaaggggggggtttccccccgggggttcgggggg

SEQ ID NO: 86519 - DNA, 793 bp, Zea mays
  misc_feature: Ceres CLONE 1572951
  misc_feature: Encodes the peptide sequence at SEQ ID NO. 86520
catagctggagctccccgcggtggcggccgctctagaactagtggatcccccgggctgcaggaattcgtctcacccctagaaaaaaccctaccactccgaccgacgacgacgagcgagcgcagcccaagcccaagcaagcagggcagcacggccatgcccgtggcgcaatcctaggcgcccatttcgtattccacggccggcgaagcagcagcagcagcagcagcagccatggtggccggcagggtcaaggcggccatgggcttccagcggagcccggccacgcccaagcccggggcctcctcctcctcctcctcgcgcaaggcgccgccgccgccgctgcagctgcccgggtcggccgcgctgccggagacgccgcgccggaggtcctcgggctctccggcgccgccaggctccgggtccaagggcggcggcccattctcgcgctacttcccgcggtcgtccgcacaggtgcagccggcgcgcgcgtcgggccagcccgagccgccgccgctgccgtcgtgcccgggccccgccgctgccgacctcgcccgcctcgtcgaggagctccgggagcgcgagtcccgcctccgcaccgagctgctggagcacaagatcctcaaggagaccgtcgccatcgtgccgttcctcgagaccgagctcgccgccaagagcagcgacctcggccgctgccgcgacgcgctgtcgcgcctcgaggccgagaacgcaagcctccgcgccgagctcgacgccgccaggggcagccagcagcgcgttgttggagctgggagaaga

SEQ ID NO: 86520 - protein, 188 aa, Zea mays
  misc_feature: Ceres CLONE 1572951
MVAGRVKAAMGFQRSPATPKPGASSSSSSRKAPPPPLQLPGSAALPETPRRRSSGSPAPPGSGSKGGGPFSRYFPRSSAQVQPARASGQPEPPPLPSCPGPAAADLARLVEELRERESRLRTELLEHKILKETVAIVPFLETELAAKSSDLGRCRDALSRLEAENASLRAELDAARGSQQRVVGAGRR

SEQ ID NO: 86521 - DNA, 784 bp, Zea mays
  misc_feature: Ceres CLONE 1572952
  misc_feature: Encodes the peptide sequence at SEQ ID NO. 86522
  misc_feature (642)..(642): n is a, c, t, g, unknown, or other
aaagctggagctcaccgcggtggcggccgctctagaactagtggatcccccgggctgcaggaattcgtctcacccctagaaaaagtccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaggggcggcgtccacacaaccggaggggaggggggcaatggcggccgtggcaggcccactctgcacgtggctcgtcgccgcgtgcttatctgcggcatgcgacgctgaagagcacaagcagaagcatttctgcgcaggcggaagccgcgctgggggcggtgtcatgctcggccagcgccgccgcctcggcgcgcggcgtcgcggcttggcgcgctctggaatgactatggctngtgcccttacagctgaaagaagtgtcattggaaaagagaaacccgatatcaaacaaagggagggtgggtgtcactgggcatgggtggtagtgacacccattggggcatggatctggaagtgtttttacaacaaatccttctt

SEQ ID NO: 86522 - protein, 112 aa, Zea mays
  misc_feature: Ceres CLONE 1572952
  misc_feature (66)..(66): Xaa is any aa, unknown, or other
MAAVAGPLCTWLVAACLSAACDAEEHKQKHFCAGGSRAGGGVMLGQRRRLGARRRGLARSGMTMAXALTAERSVIGKEKPDIKQREGGCHWAWVVVTPIGAWIWKCFYNKSF

SEQ ID NO: 86523 - DNA, 756 bp, Zea mays
  misc_feature: Ceres CLONE 1572955
aaactggagctcaccgcggtggcggccgctctagactagtggatcccccgggctgcaggaattcgtctcacccctagaaaaacattgcatagcatgggcagcacttccacaccacaccacaccacacctcggctgggcctgggatgggggttgggcagggagccccctccttcctttttttcccctccctcaaaaaagcacacccacacactcttcttcgttccttgaccgagtaaatcctctctcctcctcccgactctcaattgcttcaagcttcatgctttgtcggccccggcccgcccccctatggctcagctcagctcagccaactgctggagtggtagtggttgcttcctctctcttctcacgtcaccatgatcgataagactagctagaatataggtggctggcagtggcagtggcagcgctatcctatatagtgccccccggccggtgtgctcgcctcgggagctagccttggaagaagaagcagagagcagagacaccgttgcgtagaaggaagaggagtgcttcttcgttcgtcgttgcccaaagcagcagcagtcacttgggaattggaccagagcggcgccgagcgctgccggccggccgggccgacctctgtttgtagcggcggcagcaccagctctcaactgctcaagcaaaacaatttaagcagccagcagtctgtcacacacacaggcggaaacggaccgggcaatgtattcttcgttccccggcctggggataacccct

SEQ ID NO: 86524 - DNA, 736 bp, Zea mays
  misc_feature: Ceres CLONE 1572956
  misc_feature: Encodes the peptide sequence at SEQ ID NO. 86525
  misc_feature (668)..(668): n is a, c, t, g, unknown, or other
ctggagctccccgcggtggcggccgctctagaactagtggatcccccgggctgcaggaattcgtctcacccctagaaaaaccagcaaaactcaccgctgcagcgacctaccagacctcgtcctcgctcccgccgcacggccgccaaccatggccttcaccgctaaaccctactgctccaccaccgccaaaccttccacacccaccgcccatcgctcgccatcccctccatctccgtccgtgccgccggcaagccgtcccccagtgttgttagcctctgcgcgctggaccagtgcatccgggagcagcaatagcctccgcgacgatggtccgacatgcgcttcttcgacaccacattgtgcgacgggaagtagttgccgagcgccactatgacaagcaccgagaagctcatccacgcgcgccagctagcccgcctcggcgtcgatgtcatcgaggtcgggttctcggtctcctcctccaacgaacttgacacagtgtgctccatcttcatcgaggtcggcaacccgccgggggcaacagcacccacgtgcccgtcatctgcgacctctcacggtgcaacaggagggataccgaagatgcatgggaggccggaaggcctgatgcgctccagtgaggtgtgggcgtctccggcggcctgatttgtacgaangcgagggcgtatcgggggctgggggacacgaaaagccaagccgcacagggacgtacggacagtaagct

SEQ ID NO: 86525 - protein, 89 aa, Zea mays
  misc_feature: Ceres CLONE 1572956
  misc_feature: SWISSPROT Homolog: EC 2.3.3.13 2-isopropylmalate synthase
MTSTEKLIHARQLARLGVDVIEVGFSVSSSNELDTVCSIFIEVGNPPGATAPTCPSSATSHGATGGIPKMHGRPEGLMRSSEVWASPAA

SEQ ID NO: 86526 - DNA, 787 bp, Zea mays
  misc_feature: Ceres CLONE 1572957
  misc_feature: Translation starting site: 250
ctggagctccccgcggtggcggccgctctagaactagtggatcccccgggctgcaggaattcgtctcacccctagaaaactctctgcaggctgcacatcctccctctcggacacaaccgggaagccaaacccgagcgtcctgagttcctgaccaaacaatcccagtactgcgattcgctcgggatcgtctgcaggccccaccggccgatccatccccccgtaaaccgtaaccttccgccgatcgcttcaatggccgtggcctcggccgcgcggacggcaacaccggcgtcgccggcgcgactggggtcgctgtggtcgacgctggaggaccagcgcggggcggcggtgccgctgctctcctcggcctggaccctgccgacgacctcccagggcggcatcgccggggacggggagcagctgcccaaggagggcctgctccggcgggctggcggcgttgttgcccgctggtggggggcggcgtgcggcgcggtggcggaactgtgggccttcgcgcggggccgatccgcggaagcccgtgttcgcgggggaggttgcgctcgcgctcgccctcatctcgctgctcgtcttcctccgggagccgcgcgacatcgtcagccactccgtctgggcaaatctcaacgtcgtcgtcgtcttcgaagtcagcatcgggtgcaccttaaagcaaaagggtttaattcggggattgggggaccctaaaccccaggaacctttttgctccaagtaagttgcaagatttgtcccaaacaccctgggaaaaactgggaag

SEQ ID NO: 86527 - DNA, 793 bp, Zea mays
  misc_feature: Ceres CLONE 1572958
  misc_feature: Encodes the peptide sequence at SEQ ID NO. 86528
  misc_feature (503)..(503): n is a, c, t, g, unknown, or other
  misc_feature (535)..(535): n is a, c, t, g, unknown, or other
ctggagctcaccgcggtggcggccgctctagaactagtggatcccccgggctgcaggaattcgtctcacccctagaaaaaaccgcatctccctcccattccactccagtccaccaccgctcccattccccagccgccgtcgccatggccagcgccgcccactcccttctgcacacaccggaggcccacagggccgccacccgctcgcccttctctcctcccgcgcccactcccttcctccatctccgccctcaccgcctccccctccgcctccgctccacctccccgaccgcctccgacctcaccgccttccccccgaacccgaacgggatctttgcgtccgaccggcccatcgacgtggacgccgccacggaggccgagctgcgggagaacgggttccggagcacgcgccgcaccaagctcgtctgcaccgtgggccccgccacctcgcgcccggaacagctcgaggcgctcgccgtcggcgggatgaacgtggcccggctncacatgtgccacggcgacagggagtggcatanggccgccatccgcgccgtcaggagcctcaacgaggagaatggcttcgccgtcgccgtcatgatggacaccgagggcagcgagatccacatggggggacctcggcgggcgcatcctcggtcaaggcgggaagatggagaaatatgggaccttccagtggtagaatcatttgaaatggccctctccccaaaacgaaactattaaatggggaactaatgaatggatttgcctgaaaaatgtgaaaaaaattggtggaataa

SEQ ID NO: 86528 - protein, 197 aa, Zea mays
  misc_feature: Ceres CLONE 1572958
  misc_feature: SWISSPROT Homolog: EC 2.7.1.40 Pyruvate kinase
  misc_feature (131)..(131): Xaa is any aa, unknown, or other
MASAAHSLLHTPEAHRAATRSPFSPPAPTPFLHLRPHRLPLRLRSTSPTASDLTAFPPNPNGIFASDRPIDVDAATEAELRENGFRSTRRTKLVCTVGPATSRPEQLEALAVGGMNVARLHMCHGDREWHXAAIRAVRSLNEENGFAVAVMMDTEGSEIHMGGPRRAHPRSRREDGEIWDLPVVESFEMALSPKRNY

SEQ ID NO: 86529 - DNA, 790 bp, Zea mays
  misc_feature: Ceres CLONE 1572959
tggagctccccgcggtggcggccgctctagaactagtggatcccccgggctgcaggaattcgtctcacccctagaaaaacttcttcctccacatcgatcccctcccccctccactcgtctccaaaatcgccagcgagagccatgccgcctcctcccctgccctcgccgagcctgaccgactgaccccacctcgccactgttctttcccttccacctgggccccacagcgcccccttaccgtcgccaccaaatccccaaatcccggaggcacgaggagggaattcgtcgcctgaccgatcggccgatccactgccgtcggcaccccaatccgccgctgccgccatgttcaacaagatcatcaagaggggaaaccgcaagggcgcgcgcggggacaacgcggaggccgccgcgcgccccgcagcgccctcctcgtcctccgggagcggcggcggcggcgcgggggcagccgcgcccgtcaccgtcaatcacgcctcccgggccacagcgccttcgccgtcctcgcccacttcgccgcacgtggcgccgtctgcgcttgcgaccaccggggggggggggcgggcgtccccgcacttctggaagccgctcccgctccttcgcggaaggtcgccgcccgcggaccggcccgggccctcttccccccgcaaggtcccgcatccgtccccggcgcccctttggacctttcgggaacccgctcaaagcacccccgcgggaagaagggagggcaaaaacgcccagggctctccctcggaaggcccgttcaaaattacgg

SEQ ID NO: 86530 - DNA, 1210 bp, Zea mays
  misc_feature: Ceres CLONE 1572960
  misc_feature (1)..(1): n is a, c, t, g, unknown, or other
  misc_feature (37)..(37): n is a, c, t, g, unknown, or other
  misc_feature (46)..(46): n is a, c, t, g, unknown, or other
  misc_feature (965)..(965): n is a, c, t, g, unknown, or other
  misc_feature (966)..(966): n is a, c, t, g, unknown, or other
nggggttatggggggggggggggtgtggagttaggtntaatgggcnatcgggggggggcggggggatacaaggtgtttttttccaaaaactggaactccccgcggtggcggccgcactcctcacagcggatcccccgggctgtttgatttcctctcacccctagaaaaaaaaacaatagtagaatggcgtagcctttctctatgacacgtgccccttcccccctcttaagctaagggacccttgggcagcccggcatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgccgctcggacgaggacgacgcagcggcccggaacgcgcgccaggcctcccacggccacgctgcggcgacaggggtggctccgccccccgaggcgaccggcggaagcgcggcccccccataaatgccctaaatgaaccgacatcagcccgaggacgggttcaacgacacaaggcataacaaggctcgcctccgaagaccaccccaaatatccccaggctgactttcccttcccgccgttaacatccccgggcccccccgtgtgggccgcgagcactgtaacgggcggtgggagcgcagagcgaggggacacgcgaggcacgtaatagactggcggccccccccgccagaaggagaaaaccacaccccgatcgcggtccacactcgtattcatagctccgtgtgcacgccatatcggcggtcgccgccgttgcggcgctatgtttgcgaaacgtcaaacagaggaaagtatttcatatagaacctctcattggtataataccatacgctataataatgagtctactcgccaaagnncagataaaaatatgtgtgcggagcaaagccggggtgttcacttgtgccccgcctgacccgagttattcctaaggtataccataataggacgctgatgctcgataccgcaggggccgtcaagaccgaagattatagttgcgtaagcataaaaacagacttgacacttgagattaaaaatgatgctaagcaacatcgttgtacgctgaggacgaagtgcaccggcgggcgggaggtatgcgcggta

SEQ ID NO: 86531 - DNA, 810 bp, Zea mays
  misc_feature: Ceres CLONE 1572963
  misc_feature: Encodes the peptide sequence at SEQ ID NO. 86532
aaagctggagctccccgcggtggcggccgctctagaactagtggatcccccgggctgcaggaattcgtctcacccctagaaaaagacaaccgctaaaaccctctatctcctgccaccgcggcggccccttctcttccctgtaataaacccccggcgagcgatgcggcggctggcgaaatccctcctcctcgcctccctctccaggaccctccgccaccgcccccagctcccgctgcttcacccttggcctccccagccccgccgcccggagccctgcctcctccccttctccactcaaaccctagccccgggccctgctcccccgcctgcgcttgttgcggcgtcgacaggcgagccctcaggcctcgcgcttctggagtccgcggagctgcacgagtccgagggggaccaccaggaggccctcggtctcgccctcaaggcgctcgcgccgctgcaggcgtcccacggcgggtggtcgctccccgtcgcgcgcgcgctccgtctcgccggcgccgcggccacccgcgccggcagcctcagagacgggctcgagtccctcggcgctgccgcggatatcgtcgactacctggccaccgcgcggcgcaaggaggtgcctgcagaggtggcggtggtcggcgctgccgtgtacgagcagctggcgcgcgccaaaatggccatcgggcgcccgtgggacgcggtgggcgaaccttcagcgtgcactggaacttgaaaactctgtgcctcggaagcccgggactgctgaccttggggaacgcctacaggggacgtcgtccgtaggccctattgcga

SEQ ID NO: 86532 - protein, 189 aa, Zea mays
  misc_feature: Ceres CLONE 1572963
MRRLAKSLLLASLSRTLRHRPQLPLLHPWPPQPRRPEPCLLPFSTQTLAPGPAPPPALVAASTGEPSGLALLESAELHESEGDHQEALGLALKALAPLQASHGGWSLPVARALRLAGAAATRAGSLRDGLESLGAAADIVDYLATARRKEVPAEVAVVGAAVYEQLARAKMAIGRPWDAVGEPSACTGT

SEQ ID NO: 86533 - DNA, 780 bp, Zea mays
  misc_feature: Ceres CLONE 1572967
  misc_feature: Encodes the peptide sequence at SEQ ID NO. 86534
  misc_feature (715)..(715): n is a, c, t, g, unknown, or other
  misc_feature (742)..(742): n is a, c, t, g, unknown, or other
aaagctggagctccccgcggtggcggccgctctagaactagtggatcccccgggctgcaggaattcgtctcacccctagaaaaaaacacatccatctacgtatgtatacaatattagaattttaagaatggcccgtcgccatacgcatgctgccctaccctaccgctaccggccctgtcattaaatgcctcccaccacgatacgaaccaaccaacgaaccaaacataaattcggcccaccgctcctgctgctggctgctgctgctgcttcgaggacaggacggagggagctcacgcgcgagcaaagcaaagcaaagcacaagcagcaatggggatctgctgcggcaaggccaaggcggcggcaggggagcccgacgacgacgagggcctgggcttcccatggatgcacgacgacctgttccacagccacctgtgggccagcgccggcgtctccgtgcacaccaagcagggatggaagggcgccaaccaggacgccatgaccgtctgccaggacttcgccggccagaaaggtcacatcctctgcggagtgttcgatggccacggccctcgtggccgggaagtcgctcgccacgtccgcgacaccctccccggtggggactagcccgccgctctgaaagccgagaacgggggacgaagatcccctccgcctcgagcgacgccttcgaaagcctaaacctgaacgaagatggccccangcgaagaatgggagaagaatggctcanggcaaagaatgggagaacgcttcgaccaacgcccgaat

SEQ ID NO: 86534 - protein, 97 aa, Zea mays
  misc_feature: Ceres CLONE 1572967
  misc_feature: SWISSPROT Homolog: EC 3.1.3.16 Phosphoprotein phosphatase
MGICCGKAKAAAGEPDDDEGLGFPWMHDDLFHSHLWASAGVSVHTKQGWKGANQDAMTVCQDFAGQKGHILCGVFDGHGPRGREVARHVRDTLPGGD
